(12) United States Patent
Cutcliffe et al.

(10) Patent No.: US 9,486,487 B2
(45) Date of Patent: Nov. 8, 2016

(54) METHODS AND COMPOSITIONS RELATING TO MICROBIAL TREATMENT AND DIAGNOSIS OF DISORDERS

(71) Applicant: Whole Biome, Inc., San Francisco, CA (US)

(72) Inventors: Colleen Cutcliffe, Menlo Park, CA (US); John S. Eid, San Francisco, CA (US); James H. Bullard, San Francisco, CA (US); Marcus F. Schicklberger, Richmond, CA (US)

(73) Assignee: WHOLE BIOME INC., San Francisco, CA (US)

( * ) Notice: Subject to any disclaimer, the term of this patent is extended or adjusted under 35 U.S.C. 154(b) by 0 days.

(21) Appl. No.: 15/139,097

(22) Filed: Apr. 26, 2016

(65) Prior Publication Data

US 2016/0228476 A1 Aug. 11, 2016

Related U.S. Application Data

(63) Continuation of application No. PCT/US2015/058511, filed on Oct. 30, 2015.

(60) Provisional application No. 62/073,912, filed on Oct. 31, 2014.

(51) Int. Cl.

| | | |
|---|---|---|
| C12N 1/12 | (2006.01) |
| A61K 35/745 | (2015.01) |
| A61K 35/74 | (2015.01) |
| C12N 1/20 | (2006.01) |
| A61K 45/06 | (2006.01) |
| A61K 31/00 | (2006.01) |
| A23L 1/30 | (2006.01) |
| A61K 9/00 | (2006.01) |
| A61K 9/28 | (2006.01) |
| A61K 9/48 | (2006.01) |
| A61K 31/733 | (2006.01) |
| A61K 35/741 | (2015.01) |
| A61K 35/742 | (2015.01) |

(52) U.S. Cl.
CPC ............ *A61K 35/745* (2013.01); *A23L 1/3014* (2013.01); *A61K 9/0053* (2013.01); *A61K 9/2846* (2013.01); *A61K 9/48* (2013.01); *A61K 31/00* (2013.01); *A61K 31/733* (2013.01); *A61K 35/74* (2013.01); *A61K 35/741* (2013.01); *A61K 35/742* (2013.01); *A61K 45/06* (2013.01); *C12N 1/20* (2013.01); *A23V 2002/00* (2013.01); *G01N 2333/605* (2013.01); *G01N 2800/04* (2013.01)

(58) Field of Classification Search
CPC .................................................... C12R 1/145
See application file for complete search history.

(56) References Cited

U.S. PATENT DOCUMENTS

| | | |
|---|---|---|
| 5,744,134 A | 4/1998 | Paul |
| 6,028,098 A | 2/2000 | Goodman et al. |
| 6,241,983 B1 | 6/2001 | Paul et al. |
| 6,960,341 B2 | 11/2005 | Viscomi et al. |
| 7,101,565 B2 | 9/2006 | Monte |
| 7,195,906 B2 | 3/2007 | Collins et al. |
| 7,785,581 B2 | 8/2010 | Cui |
| 7,988,960 B2 | 8/2011 | Isolauri et al. |
| 8,329,672 B2 | 12/2012 | Rull et al. |
| 8,343,482 B2 | 1/2013 | Bergonzelli et al. |
| 8,557,233 B2 | 10/2013 | Macsharry et al. |
| 8,709,398 B2 | 4/2014 | Macsharry et al. |
| 8,734,783 B2 | 5/2014 | Mogna et al. |
| 8,802,179 B2 | 8/2014 | Miller |
| 8,906,668 B2 | 12/2014 | Henn et al. |
| 8,951,512 B2 | 2/2015 | Blaser et al. |
| 9,011,834 B1 | 4/2015 | McKenzie et al. |
| 9,028,841 B2 | 5/2015 | Henn et al. |
| 9,173,910 B2 | 11/2015 | Kaplan et al. |
| 9,180,147 B2 | 11/2015 | McKenzie et al. |
| 9,259,447 B2 | 2/2016 | Burcelin et al. |
| 2005/0112112 A1 | 5/2005 | Park et al. |
| 2006/0115465 A1 | 6/2006 | Macfarlane et al. |
| 2009/0169531 A1 | 7/2009 | Lacoste et al. |
| 2010/0086528 A1 | 4/2010 | Olofsson et al. |
| 2011/0287072 A1 | 11/2011 | Ritter et al. |
| 2012/0107291 A1 | 5/2012 | Burcelin et al. |
| 2012/0230956 A1 | 9/2012 | McLean et al. |
| 2013/0224155 A1 | 8/2013 | Kaplan et al. |
| 2014/0037688 A1 | 2/2014 | Berkes et al. |
| 2014/0079676 A1 | 3/2014 | Olmstead |
| 2014/0093478 A1 | 4/2014 | Turnbaugh et al. |

(Continued)

FOREIGN PATENT DOCUMENTS

| | | |
|---|---|---|
| CN | 105030841 A | 11/2015 |
| CN | 105106245 A | 12/2015 |
| WO | WO-0188095 A1 | 11/2001 |
| WO | WO-2006013441 A2 | 2/2006 |
| WO | WO-2007125566 A2 | 11/2007 |

(Continued)

OTHER PUBLICATIONS

Donohoe, et al. The microbiome and butyrate regulate energy metabolism and autophagy in the mammalian colon. Cell Metab. May 4, 2011;13(5):517-26. doi: 10.1016/j.cmet.2011.02.018.

(Continued)

*Primary Examiner* — Ruth Davis
(74) *Attorney, Agent, or Firm* — Wilson Sonsini Goodrich & Rosati

(57) ABSTRACT

The present disclosure provides methods, systems, compositions, and kits to address the need for microbiome-related treatment of health conditions and disease. The present disclosure provides for treatment of metabolic conditions using microbial compositions.

16 Claims, 16 Drawing Sheets

(56) References Cited

U.S. PATENT DOCUMENTS

| | | |
|---|---|---|
| 2014/0286920 A1 | 9/2014 | Mayra-Makinen et al. |
| 2014/0294774 A1 | 10/2014 | Nieuwdorp et al. |
| 2015/0190435 A1 | 7/2015 | Henn et al. |
| 2015/0246081 A1 | 9/2015 | Morris |
| 2015/0306152 A1 | 10/2015 | Cani et al. |
| 2015/0306156 A1 | 10/2015 | Borody |
| 2015/0320805 A9 | 11/2015 | Honda et al. |
| 2016/0000838 A1 | 1/2016 | Harmsen et al. |
| 2016/0030494 A1 | 2/2016 | Henn et al. |
| 2016/0040215 A1 | 2/2016 | Henn et al. |
| 2016/0113971 A1 | 4/2016 | Kaplan et al. |
| 2016/0199424 A1 | 7/2016 | Berry et al. |

FOREIGN PATENT DOCUMENTS

| | | |
|---|---|---|
| WO | WO-2008076696 A2 | 6/2008 |
| WO | WO-2010146568 A2 | 12/2010 |
| WO | WO-2011135194 A2 | 11/2011 |
| WO | WO-2013032328 A1 | 3/2013 |
| WO | WO-2013050833 A1 | 4/2013 |
| WO | WO-2014076246 A1 | 5/2014 |
| WO | WO-2014082050 A1 | 5/2014 |
| WO | WO-2014121298 A2 | 8/2014 |
| WO | WO-2014121301 A1 | 8/2014 |
| WO | WO-2014121302 A2 | 8/2014 |
| WO | WO-2014121304 A1 | 8/2014 |
| WO | WO-2014137211 A1 | 9/2014 |
| WO | WO-2014153194 A2 | 9/2014 |
| WO | WO-2015051323 A1 | 4/2015 |
| WO | WO-2015067936 A1 | 5/2015 |
| WO | WO-2015067938 A1 | 5/2015 |
| WO | WO-2015067947 A1 | 5/2015 |
| WO | WO-2015067948 A1 | 5/2015 |
| WO | WO-2015067949 A1 | 5/2015 |
| WO | WO-2015077794 A1 | 5/2015 |
| WO | WO-2015095241 A2 | 6/2015 |
| WO | WO-2015189472 A1 | 12/2015 |

OTHER PUBLICATIONS

Baffoni, et al. Effect of dietary supplementation of Bifidobacterium and Lactobacillus strains in *Apis mellifera* L. against Nosema ceranae. Benef Microbes. Nov. 13, 2015:1-8. [Epub ahead of print].

Diaz Heijtz, et al. Normal gut microbiota modulates brain development and behavior. Proc Natl Acad Sci U S A. Feb. 15, 2011;108(7):3047-52. doi: 10.1073/pnas.1010529108. Epub Jan. 31, 2011.

Donohoe, et al. A gnotobiotic mouse model demonstrates that dietary fiber protects against colorectal tumorigenesis in a microbiota- and butyrate-dependent manner. Cancer Discov. Dec. 2014;4(12):1387-97. doi: 10.1158/2159-8290.CD-14/0501. Epub Sep. 29, 2014.

Erickson, et al. Integrated metagenomics/metaproteomics reveals human host-microbiota signatures of Crohn's disease. PLoS One. 2012;7(11):e49138. doi: 10.1371/journal.pone.0049138. Epub Nov. 28, 2012.

Hamer, et al. Review article: the role of butyrate on colonic function. Aliment Pharmacol Ther. Jan. 15, 2008;27(2):104-19. Epub Oct. 25, 2007.

Hansen, et al. Early life treatment with vancomycin propagates Akkermansia muciniphila and reduces diabetes incidence in the NOD mouse. Diabetologia. Aug. 2012;55(8):2285-94. doi: 10.1007/s00125-012-2564-7. Epub May 10, 2012.

Knip, et al. The role of the intestinal microbiota in type 1 diabetes mellitus. Nat Rev Endocrinol. Mar. 2016;12(3):154-67. doi: 10.1038/nrendo.2015.218. Epub Jan. 4, 2016.

Le Barz, et al. Probiotics as Complementary Treatment for Metabolic Disorders. Diabetes Metab J. Aug. 2015; 39(4): 291-303. doi:10.4093/dmj.2015.39.4.291.

Nylund, et al. Severity of atopic disease inversely correlates with intestinal microbiota diversity and butyrate-producing bacteria. Allergy. Feb. 2015;70(2):241-4. doi: 10.1111/all.12549.

Rao, et al. A randomized, double-blind, placebo-controlled pilot study of a probiotic in emotional symptoms of chronic fatigue syndrome. Gut Pathog. Mar. 19, 2009;1(1):6. doi: 10.1186/1757-4749-1-6.

Segain, et al. Butyrate inhibits inflammatory responses through NFkappaB inhibition: implications for Crohn's disease. Gut. Sep. 2000;47(3):397-403.

Takahashi, et al. Reduced Abundance of Butyrate-Producing Bacteria Species in the Fecal Microbial Community in Crohn's Disease. Digestion. 2016;93(1):59-65. doi: 10.1159/000441768. Epub Jan. 14, 2016.

Takaishi, et al. Imbalance in intestinal microflora constitution could be involved in the pathogenesis of inflammatory bowel disease. Int J Med Microbiol. Jul. 2008;298(5-6):463-72. Epub Sep. 25, 2007.

Vipperla, et al. Diet, microbiota, and dysbiosis: a 'recipe' for colorectal cancer. Food Funct. Apr. 20, 2016;7(4):1731-40. doi: 10.1039/c5fo01276g.

Wedlake, et al. Fiber in the treatment and maintenance of inflammatory bowel disease: a systematic review of randomized controlled trials. Inflamm Bowel Dis. Mar. 2014;20(3):576-86.doi: 10.1097/01.MIB.0000437984.92565.31.

Zeng, et al. Mechanisms linking dietary fiber, gut microbiota and colon cancer prevention. World J Gastrointest Oncol. Feb. 15, 2014;6(2):41-51. doi: 10.4251/wjgo.v6.i2.41.

Zhu, et al. Gut microbiome and nonalcoholic fatty liver diseases. Pediatr Res. Jan. 2015;77(1-2):245-51. doi: 10.1038/pr.2014.157. Epub Oct. 13, 2014.

Allen, et al. Probiotic May Help Alleviate Stress-Related Conditions. Society for Neuroscience (SfN) 2015 Annual Meeting. Abstract 162.04. Presented Oct. 18, 2015.

Asano, et al. Critical role of gut microbiota in the production of biologically active, free catecholamines in the gut lumen of mice. Am J Physiol Gastrointest Liver Physiol. Dec. 1, 2012;303(11):G1288-95. doi: 10.1152/ajpgi.00341.2012. Epub Oct. 11, 2012.

Bravo, Ingestion of Lactobacillus strain regulates emotional behavior and central GABA receptor expression in a mouse via the vagus nerve. Proc Natl Acad Sci U S A. Sep. 20, 2011;108(38):16050-5. doi: 10.1073/pnas.1102999108. Epub Aug. 29, 2011.

"Clarke, G. Society for Neuroscience (SfN) 2015 Annual Meeting. Abstract 162.04. Presented Oct. 18, 2015."

Everard; et al., "Cross-talk between Akkermansia muciniphila and intestinal epithelium controls diet-induced obesity. Proc Natl Acad Sci U S A. May 28, 2013;110(22):9066-71. doi: 10.1073/pnas.1219451110. Epub May 13, 2013."

Hu; et al., "Type 1 Diabetes and Gut Microbiota: Friend or Foe? Pharmacological Research 98 (2015): 9-15."

"International search report and written opinion dated Jan. 27, 2016 for PCT Application No. US2015/058511."

"Karlsson, et al. Gut metagenome in European women with normal, impaired and diabetic glucose control. Nature. Jun. 6, 2013;498(7452):99-103. doi: 10.1038/nature12198. Epub May 29, 2013."

"Louis et al. Diversity, metabolismand microbial ecology of butyrate-producing bacteria from the human large intestine. FEMS Microbiol Lett. 2009, vol. 294(1), p. 1-8."

Messaoudi, et al. Assessment of psychotropic-like properties of a probiotic formulation (Lactobacillus helveticus R0052 and Bifidobacterium longum R0175) in rats and human subjects. Br J Nutr. Mar. 2011;105(5):755-64. doi: 10.1017/S0007114510004319. Epub Oct. 26, 2010.

"Naruszewicz, et al. Effect of Lactobacillus plantarum 299v on cardiovascular disease risk factors in smokers. Am J Clin Nutr. Dec. 2002;76(6):1249-55."

O'Keefe, et al. Fat, fibre and cancer risk in African Americans and rural Africans. Nat Commun. Apr. 28, 2015;6:6342. doi: 10.1038/ncomms7342.

"Parnell, et al. Weight loss during oligofructose supplementation is associated with decreased ghrelin and increased peptide YY in overweight and obese adults. Am J Clin Nutr. Jun. 2009;89(6):1751-9. doi: 10.3945/ajcn.2009.27465. Epub Apr. 22, 2009."

(56) References Cited

OTHER PUBLICATIONS

"Puddu et al. Evidence for the Gut Microbiota Short-Chain Fatty Acids as Key Pathophysiologicat Molecules Improving Diabetes. Mediators Inflamm. vol. 2014;2014:162021. Epub Aug. 17, 2014."
"Queipo-Ortuno, et al. Gut microbiota composition in male rat models under different nutritional status and physical activity and its association with serum leptin and ghrelin levels. PLoS One. May 28, 2013;8(5):e65465. doi: 10.1371/journal.pone.0065465. Print 2013."
Ravussin, et al. Responses of gut microbiota to diet composition and weight loss in lean and obese mice. Obesity (Silver Spring). Apr. 2012;20(4):738-47. doi: 10.1038/oby.2011.111. Epub May 19, 2011.
Registad, et al. Gut microbes promote colonic serotonin production through an effect of short-chain fatty acids on enterochromaffin cells. FASEB J. Apr. 2015;29(4):1395-403. doi: 10.1096/fj.14-259598. Epub Dec. 30, 2014.
"Roshchina, V. Evolutionary Considerations of Neurotransmitters in Microbial, Plant, and Animal Cells. In: Lyte M, Fitzgerald P (eds). Microbial Endocrinology: Interkingdom Signaling in Infectious Disease and Health. New York: Springer, Feb. 2010, pp. 17-52."
"Vital et al. Revealing the Bacterial Butyrate Synthesis Pathways by Analyzing (Meta)genomic Data. MBio. Apr. 22, 2014, vol. 5(2):e00889."
Vrieze, et al. Transfer of intestinal microbiota from lean donors increases insulin sensitivity in individuals with metabolic syndrome. Gastroenterology. Oct. 2012;143(4):913-6.e7. doi: 10.1053/j.gastro.2012.06.031. Epub Jun. 20, 2012.
Yadav, et al. Beneficial metabolic effects of a probiotic via butyrate-induced GLP-1 hormone secretion. J Biol Chem. Aug. 2013;288(35):25088-97. doi: 10.1074/jbc.M113.452516. Epub Jul. 8, 2013.
Gomez-Gallego, et al. Akkermansia muciniphila: a novel functional microbe with probiotic properties. Benef Microbes. Jun. 13, 2016:1-14. doi:10.3920/BM2016.0009.
International search report and written opinion dated Jun. 17, 2016 for PCT/US2016/023311.
Li, et al. Akkermansia Muciniphila Protects Against Atherosclerosis by Preventing Metabolic Endotoxemia-Induced Inflammation in Apoe-/- Mice. Circulation. Jun. 14, 2016;133(24):2434-46. doi: 10.1161/CIRCULATIONAHA.115.019645. Epub Apr. 25, 2016.
Ong, et al. Endogenous antimicrobial peptides and skin infections in atopic dermatitis. N Engl J Med. Oct. 10, 2002;347(15):1151-60.
Abrahamsson, et al. Low Diversity of the Gut Microbiota in Infants with Atopic Eczema. J Allergy Clin. Immunol. 2012; 129:434-40.
Baviera, et al. Microbiota in Healthy Skin and in Atopic Eczema. Hindawi Publishing Corporation, BioMed Research International, vol. 2014.
Flores, et al. Microbiome of Affected and Unaffected Skin of Patients with Atopic Dermatitis Before and After Emollient Treatment. Journal of Drugs in Dermatology, Nov. 2014, vol. 13, Issue 11, pp. 611-618.
Flores, et al. Skin Microbiome Diversity in Patients with Atopic Dermatitis Before and After Emollient Treatment.
Grice, E. The Skin Microbiome: Potential for Novel Diagnostic and Therapeutic Approaches to Cutaneous Disease. Semin Cutan Med Surg, 2014, 33:98-103.
Isolauri, et al. Probiotics in the management of atopic eczema. Clin Exp Allergy. Nov. 2000;30(11):1604-10.
Kalliomaki, et al. Probiotics in primary prevention of atopic disease: a randomised placebo-controlled trial. Lancet. Apr. 7, 2001;357(9262):1076-9.
Kim, et al. Effects of Probiotics for the Treatment of Atopic Dermatitis: A Meta-Analysis of Randomized Controlled Trials. Ann. Allergy Asthma Immunol 113 (2014): 217-226.
Kong, et al. Temporal Shifts in the Skin Microbiome Associated with Disease Flares and Treatment in Children with Atopic Dermatitis. Genome Res. 2012, 22: 850-859.
Lamont. Infection in the prediction and antibiotics in the prevention of spontaneous preterm labour and preterm birth. BJOG: an International Journal of Obstetrics and Gynaecology. 2003; 110(Suppl 20):71-75.
Meneghin, et al. Probiotics and atopic dermatitis in children. Pharmaceuticals (Basel). Jul. 6, 2012;5(7):727-44. doi: 10.3390/ph5070727.
Nylund, et al. Severity of Atopic Disease Inversely Correlates with Intestinal Microbiota Diversity and Butyrate-Producing Bacteria.
Oh, et al. Shifts in Human Skin and Nares Microbiota of Healthy Children and Adults. Genome Medicine 2012, 4:77.
Rosenfeldt, et al. Effect of probiotic Lactobacillus strains in children with atopic dermatitis. J Allergy Clin Immunol. Feb. 2003;111(2):389-95.
Sanmiguel, et al. Interactions between Host Factors and the Skin Microbiome. Cell. Mol. Life Sci., Dec. 2014.
Tollefson, et al. Atopic Dermatitis: Skin-Directed Management. Pediatrics vol. 134, No. 6, Dec. 2014, pp. e1735-e1744.
Co-pending U.S. Appl. No. 15/074,923, filed Mar. 18, 2016.

(A) Standard Resolution

METHODS AND COMPOSITIONS RELATING TO MICROBIAL TREATMENT AND DIAGNOSIS OF DISORDERS

CROSS REFERENCE

This application is a continuation of PCT Application No. PCT/US15/58511 filed Oct. 30, 2015, which claims the benefit of U.S. Provisional Application Ser. No. 62/073,912, filed on Oct. 31, 2014, the content of each of which is incorporated herein by reference in its entirety.

BACKGROUND OF THE INVENTION

The body of an individual is inhabited by trillions of microbes across various locations, often referred to as microbiomes. Microbiomes can play a key role in many health conditions and diseases. Despite the interrelation between microbiomes and health, the complexity of the various microbiomes, as well as difficulties in characterizing, categorizing, and analyzing microbiome constituents has made understanding microbiomes challenging. Consequently, these challenges have presented hurdles in the development of diagnostic and therapeutic applications for microbiome-related health conditions and diseases. The present disclosure provides methods, systems, compositions, and kits to address the need for microbiome-related treatment of health conditions and disease.

SEQUENCE LISTING

The instant application contains a Sequence Listing which has been submitted in ASCII format via EFS-Web and is hereby incorporated by reference in its entirety. Said ASCII copy, created on Oct. 30, 2015, is named 46790-702.601.txt and is 36,254,267 bytes in size.

SUMMARY OF THE INVENTION

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe that alters glucagon-like peptide-1 (GLP-1) production, and a pharmaceutically-acceptable carrier.

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe that encodes for an enzyme selected from the group consisting of: butyrate kinase, butyrate coenzyme A, butyrate coenzyme a transferase, and any combination thereof, and a pharmaceutically-acceptable carrier.

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe that is capable of producing butyrate, and a pharmaceutically-acceptable carrier.

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe with at least about 85% sequence identity to a rRNA sequence of *Akkermansia muciniphilia*, and a pharmaceutically-acceptable carrier.

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe with at least about 85% sequence identity to a rRNA sequence of *Anaerostipes caccae*, and a pharmaceutically-acceptable carrier.

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe with at least about 85% sequence identity to a rRNA sequence of *Bifidobacterium adolescentis*, and a pharmaceutically-acceptable carrier.

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe with at least about 85% sequence identity to a rRNA sequence of *Bifidobacterium bifidum*, and a pharmaceutically-acceptable carrier.

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe with at least about 85% sequence identity to a rRNA sequence of *Bifidobacterium infantis*, and a pharmaceutically-acceptable carrier.

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe with at least about 85% sequence identity to a rRNA sequence of *Bifidobacterium longum*, and a pharmaceutically-acceptable carrier.

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe with at least about 85% sequence identity to a rRNA sequence of *Butyrivibrio fibrisolvens*, and a pharmaceutically-acceptable carrier.

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe with at least about 85% sequence identity to a rRNA sequence of *Clostridium acetobutylicum*, and a pharmaceutically-acceptable carrier.

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe with at least about 85% sequence identity to a rRNA sequence of *Clostridium beijerinckii*, and a pharmaceutically-acceptable carrier.

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe with at least about 85% sequence identity to a rRNA sequence of *Clostridium butyricum*, and a pharmaceutically-acceptable carrier.

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe with at least about 85% sequence identity to a rRNA sequence of *Clostridium colinum*, and a pharmaceutically-acceptable carrier.

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe with at least about 85% sequence identity to a rRNA sequence of *Clostridium indolis*, and a pharmaceutically-acceptable carrier.

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe with at least about 85% sequence identity to a rRNA sequence of *Enterococcus faecium*, and a pharmaceutically-acceptable carrier.

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe with at least about 85% sequence identity to a rRNA sequence of *Eubacterium hallii*, and a pharmaceutically-acceptable carrier.

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe with at least about 85% sequence identity to a rRNA sequence of *Eubacterium rectale*, and a pharmaceutically-acceptable carrier.

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe with at least about 85% sequence identity to a rRNA sequence of *Faecalibacterium prausnitzii*, and a pharmaceutically-acceptable carrier.

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe with at least about 85% sequence identity to a rRNA sequence of *Fibrobacter succinogenes*, and a pharmaceutically-acceptable carrier.

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe with at least about 85% sequence identity to a rRNA sequence of *Lactobacillus acidophilus*, and a pharmaceutically-acceptable carrier.

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe with at least about 85% sequence identity to a rRNA sequence of *Lactobacillus brevis*, and a pharmaceutically-acceptable carrier.

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe with at least about 85% sequence identity to a rRNA sequence of *Lactobacillus bulgaricus*, and a pharmaceutically-acceptable carrier.

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe with at least about 85% sequence identity to a rRNA sequence of *Lactobacillus casei*, and a pharmaceutically-acceptable carrier.

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe with at least about 85% sequence identity to a rRNA sequence of *Lactobacillus caucasicus*, and a pharmaceutically-acceptable carrier.

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe with at least about 85% sequence identity to a rRNA sequence of *Lactobacillus fermentum*, and a pharmaceutically-acceptable carrier.

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe with at least about 85% sequence identity to a rRNA sequence of *Lactobacillus helveticus*, and a pharmaceutically-acceptable carrier.

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe with at least about 85% sequence identity to a rRNA sequence of *Lactobacillus lactis*, and a pharmaceutically-acceptable carrier.

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe with at least about 85% sequence identity to a rRNA sequence of *Lactobacillus plantarum*, and a pharmaceutically-acceptable carrier.

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe with at least about 85% sequence identity to a rRNA sequence of *Lactobacillus reuteri*, and a pharmaceutically-acceptable carrier.

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe with at least about 85% sequence identity to a rRNA sequence of *Lactobacillus rhamnosus*, and a pharmaceutically-acceptable carrier.

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe with at least about 85% sequence identity to a rRNA sequence of *Roseburia cecicola*, and a pharmaceutically-acceptable carrier.

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe with at least about 85% sequence identity to a rRNA sequence of *Roseburia inulinivorans*, and a pharmaceutically-acceptable carrier.

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe with at least about 85% sequence identity to a rRNA sequence of *Ruminococcus flavefaciens*, and a pharmaceutically-acceptable carrier.

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe with at least about 85% sequence identity to a rRNA sequence of *Ruminococcus gnavus*, and a pharmaceutically-acceptable carrier.

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe with at least about 85% sequence identity to a rRNA sequence of *Streptococcus cremoris*, and a pharmaceutically-acceptable carrier.

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe with at least about 85% sequence identity to a rRNA sequence of *Streptococcus faecium*, and a pharmaceutically-acceptable carrier.

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe with at least about 85% sequence identity to a rRNA sequence of *Streptococcus infantis*, and a pharmaceutically-acceptable carrier.

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe with at least about 85% sequence identity to a rRNA sequence of *Streptococcus mutans*, and a pharmaceutically-acceptable carrier.

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe with at least about 85% sequence identity to a rRNA sequence of *Streptococcus thermophilus*, and a pharmaceutically-acceptable carrier.

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe with at least about 85% sequence identity to a rRNA sequence of *Clostridium aminophilum*, and a pharmaceutically-acceptable carrier.

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe with at least about 85% sequence identity to a rRNA sequence of *Clostridium orbiscindens*, and a pharmaceutically-acceptable carrier.

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe with at least about 85% sequence identity to a rRNA sequence of *Oscillospira guilliermondii*, and a pharmaceutically-acceptable carrier.

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe with at least about 85% sequence identity to a rRNA sequence of *Ruminococcus obeum*, and a pharmaceutically-acceptable carrier.

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe with at least about 85% sequence identity to a rRNA sequence of *Anaerofustis stercorihominis*, and a pharmaceutically-acceptable carrier.

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe with at least about 85% sequence identity to a rRNA sequence of *Anaerostipes hadrus*, and a pharmaceutically-acceptable carrier.

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe with at least about 85% sequence identity to a rRNA sequence of *Anaerotruncus colihominis*, and a pharmaceutically-acceptable carrier.

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe with at least about 85% sequence identity to a rRNA sequence of *Clostridium sporogenes*, and a pharmaceutically-acceptable carrier.

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe with at least about 85% sequence identity to a rRNA sequence of *Clostridium tetani*, and a pharmaceutically-acceptable carrier.

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe with at least about 85% sequence identity to a rRNA sequence of *Coprococcus*, and a pharmaceutically-acceptable carrier.

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe with at least about 85% sequence identity to a rRNA sequence of *Coprococcus eutactus*, and a pharmaceutically-acceptable carrier.

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe with at least about 85% sequence identity to a rRNA sequence of *Eubacterium cylindroides*, and a pharmaceutically-acceptable carrier.

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe with at least about 85% sequence identity to a rRNA sequence of *Eubacterium dolichum*, and a pharmaceutically-acceptable carrier.

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe with at least about 85% sequence identity to a rRNA sequence of *Eubacterium ventriosum*, and a pharmaceutically-acceptable carrier.

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe with at least about 85% sequence identity to a rRNA sequence of *Roseburia faeccis*, and a pharmaceutically-acceptable carrier.

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe with at least about 85% sequence identity to a rRNA sequence of *Roseburia hominis*, and a pharmaceutically-acceptable carrier.

In some embodiments, this invention comprises a method of treating a metabolic disorder in a subject in need thereof, the method comprising: administering a therapeutically-effective amount of a pharmaceutical composition comprising a population of isolated and purified microbe, wherein at least one of said microbes comprises a microbe with at least about 85% sequence identity to a rRNA sequence of *Roseburia intestinalis*, and a pharmaceutically-acceptable carrier.

A method of treating a metabolic disorder in a subject in need thereof, the method comprising: administering a therapeutically-effective amount of a pharmaceutical composition comprising a population of isolated and purified microbe, wherein at least one of said microbes comprises a microbe with at least about 85% sequence identity to a rRNA sequence of a microbe selected from the group consisting of: *Akkermansia muciniphila, Anaerostipes caccae, Bifidobacterium adolescentis, Bifidobacterium bifidum, Bifidobacterium infantis, Bifidobacterium longum, Butyrivibrio fibrisolvens, Clostridium acetobutylicum, Clostridium aminophilum, Clostridium beijerinckii, Clostridium butyricum, Clostridium colinum, Clostridium indolis, Clostridium orbiscindens, Enterococcus faecium, Eubacterium hallii, Eubacterium rectale, Faecalibacterium prausnitzii, Fibrobacter succinogenes, Lactobacillus acidophilus, Lactobacillus brevis, Lactobacillus bulgaricus, Lactobacillus casei, Lactobacillus caucasicus, Lactobacillus fermentum, Lactobacillus helveticus, Lactobacillus lactis, Lactobacillus plantarum, Lactobacillus reuteri, Lactobacillus rhamnosus, Oscillospira guilliermondii, Roseburia cecicola, Roseburia inulinivorans, Ruminococcus flavefaciens, Ruminococcus gnavus, Ruminococcus obeum, Streptococcus cremoris, Streptococcus faecium, Streptococcus infantis, Streptococcus mutans, Streptococcus thermophilus, Anaerofustis stercorihominis, Anaerostipes hadrus, Anaerotruncus colihominis, Clostridium sporogenes, Clostridium tetani, Coprocoaccus, Coprococcus eutactus, Eubacterium cylindroides, Eubacterium dolichum, Eubacterium ventriosum, Roseburia faeccis, Roseburia hominis, Roseburia intestinalis*, and any combination thereof.

The method of any of the preceding embodiments, wherein said treating results in a subject with an altered microbiome.

The method of any of the preceding embodiments, wherein said treating results in a subject with an altered gut microbiome.

The method of any of the preceding embodiments, wherein the pharmaceutical composition further comprises a second population of isolated and purified microbe. In some aspects, the method may further comprise a second population of isolated and purified microbe, wherein said second population comprises a microbe with at least about 85% sequence identity to a rRNA sequence of a microbe selected from the group consisting of: *Akkermansia muciniphila, Anaerostipes caccae, Bifidobacterium adolescentis, Bifidobacterium bifidum, Bifidobacterium infantis, Bifidobacterium longum, Butyrivibrio fibrisolvens, Clostridium acetobutylicum, Clostridium aminophilum, Clostridium beijerinckii, Clostridium butyricum, Clostridium colinum, Clostridium indolis, Clostridium orbiscindens, Enterococcus faecium, Eubacterium hallii, Eubacterium rectale, Faecalibacterium prausnitzii, Fibrobacter succinogenes, Lactobacillus acidophilus, Lactobacillus brevis, Lactobacillus bulgaricus, Lactobacillus casei, Lactobacillus caucasicus, Lactobacillus fermentum, Lactobacillus helveticus, Lactobacillus lactis, Lactobacillus plantarum, Lactobacillus reuteri, Lactobacillus rhamnosus, Oscillospira guilliermondii, Roseburia cecicola, Roseburia inulinivorans, Ruminococcus flavefaciens, Ruminococcus gnavus, Ruminococcus obeum, Streptococcus cremoris, Streptococcus faecium, Streptococcus infantis, Streptococcus mutans, Streptococcus thermophilus, Anaerofustis stercorihominis, Anaerostipes hadrus, Anaerotruncus colihominis, Clostridium sporogenes, Clostridium tetani, Coprococcus, Coprococcus eutactus, Eubacterium cylindroides, Eubacterium dolichum, Eubacterium ventriosum, Roseburia faeccis, Roseburia hominis, Roseburia intestinalis*, and any combination thereof.

The method of any of the preceding embodiments, wherein said metabolic disorder is obesity.

The method of any of the preceding embodiments, wherein said metabolic disorder is insulin insensitivity.

The method of any of the preceding embodiments, wherein said metabolic disorder is Type 2 Diabetes Mellitus.

The method of any of the preceding embodiments, wherein said treating results in the subject losing weight as compared to a pre-treatment level.

The method of any of the preceding embodiments, wherein said treating results in the subject having increased insulin sensitivity as compared to a pre-treatment level.

The method of any of the preceding embodiments, wherein said treating results in the subject having reduced symptoms associated with the metabolic disorder as compared to a pre-treatment level.

The method of any of the preceding embodiments, wherein said subject is a subject enrolled in a clinical study.

The method of any of the preceding embodiments, wherein said at least about 85% sequence identity is selected from the group consisting of: at least about 96%, at least about 97%, at least about 98%, at least about 99%, at least about 99.5%, and at least about 99.5% sequence identity to a rRNA sequence.

The method of any of the preceding embodiments, wherein said pharmaceutical composition is substantially free of fecal matter obtained from a subject.

The method of any of the preceding embodiments, wherein said at least one of said microbes comprises a population of said microbes.

The method of any of the preceding embodiments, wherein said rRNA sequence is a 16S rRNA sequence.

The method of any of the preceding embodiments, wherein said rRNA sequence is a 23S rRNA sequence.

The method of any of the preceding embodiments, wherein said rRNA sequence is both a 16S rRNA sequence and a 23S rRNA sequence.

The method of any of the preceding embodiments, wherein the pharmaceutical composition is formulated for oral delivery.

The method of any of the preceding embodiments, wherein the pharmaceutical composition is formulated for anal delivery.

The method of any of the preceding embodiments, wherein the pharmaceutical composition is formulated as a pill.

The method of any of the preceding embodiments, wherein the pharmaceutical composition is formulated as a capsule.

The method of any of the preceding embodiments, wherein the pharmaceutical composition is formulated in a liquid form suitable for administration via an enema.

The method of any of the preceding embodiments, wherein the pharmaceutical composition is formulated as a suppository.

The method of any of the preceding embodiments, wherein the pharmaceutical composition is formulated in a liquid form suitable for delivery via injection.

The method of any of the preceding embodiments, wherein the pharmaceutical composition further comprises a probiotic. In some aspects, the pharmaceutical composition may further comprise a probiotic, said probiotic is selected from the group consisting of: *Akkermansia muciniphila, Anaerostipes caccae, Bifidobacterium adolescentis, Bifido-* bacterium bifidum, Bifidobacterium infantis, Bifidobacterium longum, Butyrivibrio fibrisolvens, Clostridium acetobutylicum, Clostridium aminophilum, Clostridium beijerinckii, Clostridium butyricum, Clostridium colinum, Clostridium indolis, Clostridium orbiscindens, Enterococcus faecium, Eubacterium hallii, Eubacterium rectale, Faecalibacterium prausnitzii, Fibrobacter succinogenes, Lactobacillus acidophilus, Lactobacillus brevis, Lactobacillus bulgaricus, Lactobacillus casei, Lactobacillus caucasicus, Lactobacillus fermentum, Lactobacillus helveticus, Lactobacillus lactis, Lactobacillus plantarum, Lactobacillus reuteri, Lactobacillus rhamnosus, Oscillospira guilliermondii, Roseburia cecicola, Roseburia inulinivorans, Ruminococcus flavefaciens, Ruminococcus gnavus, Ruminococcus obeum, Streptococcus cremoris, Streptococcus faecium, Streptococcus infantis, Streptococcus mutans, Streptococcus thermophilus, Anaerofustis stercorihominis, Anaerostipes hadrus, Anaerotruncus colihominis, Clostridium sporogenes, Clostridium tetani, Coprococcus, Coprococcus eutactus, Eubacterium cylindroides, Eubacterium dolichum, Eubacterium ventriosum, Roseburia faeccis, Roseburia hominis, Roseburia intestinalis, and any combination thereof.

The method of any of the preceding embodiments, wherein the pharmaceutical composition further comprises a prebiotic. In some aspects, the pharmaceutical composition may further comprise a prebiotic, said prebiotic is selected from the group consisting of: complex carbohydrates, complex sugars, resistant dextrins, resistant starch, amino acids, peptides, nutritional compounds, biotin, polydextrose, fructooligosaccharide (FOS), galactooligosaccharides (GOS), inulin, starch, lignin, psyllium, chitin, chitosan, gums (e.g. guar gum), high amylose cornstarch (HAS), cellulose, β-glucans, hemi-celluloses, lactulose, mannooligosaccharides, mannan oligosaccharides (MOS), oligofructose-enriched inulin, oligofructose, oligodextrose, tagatose, trans-galactooligosaccharide, pectin, resistant starch, xylooligosaccharides (XOS), and any combination thereof. In some aspects, said prebiotic is inulin.

The method of any of the preceding embodiments, wherein the pharmaceutical composition is co-administered with an antibiotic.

The method of any of the preceding embodiments, wherein the pharmaceutical composition is administered after an antibiotic. In some aspects, the method may comprise administering the pharmaceutical composition after an antibiotic, wherein the pharmaceutical composition is administered at least one hour after an antibiotic. In some aspects, the method may comprise administering the pharmaceutical composition after an antibiotic, wherein the pharmaceutical composition is administered at least 2 hours after an antibiotic. In some aspects, the method may comprise administering the pharmaceutical composition after an antibiotic, wherein the pharmaceutical composition is administered at least 12 hours after an antibiotic. In some aspects, the method may comprise administering the pharmaceutical composition after an antibiotic, wherein the pharmaceutical composition is administered at least 1 day after an antibiotic. In some aspects, the method may comprise administering the pharmaceutical composition after an antibiotic, wherein the pharmaceutical composition is administered at least 1 week after an antibiotic. In some aspects, the method may comprise administering the pharmaceutical composition after an antibiotic, wherein the pharmaceutical composition is administered at least 2 weeks after an antibiotic.

The method of any of the preceding embodiments, wherein the pharmaceutical composition is administered after completion of an antibiotic regimen by the subject.

The method of any of the preceding embodiments, wherein the pharmaceutical composition is formulated as a dietary supplement.

The method of any of the preceding embodiments, wherein the pharmaceutical composition is a biologic product.

The method of any of the preceding embodiments, further comprising determining the sequence of a population of the subject's microbiome by sequencing. In some aspects, the method may further comprise determining the sequence of the subject's microbiome by sequencing, said sequencing comprises sequencing the 16S rRNA. In some aspects, the method may further comprise determining the sequence of the subject's microbiome by sequencing, said sequencing comprises sequencing the 23S rRNA. In some aspects, the method may further comprise determining the sequence of the subject's microbiome by sequencing, said sequencing comprises sequencing the 23S and 16S rRNA. In some aspects, the method may further comprise determining the sequence of the subject's microbiome by sequencing, said sequencing comprises Complete Biome Test resolution. In some aspects, said sequencing comprises long-read sequencing. In some aspects, the method may further comprise determining the sequence of the subject's microbiome by sequencing, wherein the determining the sequence of the population of the subject's microbiome is performed before treating the subject with the pharmaceutical composition. In some aspects, the method may further comprise determining the sequence of the subject's microbiome by sequencing, wherein the determining the sequence of the population of the subject's microbiome is performed after treating the subject with the pharmaceutical composition.

The method of any of the preceding embodiments, further comprising transmitting data via machine-readable code.

The method of any of the preceding embodiments, further comprising computing data via machine-readable code.

The method of any of the preceding embodiments, further comprising storing data via machine-readable code.

The method of any of the preceding embodiments, wherein the subject is a mammal.

The method of any of the preceding embodiments, wherein the subject is a laboratory mammal.

The method of any of the preceding embodiments, wherein the subject is a human.

The method of any of the preceding embodiments, wherein said method further comprises a companion diagnostic.

A method of producing the microbes of any of the preceding embodiments, the method comprising genetically-modifying the microbes to generate recombinant microbes. In some aspects, the method may comprise genetically-modifying the microbes to generate recombinant microbes, wherein an operon controls growth of the recombinant microbe.

The method of any of the preceding embodiments, wherein the pharmaceutical composition is formulated as an enteric-coated pill. In some aspects, the method may comprise formulating the pharmaceutical composition as an enteric-coated pill, wherein the enteric-coating is formed by a pH sensitive polymer. In some aspects, the method may comprise formulating the pharmaceutical composition as an enteric-coated pill, wherein the enteric-coating is formed by a pH sensitive polymer, wherein the polymer is eudragit FS30D.

The method of any of the preceding embodiments, wherein the pharmaceutical composition is formulated for delivery of the microbes to the subject's ileum region.

The method of any of the preceding embodiments, wherein the pharmaceutical composition is formulated for delivery of the microbes to the subject's colon region.

The method of any of the preceding embodiments, wherein the pharmaceutical composition is formulated for delivery of the microbes to the subject's ileum and colon region.

The method of any of the preceding embodiments, wherein the pharmaceutical composition is delivered to the subject's ileum region.

The method of any of the preceding embodiments, wherein the pharmaceutical composition is delivered to the subject's colon region.

The method of any of the preceding embodiments, wherein the pharmaceutical composition is delivered to the subject's ileum and colon region.

The method of any of the preceding embodiments, wherein the pharmaceutical composition is administered before food intake. In some aspects, the method may comprise administering the pharmaceutical composition before food intake, wherein the pharmaceutical composition is administered at least one hour before food intake. In some aspects, the method may comprise administering the pharmaceutical composition before food intake, wherein the pharmaceutical composition is administered at least 2 hours before food intake. In some aspects, the method may comprise administering the pharmaceutical composition before food intake, wherein the pharmaceutical composition is administered at least 3 hours before food intake. In some aspects, the method may comprise administering the pharmaceutical composition before food intake, wherein the pharmaceutical composition is administered at least 4 hours before food intake.

The method of any of the preceding embodiments, wherein said microbes are administered with food intake.

The method of any of the preceding embodiments, wherein said microbes comprise a synergistic stability in the pharmaceutical composition as compared to individual strains.

INCORPORATION BY REFERENCE

All publications, patents, and patent applications mentioned in this specification are herein incorporated by reference to the same extent as if each individual publication, patent, or patent application was specifically and individually indicated to be incorporated by reference.

The content of the International Nucleotide Sequence Database Collaboration (DDBJ/EMBL/GENBANK) accession number CP001071.1 for microbial strain *Akkermansia muciniphila*, culture collection ATCC BAA-835, is herein incorporated by reference in its entirety.

The content of DDBJ/EMBL/GENBANK accession number AJ518871.2 for microbial strain *Anaerofustis stercorihominis*, culture collection DSM 17244, is herein incorporated by reference in its entirety.

The content of DDBJ/EMBL/GENBANK accession number DS499744.1 for microbial strain *Anaerostipes caccae*, culture collection DSM 14662, is herein incorporated by reference in its entirety.

The content of DDBJ/EMBL/GENBANK accession number AJ270487.2 for microbial strain *Anaerostipes caccae*, butyrate-producing bacterium L1-92, is herein incorporated by reference in its entirety.

The content of DDBJ/EMBL/GENBANK accession number AY305319.1 for microbial strain *Anaerostipes hadrus*, butyrate-producing bacterium SS2/1, is herein incorporated by reference in its entirety.

The content of DDBJ/EMBL/GENBANK accession number AJ315980.1 for microbial strain *Anaerotruncus colihominis*, culture collection DSM 17241, is herein incorporated by reference in its entirety.

The content of DDBJ/EMBL/GENBANK accession number AP009256.1 for microbial strain, *Bifidobacterium adolescentis*, culture collection ATCC 15703, is herein incorporated by reference in its entirety.

The content of DDBJ/EMBL/GENBANK accession number CP001095.1 for microbial strain *Bifidobacterium longum* subsp. *infantis*, culture collection ATCC 15697, is herein incorporated by reference in its entirety.

The content of DDBJ/EMBL/GenBank accession number U41172.1 for microbial strain *Butyrivibrio fibrisolvens*, culture collection ATCC 19171, is herein incorporated by reference in its entirety.

The content of DDBJ/EMBL/GenBank accession number AJ250365.2 for microbial strain *Butyrivibrio fibrisolvens*, 16.4, is herein incorporated by reference in its entirety.

The content of DDBJ/EMBL/GenBank accession number U41168.1 for microbial strain *Butyrivibrio fibrisolvens*, OB 156, is herein incorporated by reference in its entirety.

The content of DDBJ/EMBL/GenBank accession number AY305305.1 for microbial strain Butyrate-producing bacterium, A2-232, is herein incorporated by reference in its entirety.

The content of DDBJ/EMBL/GenBank accession number AY305316.1 for microbial strain Butyrate-producing bacterium, SS3/4, is herein incorporated by reference in its entirety.

The content of DDBJ/EMBL/GENBANK accession number AE001437.1 for microbial strain *Clostridium acetobutylicum*, culture collection ATCC 824, is herein incorporated by reference in its entirety.

The content of DDBJ/EMBL/GENBANK accession number X78070.1 for microbial strain *Clostridium acetobutylicum*, culture collection DSM 792, is herein incorporated by reference in its entirety.

The content of DDBJ/EMBL/GENBANK accession number CP000721.1 for microbial strain *Clostridium beijerinckii*, culture collection NCIMB 8052, is herein incorporated by reference in its entirety.

The content of DDBJ/EMBL/GENBANK accession number X68189.1 for microbial strain *Clostridium sporogenes*, is herein incorporated by reference in its entirety.

The content of DDBJ/EMBL/GENBANK accession number X74770.1 for microbial strain *Clostridium tetani*, is herein incorporated by reference in its entirety.

The content of DDBJ/EMBL/GENBANK accession number AJ270491.2 for microbial strain *Coprococcus*, butyrate-producing bacterium L2-50, is herein incorporated by reference in its entirety.

The content of DDBJ/EMBL/GENBANK accession number EF031543.1 for microbial strain *Coprococcus eutactus*, culture collection ATCC 27759, is herein incorporated by reference in its entirety.

The content of DDBJ/EMBL/GenBank accession number AY305306.1 for microbial strain *Eubacterium cylindroides*, butyrate-producing bacterium T2-87, is herein incorporated by reference in its entirety.

The content of DDBJ/EMBL/GenBank accession number AY305313.1 for microbial strain *Eubacterium cylindroides*, butyrate-producing bacterium SM7/11, is herein incorporated by reference in its entirety.

The content of DDBJ/EMBL/GenBank accession number L34682.2 for microbial strain *Eubacterium dolichum*, culture collection DSM 3991, is herein incorporated by reference in its entirety.

The content of DDBJ/EMBL/GenBank accession number AJ270490.2 for microbial strain *Eubacterium halii*, butyrate-producing bacterium L2-7, is herein incorporated by reference in its entirety.

The content of DDBJ/EMBL/GenBank accession number AY305318.1 for microbial strain *Eubacterium halii*, butyrate-producing bacterium SM6/1, is herein incorporated by reference in its entirety.

The content of DDBJ/EMBL/GenBank accession number L34621.2 for microbial strain *Eubacterium halii*, culture collection ATCC 27751, is herein incorporated by reference in its entirety.

The content of DDBJ/EMBL/GenBank accession number AJ270475.2 for microbial strain *Eubacterium rectale*, A1-86, is herein incorporated by reference in its entirety.

The content of DDBJ/EMBL/GENBANK accession number NC_012781.1 for microbial strain *Eubacterium rectale*, culture collection ATCC 33656, is herein incorporated by reference in its entirety.

The content of DDBJ/EMBL/GenBank accession number L34421.2 for microbial strain *Eubacterium ventriosum*, culture collection ATCC 27560, is herein incorporated by reference in its entirety.

The content of DDBJ/EMBL/GENBANK accession number AY305307.1 for microbial strain *Faecalibacterium prausnitzii*, butyrate producing bacterium M21/2, is herein incorporated by reference in its entirety.

The content of DDBJ/EMBL/GENBANK accession number FP929046.1 for microbial strain *Faecalibacterium prausnitzii* is herein incorporated by reference in its entirety.

The content of DDBJ/EMBL/GENBANK accession number GG697168.2 for microbial strain *Faecalibacterium prausnitzii* is herein incorporated by reference in its entirety.

The content of DDBJ/EMBL/GENBANK accession number CP002158.1 for microbial strain *Fibrobacter succino genes* subsp. *succino genes* is herein incorporated by reference in its entirety.

The content of DDBJ/EMBL/GENBANK accession number NZ_AUJN01000001.1 for microbial strain *Clostridium butyricum* is herein incorporated by reference in its entirety.

The content of DDBJ/EMBL/GENBANK accession number NZ_AZUI01000001.1 for microbial strain *Clostridium indolis*, culture collection DSM 755, is herein incorporated by reference in its entirety.

The content of DDBJ/EMBL/GENBANK accession number ACEP01000175.1 for microbial strain *Eubacterium hallii*, culture collection DSM 3353, is herein incorporated by reference in its entirety.

The content of DDBJ/EMBL/GenBank accession number AY305310.1 for microbial strain *Roseburia faecis*, M72/1, is herein incorporated by reference in its entirety.

The content of DDBJ/EMBL/GenBank accession number AJ270482.2 for microbial strain *Roseburia hominis*, type strain A2-183T, is herein incorporated by reference in its entirety.

The content of DDBJ/EMBL/GenBank accession number AJ312385.1 for microbial strain *Roseburia intestinalis*, L1-82, is herein incorporated by reference in its entirety.

The content of DDBJ/EMBL/GenBank accession number AJ270473.3 for microbial strain *Roseburia inulinivorans*, type strain A2-194T, is herein incorporated by reference in its entirety.

The content of DDBJ/EMBL/GENBANK accession number NZ_ACFY01000179.1 for microbial strain *Roseburia inulinivorans*, culture collection DSM 16841, is herein incorporated by reference in its entirety.

The content of DDBJ/EMBL/GENBANK accession number K1912489.1 for microbial strain *Ruminococcus flavefaciens*, culture collection ATCC 19208, is herein incorporated by reference in its entirety.

The content of DDBJ/EMBL/GENBANK accession number AAYG02000043.1 for microbial strain *Ruminococcus gnavus*, culture collection ATCC 29149, is herein incorporated by reference in its entirety.

BRIEF DESCRIPTION OF THE DRAWINGS

The novel features of the invention are set forth with particularity in the appended claims. A better understanding of the features and advantages of the present invention will be obtained by reference to the following detailed description that sets forth illustrative embodiments, in which the principles of the invention are utilized, and the accompanying drawings of which:

*mutans, Ruminococcus gnavus, Roseburia cecicola, Fibrobacter succinogenes, Ruminococcus flavefaciens*, and *Clostridium indolis.*

Figure 7:
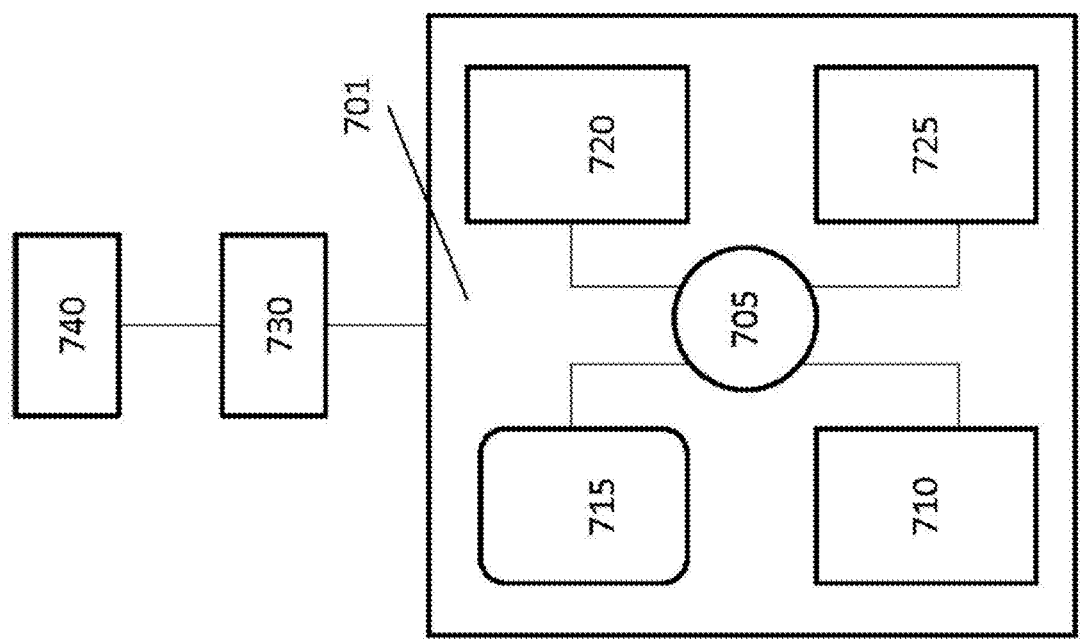

FIG. 7 depicts a system adapted to enable a user to detect, analyze, and process data (e.g. sequencing data, strain classification, functional pathways, epigenetic changes, patient information, external data, databases, microbiome strains; therapeutic consortia, etc.) using machine readable code.

Figure 8:
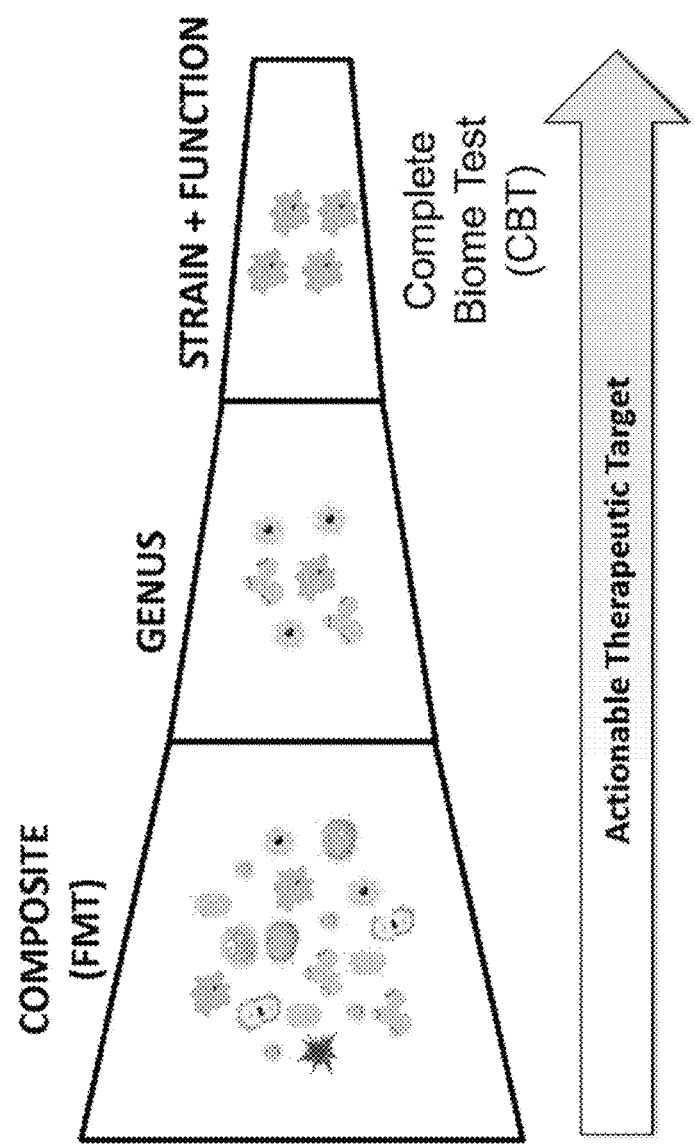

FIG. 8 depicts how both the diagnostic and therapeutic approach outlined herein can comprise a targeted microbe strain selection as compared to a composite fecal microbiome transplant.

Figure 9:
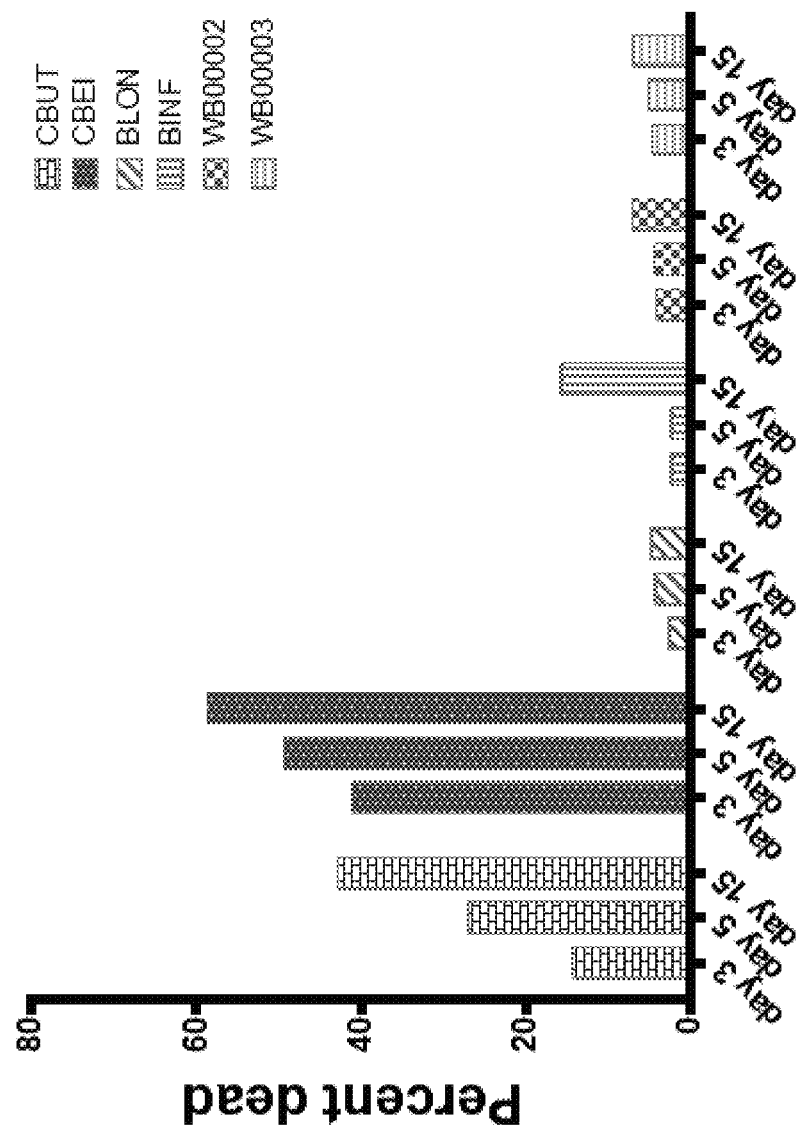

FIG. 9 depicts how by combining strains together in a formulation the stability of all of the individual strains either can remain high or dramatically improve. Stability of individual strains, *Clostridium butyricum* (CBUT), *Clostridium beijerinckii* (CBEI), *Bifidobacterium longum* (BLON), and *Bifidobacterium infantis* (BINF) was compared with formulations WB00002 and WB00003, which can comprise strains CBUT, CBEI, BLON, BINF present together in the formulation. The formulations can additionally comprise strains *B. adolescentis, A. muciniphila, E. hallii*, and *C. indolis*. Formulations WB0002 and WB0003 differ in that WB0003 can also comprise a prebiotic in combination with the strains. The increased stability of the formulations suggests that the formulation can provide a synergistic stability when the strains are together over individual strains.

Figure 10:
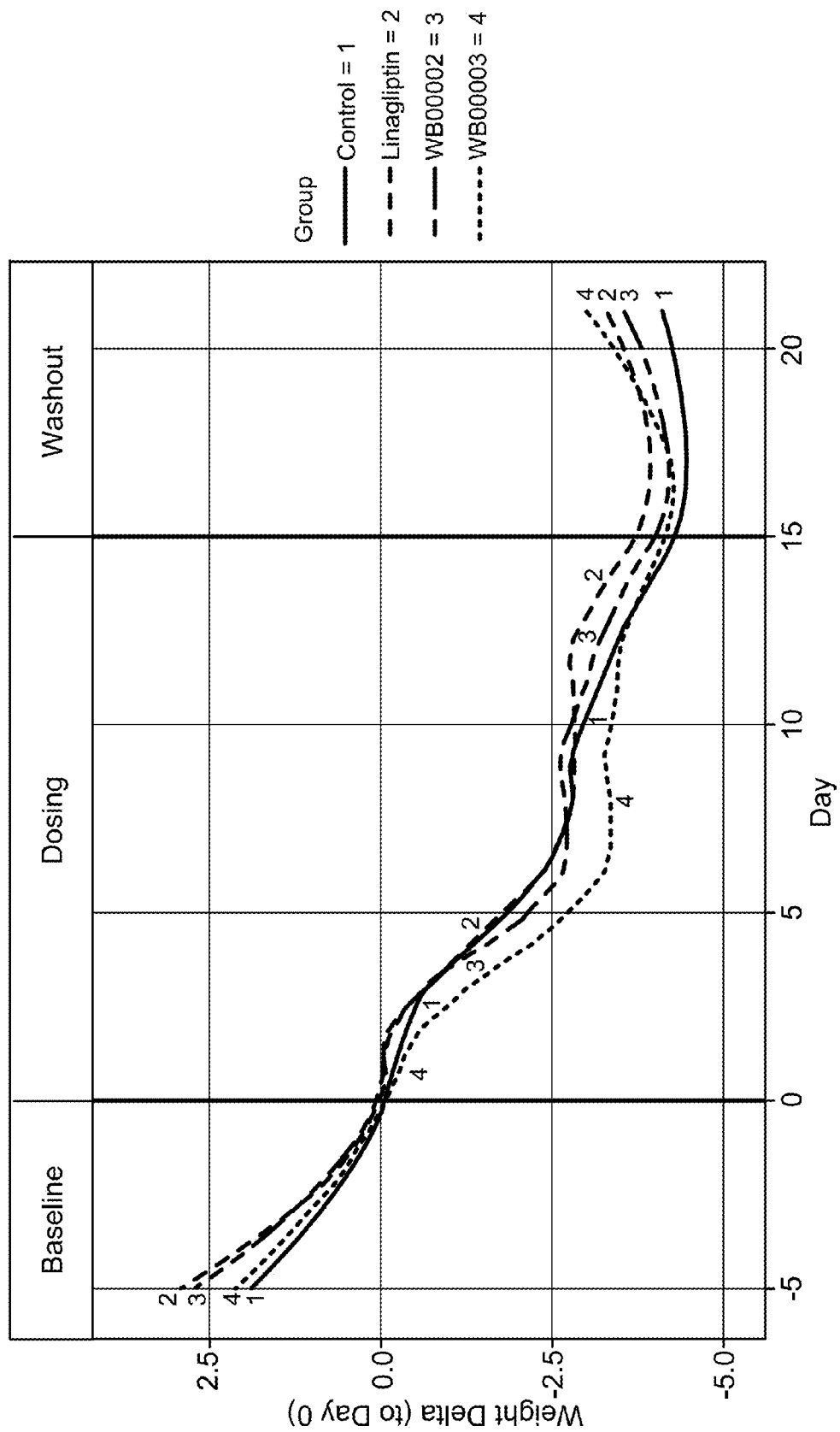

FIG. 10 depicts how formulation WB0003 can result in increased weight loss during the dosing period of a preclinical study involving diet-induced obese mice. Support of this effect is further corroborated by the weight regain during the washout period. Linagliptin is a positive control.

Figure 11:
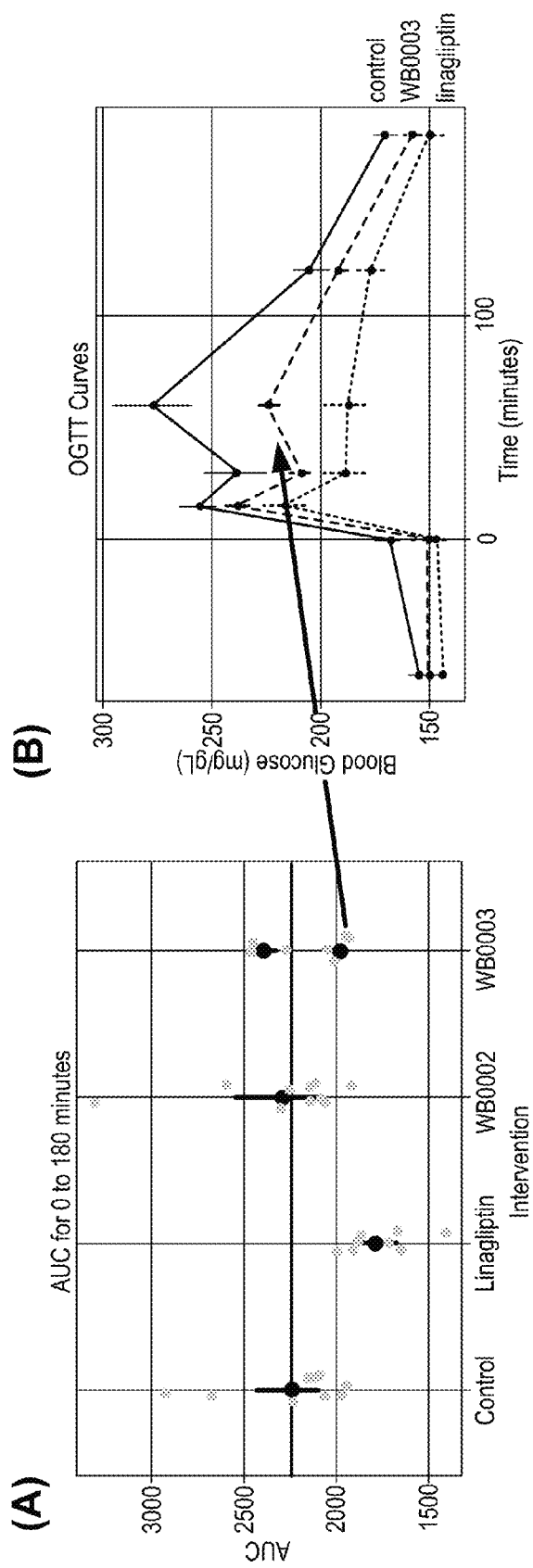

FIG. 11 (A) depicts a bi-modal response in glucose control as measured by Area Under the Oral Glucose Tolerance Test (OGTT) Curve (AUC) for mice dosed with formulation WB0003. (B) Depicts the OGTT curves that compare the responders to WB0003, to control, and to the positive control, Linagliptin.

Figure 12:
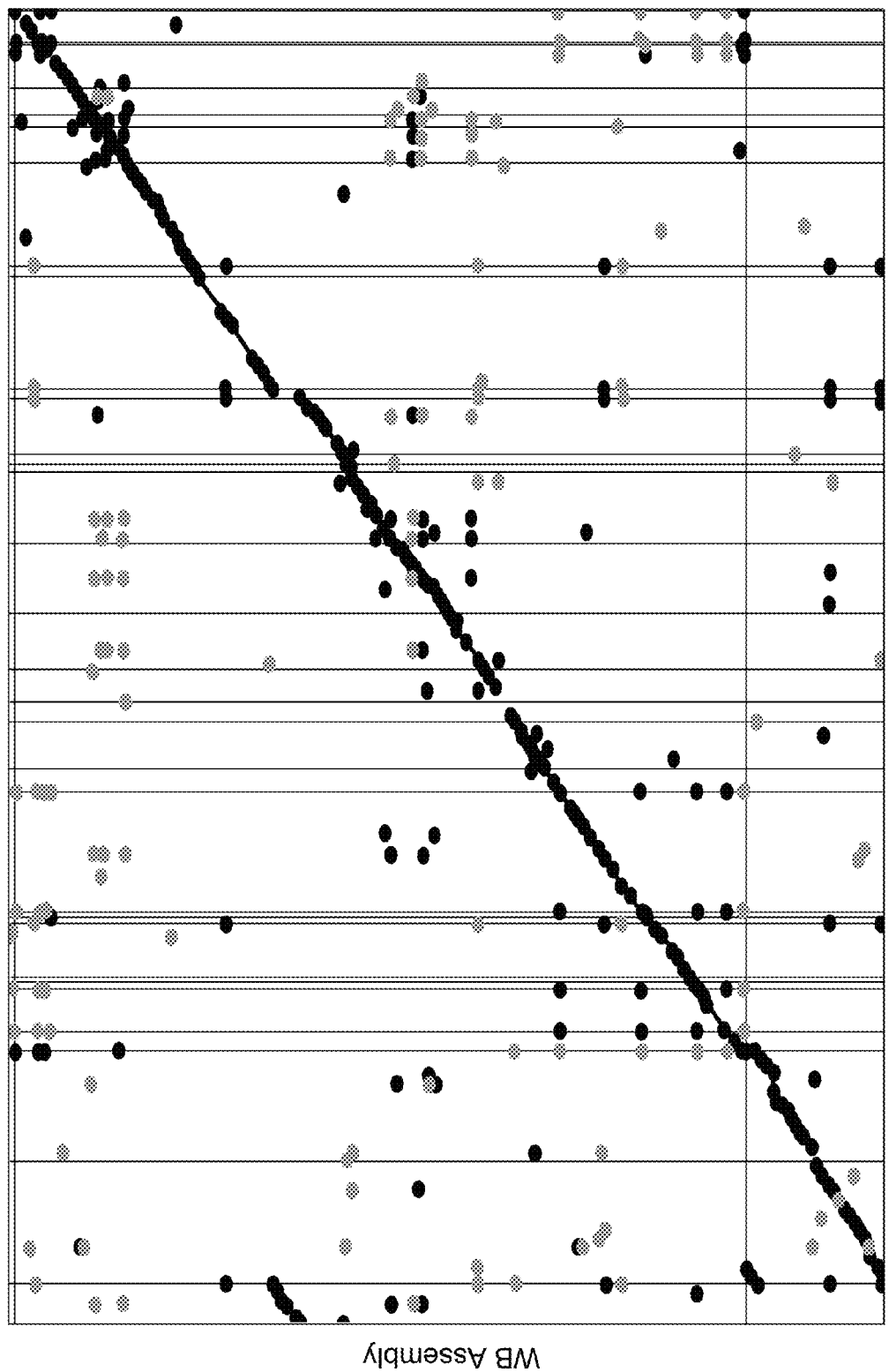

FIG. 12 illustrates that de novo assembly for *C. butyricum* using methods of the invention can result in the use of less contigs (e.g., 2 contigs) than those found in the database (e.g., 40 contigs).

Figure 13:
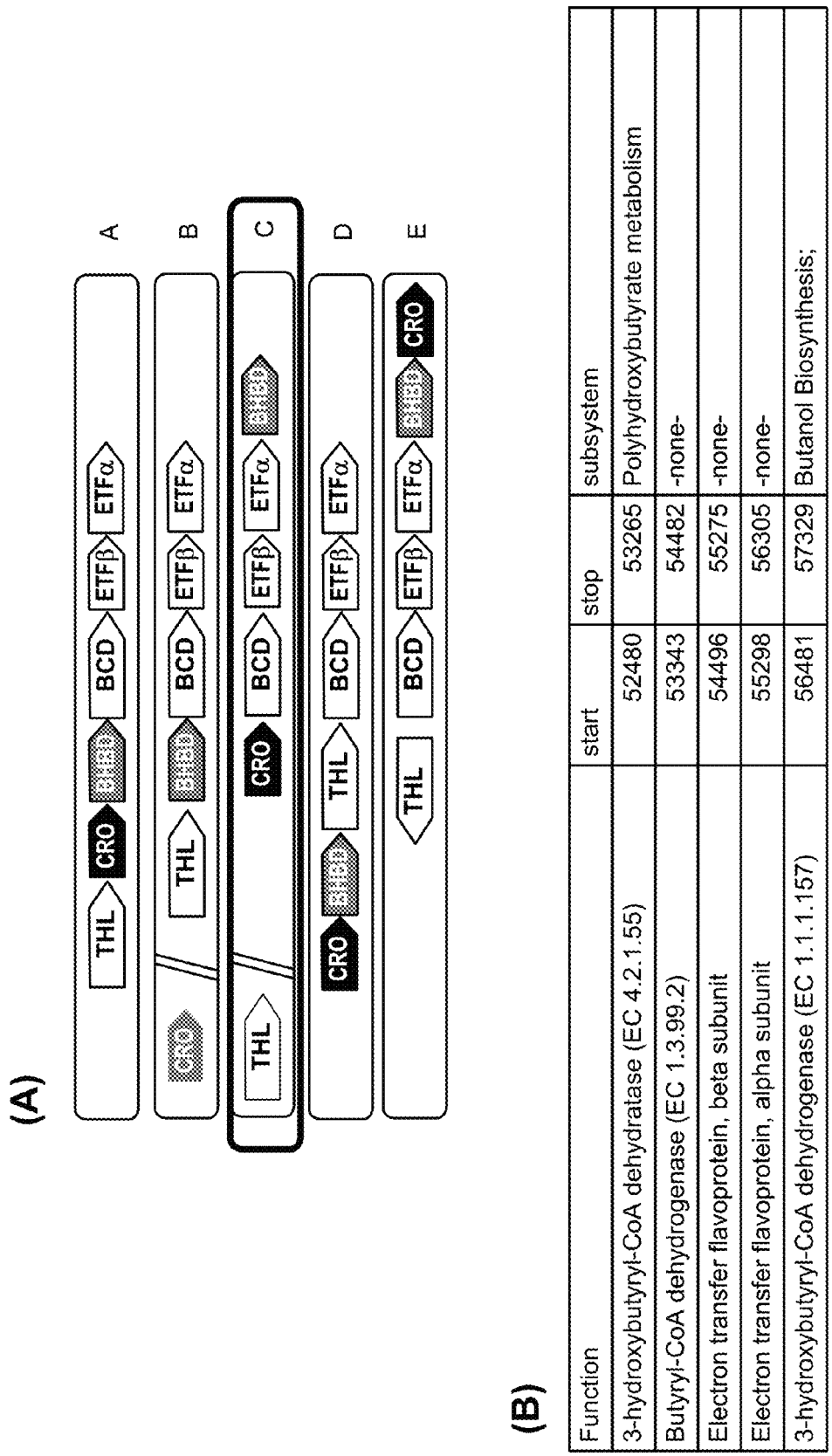

FIG. 13 (A) illustrates that de novo assembly using a method of the invention can differentiate between several operon orderings and for this example strain of *C. butyricum* a 'type C' ordering was discovered. (B) Tabulates the exact genomic coordinates for five of the butyrate pathway genes for this strain.

FIG. 14 illustrates exemplary data for short chain fatty acid quantification in different media (e.g., RCM, PYG) by strain. The short chain fatty acid quantification shows that the predicted genomic function of the strains matches the actual function. This can be similar for different media. In one non-limiting example, strain 1 can be *Bifidobacterium adolescentis* (BADO). In one non-limiting example, strain 2 is *Bifidobacterium infantis* (BINF). In one non-limiting example, strain 3 is *Bifidobacterium longum* (BLON). In one non-limiting example, strain 4 is *Clostridium beijerinckii* (CBEI). In one non-limiting example, strain 5 is *Clostridium butyricum* (CBUT). In one non-limiting example, strain 6 is *Clostridium indolis* (CIND). In one non-limiting example, strain 7 is *Eubacterium hallii* (EHAL).

FIG. 15 illustrates that improved media of the invention (e.g., PYGveg+vit+salt+buffer) can result in higher peak bacterial density. In one non-limiting example, strain 1 is *Akkermansia muciniphila* (AMUC). In one non-limiting example, strain 2 is CBEI. In one non-limiting example, strain 3 is EHAL. In one non-limiting example, strain 4 is CIND. In one non-limiting example, strain 5 is BLON. In one non-limiting example, strain 6 is BADO. In one non-limiting example, strain 7 is CBUT. In one non-limiting example, strain 8 is BINF.

DETAILED DESCRIPTION OF THE INVENTION

Definitions

As used in the specification and claims, the singular forms "a", "an" and "the" include plural references unless the context clearly dictates otherwise. For example, the term "a sample" includes a plurality of samples, including mixtures thereof.

The terms "microbes" and "microorganisms" are used interchangeably herein and can refer to bacteria, archaea, eukaryotes (e.g. protozoa, fungi, yeast), and viruses, including bacterial viruses (i.e. phage).

The term "microbiome", "microbiota", and "microbial habitat" are used interchangeably herein and can refer to the ecological community of microorganisms that live on or in a subject's body. The microbiome can be comprised of commensal, symbiotic, and/or pathogenic microorganisms. Microbiomes can exist on or in many, if not most parts of the subject. Some non-limiting examples of habitats of microbiome can include: body surfaces, body cavities, body fluids, the gut, the colon, skin surfaces and pores, vaginal cavity, umbilical regions, conjunctival regions, intestinal regions, the stomach, the nasal cavities and passages, the gastrointestinal tract, the urogenital tracts, saliva, mucus, and feces.

The term "prebiotic" as used herein can be a general term to refer to chemicals and or ingredients that can affect the growth and/or activity of microorganisms in a host (e.g. can allow for specific changes in the composition and/or activity in the microbiome). Prebiotics can confer a health benefit on the host. Prebiotics can be selectively fermented, e.g. in the colon. Some non-limiting examples of prebiotics can include: complex carbohydrates, complex sugars, resistant dextrins, resistant starch, amino acids, peptides, nutritional compounds, biotin, polydextrose, fructooligosaccharide (FOS), galactooligosaccharides (GOS), inulin, lignin, psyllium, chitin, chitosan, gums (e.g. guar gum), high amylose cornstarch (HAS), cellulose, β-glucans, hemi-celluloses, lactulose, mannooligosaccharides, mannan oligosaccharides (MOS), oligofructose-enriched inulin, oligofructose, oligodextrose, tagatose, trans-galactooligosaccharide, pectin, resistant starch, and xylooligosaccharides (XOS). Prebiotics can be found in foods (e.g. acacia gum, guar seeds, brown rice, rice bran, barley hulls, chicory root, Jerusalem artichoke, dandelion greens, garlic, leek, onion, asparagus, wheat bran, oat bran, baked beans, whole wheat flour, banana), and breast milk. Prebiotics can also be administered in other forms (e.g. capsule or dietary supplement).

The term "probiotic" as used herein can mean one or more microorganisms which, when administered appropriately, can confer a health benefit on the host or subject. Some non-limiting examples of probiotics include: *Akkermansia muciniphila, Anaerostipes caccae, Bifidobacterium adolescentis, Bifidobacterium bifidum, Bifidobacterium infantis, Bifidobacterium longum, Butyrivibrio fibrisolvens, Clostridium acetobutylicum, Clostridium aminophilum, Clostridium beijerinckii, Clostridium butyricum, Clostridium colinum, Clostridium indolis, Clostridium orbi-*

*scindens, Enterococcus faecium, Eubacterium hallii, Eubacterium rectale, Faecalibacterium prausnitzii, Fibrobacter succinogenes, Lactobacillus acidophilus, Lactobacillus brevis, Lactobacillus bulgaricus, Lactobacillus casei, Lactobacillus caucasicus, Lactobacillus fermentum, Lactobacillus helveticus, Lactobacillus lactis, Lactobacillus plantarum, Lactobacillus reuteri, Lactobacillus rhamnosus, Oscillospira guilliermondii, Roseburia cecicola, Roseburia inulinivorans, Ruminococcus flavefaciens, Ruminococcus gnavus, Ruminococcus obeum, Streptococcus cremoris, Streptococcus faecium, Streptococcus infantis, Streptococcus mutans, Streptococcus thermophilus, Anaerofustis stercorihominis, Anaerostipes hadrus, Anaerotruncus colihominis, Clostridium sporogenes, Clostridium tetani, Coprococcus, Coprococcus eutactus, Eubacterium cylindroides, Eubacterium dolichum, Eubacterium ventriosum, Roseburia faeccis, Roseburia hominis, Roseburia intestinalis*, and any combination thereof.

The terms "determining", "measuring", "evaluating", "assessing," "assaying," and "analyzing" can be used interchangeably herein and can to refer to any form of measurement, and include determining if an element is present or not. (e.g., detection). These terms can include both quantitative and/or qualitative determinations. Assessing may be relative or absolute. These terms can include use of the algorithms and databases described herein. "Detecting the presence of" can include determining the amount of something present, as well as determining whether it is present or absent. The term "genome assembly algorithm" as used herein, refers to any method capable of aligning sequencing reads with each other (de novo) or to a reference (re-sequencing) under conditions that a complete sequence of the genome may be determined.

The term "genome" as used herein, can refer to the entirety of an organism's hereditary information that is encoded in its primary DNA sequence. The genome includes both the genes and the non-coding sequences. For example, the genome may represent a microbial genome. The genetic content of the microbiome can comprise: genomic DNA, RNA, and ribosomal RNA, the epigenome, plasmids, and all other types of genetic information found in the microbes that comprise the microbiome.

"Nucleic acid sequence" and "nucleotide sequence" as used herein refer to an oligonucleotide or polynucleotide, and fragments or portions thereof, and to DNA or RNA of genomic or synthetic origin which may be single- or double-stranded, and represent the sense or antisense strand. The nucleic acid sequence can be made up of adenine, guanine, cytosine, thymine, and uracil (A, T, C, G, and U) as well as modified versions (e.g. N6-methyladenosine, 5-methylcytosine, etc.).

The terms "homology" and "homologous" as used herein in reference to nucleotide sequences refer to a degree of complementarity with other nucleotide sequences. There may be partial homology or complete homology (i.e., identity). A nucleotide sequence which is partially complementary, i.e., "substantially homologous," to a nucleic acid sequence is one that at least partially inhibits a completely complementary sequence from hybridizing to a target nucleic acid sequence.

The term "sequencing" as used herein refers to sequencing methods for determining the order of the nucleotide bases—A, T, C, G, and U—in a nucleic acid molecule (e.g., a DNA or RNA nucleic acid molecule.

The term "biochip" or "array" can refer to a solid substrate having a generally planar surface to which an adsorbent is attached. A surface of the biochip can comprise a plurality of addressable locations, each of which location may have the adsorbent bound there. Biochips can be adapted to engage a probe interface, and therefore, function as probes. Protein biochips are adapted for the capture of polypeptides and can be comprise surfaces having chromatographic or biospecific adsorbents attached thereto at addressable locations. Microarray chips are generally used for DNA and RNA gene expression detection.

The term "barcode" as used herein, refers to any unique, non-naturally occurring, nucleic acid sequence that may be used to identify the originating genome of a nucleic acid fragment.

The terms "subject," "individual," "host," and "patient" can be used interchangeably herein and refer to any animal subject, including: humans, laboratory animals, livestock, and household pets. The subject can host a variety of microorganisms. The subject can have different microbiomes in various habitats on and in their body. The subject may be diagnosed or suspected of being at high risk for a disease. The subject may have a microbiome state that is contributing to a disease (a dysbiosis). In some cases, the subject is not necessarily diagnosed or suspected of being at high risk for the disease. In some instances a subject may be suffering from an infection or at risk of developing or transmitting to others an infection.

The terms "treatment" or "treating" are used interchangeably herein. These terms can refer to an approach for obtaining beneficial or desired results including but not limited to a therapeutic benefit and/or a prophylactic benefit. A therapeutic benefit can mean eradication or amelioration of the underlying disorder being treated. Also, a therapeutic benefit can be achieved with the eradication or amelioration of one or more of the physiological symptoms associated with the underlying disorder such that an improvement is observed in the subject, notwithstanding that the subject may still be afflicted with the underlying disorder. A prophylactic effect includes delaying, preventing, or eliminating the appearance of a disease or condition, delaying or eliminating the onset of symptoms of a disease or condition, slowing, halting, or reversing the progression of a disease or condition, or any combination thereof. For prophylactic benefit, a subject at risk of developing a particular disease, or to a subject reporting one or more of the physiological symptoms of a disease may undergo treatment, even though a diagnosis of this disease may not have been made.

The terms "16S", "16S ribosomal subunit", and "16S ribosomal RNA (rRNA)" can be used interchangeably herein and can refer to a component of a small subunit (e.g., 30S) of a prokaryotic (e.g., bacteria, archaea) ribosome. The 16S rRNA is highly conserved evolutionarily among species of microorganisms. Consequently, sequencing of the 16S ribosomal subunit can be used to identify and/or compare microorganisms present in a sample (e.g., a microbiome).

The terms "23S", "23S ribosomal subunit", and "23S ribosomal RNA (rRNA)" can be used interchangeably herein and can refer to a component of a large subunit (e.g., 50S) of a prokaryotic (e.g., bacteria, archaea) ribosome. Sequencing of the 23S ribosomal subunit can be used to identify and/or compare microorganisms present in a sample (e.g., a microbiome).

The term "spore" as used herein can refer to a viable cell produced by a microorganism to resist unfavorable conditions such as high temperatures, humidity, and chemical agents. A spore can have thick walls that allow the microorganism to survive harsh conditions for extended periods of time. Under suitable environmental conditions, a spore can germinate to produce a living form of the microorganism that is capable of reproduction and all of the physiological activities of the microorganism.

Overview

Compositions comprising microbes such as probiotics can confer a variety of beneficial effects on a subject. Examples of these beneficial effects can include immunomodulatory features, regulation of cell proliferation, the ability to promote normal physiologic development of the mucosal epithelium, and enhancement of human nutrition. Microbial-based compositions can be administered as a therapeutic to a subject suffering from a microbiome-related health condition or disorder.

In some embodiments, the disclosure provides a diagnostic assay for predicting a disease status of a subject or likelihood of a subject's response to a therapeutic. The diagnostic assay can use the presence of one or more microbes in a sample or a microbiome profile of a subject to calculate a quantitative score. The quantitative score can be used to predict disease status or likelihood of response to a therapeutic in a subject. In some applications, the diagnostic assay can use the presence of one or more microbes and one or more characteristics, such as, e.g., age, weight, gender, medical history, risk factors, family history, or a combination thereof to calculate a quantitative score that can be used to predict disease status or likelihood of response to a therapeutic in a subject. In some applications, the diagnostic assay can further use environmental factors such as geographic location, type of work, and use of hygiene products to calculate a quantitative score.

An exemplary method of the disclosure can comprise at least one of the following steps: obtaining a biological sample from a subject, measuring a panel of microbes in the biological sample of the subject, determining a disease status upon the measuring, generating a report that provides information of disease status upon the results of the determining, and administering microbial-based compositions of the disclosure to the subject for preventing and/or treating a health condition such as a microbiome-based disorder, or the presence or absence of a microbe.

Methods for Determining Members of a Microbial Habitat

The present disclosure provides methods and compositions comprising microbial populations for the treatment of microbiome-related health conditions and/or disorders in a subject. Methods of the disclosure can include collection, stabilization and extraction of microbes for microbiome analysis. Methods of the disclosure can include determining the composition of a microbial habitat of a host to generate a microbiome profile. The composition of a microbial habitat can be used to diagnose a health condition of a host, for example, to determine likelihood of a disorder and/or treatment course of the disorder.

In some embodiments, methods of the disclosure can be used to determine microbial habitat of the gut or gastrointestinal tract of a subject. The gut comprises a complex microbiome including multiple species of microbes that can contribute to vitamin production and absorption, metabolism of proteins and bile acids, fermentation of dietary carbohydrates, and prevention of pathogen overgrowth. The composition of microbes within the gut can be linked to functional metabolic pathways in a subject. Non-limiting examples of metabolic pathways linked to gut microbiota include, energy balance regulation, secretion of leptin, lipid synthesis, hepatic insulin sensitivity, modulation of intestinal environment, and appetite signaling. Modification of the gut microbiome can increase the risk for health conditions such as ulcerative colitis, colorectal cancer, autoimmune disorders, obesity, diabetes, and inflammatory bowel disease.

In some embodiments, detection methods (e.g. sequencing) can be used to identify gut microbiome biomarkers associated with, for example, obesity and obesity-induced diabetes. For example, non-obese and obese subjects can be categorized based on differences in species of microbes present in their microbiome. Obese subjects can have reduced microbial diversity and higher levels of fermentation causing microbes, for example, bacteroidetes phylum and methanogenic archaea, compared with non-obese subjects. Subjects with obesity-induced diabetes can have a microbiota that promotes mass gain, metabolic endotoxemia, adipose tissue inflammation, and insulin resistance. Differences in microbes between obese and lean subjects can be used to generate microbial biomarker profiles associated with obesity that can be used to predict risk factors and/or treatment course.

In some embodiments, detection methods of the disclosure (e.g., sequencing) can be used to analyze changes in gut microbiome composition over time, for example, during antibiotic treatment, gut microbiome therapies, and various diets. The microbiome can be significantly altered upon exposure to antibiotics and diets that deplete the native microbial population. Methods of the disclosure can be used to generate profiles of the subject before and after administration of a therapeutic to characterize differences in the microbiota.

In some embodiments, methods to visualize the microbiome based on sequencing signatures are provided. In some embodiments, methods are provided to visualize the microbiome over time based on sequencing information.

Methods of the disclosure can be used to detect, characterize and quantify microbial habitat of the amniotic fluid of a pregnant woman. The amniotic cavity of a pregnant woman undergoing preterm labor can harbor genetic material from a greater diversity of microbes, including previously-uncharacterized microbes, compared with pregnant woman delivering at full-term. The microbial habit can be used to define the diversity and abundance of microbes invading the amniotic cavity in order to evaluate clinical significance and causal framework for preterm labor. The microbiome profiles of amniotic fluid of women with full-term delivery and preterm delivery can be compared to determine microbes that can be used as biomarkers for predicting and/or treating preterm labor.

Microorganisms can translocate from a mother to an infant through maternal mononuclear cells in breast milk, which may prime the developing infant immune system to appropriately respond to commensal and pathogenic bacteria. Methods of the disclosure can be used to determine microbial habitat of the gut of an infant to generate patterns of microbial colonization and effects of the microbes on development of immunity during infancy and early childhood.

Methods of the disclosure can be used to analyze microbial habitat of the skin. Parts of the skin, including cutaneous invaginations and appendages, sweat glands (eccrine and apocrine), sebaceous glands and hair follicles, can each be associated with unique microbiota. Comparison of skin microbiome profiles of a healthy subject and a subject with for example, acne, can provide insights into microbial involvement in skin health and disease.

Biological Samples

A biological sample can be collected from a subject to determine the microbiome profile of the subject. The biological sample can be any sample type from any microbial habitat on the body of a subject. Non-limiting examples of microbial habitats include skin habitat, umbilical habitat, vaginal habitat, amniotic fluid habitat, conjunctival habitat, intestinal habitat, stomach habitat, gut habitat, oral habitat, nasal habitat, gastrointestinal tract habitat, respiratory habitat, and urogenital tract habitat.

Depending on the application, the selection of a biological sample can be tailored to the specific application. The biological sample can be for example, whole blood, serum, plasma, mucosa, saliva, cheek swab, urine, stool, cells, tissue, bodily fluid, lymph fluid, CNS fluid, and lesion exudates. A combination of biological samples can be used with the methods of the disclosure.

Sample Preparation

Sample preparation can comprise any one of the following steps or a combination of steps. A sterile swab is first dipped into a tube containing sterile phosphate buffered saline (PBS) to wet. The swab is swiped across the area of interest multiple times (e.g., 10-20 times) with enough vigor that the tissue is slightly pink/red colored afterwards. The swab is gently dipped into a buffer (e.g., a lysis buffer) in a sterile tube. The swab is left in the tube for shipping to a laboratory to be further analyzed as provided herein. The samples obtained can be shipped overnight at room temperature.

Shipping microbial cells in buffers can introduce detection bias in the samples. Some microbes can continue propagating on the nutrients that come along with sample collection. Some microbes can undergo apoptosis in the absence of a specific environment. As a result, microbial samples shipped in this fashion can have an initial profiling/population bias associated with cellular integrity.

Methods can be used to enrich intact cells by first centrifuging the collected sample. The resulting pellet, formed from the intact cells within the sample, can then be used as a precursor for all of the downstream steps. In some embodiments, the methods of the disclosure further comprise a purification step to concentrate any DNA present in the supernatant (e.g. from already lysed cells). This DNA can be combined with DNA extracted from the standard pellet preparation. The combined DNA can form a more complete precursor to the downstream steps.

Cell lysis and/or extraction of nucleic acids from the cells can be performed by any suitable methods including physical methods, chemical methods, or a combination of both. Nucleic acids can be isolated from a biological sample using shearing methods, which preserve the integrity and continuity of genomic DNA.

A nucleic acid sample used with the present disclosure can include all types of DNA and RNA. The length of nucleic acids can be about 100, 200, 300, 400, 500, 600, 700, 800, 900, 1000, 2000, 3000, 4000, 5000, 6000, 7000, 8000, 9000, 10,000, 20,000, 30,000, 40,000, 50,000, 60,000, 70,000, 80,000, 90,000, 100,000, 200,000, 300,000, 400,000, 500,000, 600,000, 700,000, 800,000, 900,000, 1,000,000, 2,000,000, 3,000,000, 4,000,000, 5,000,000, 6,000,000, 7,000,000, 8,000,000, 9,000,000, or 10,000,000, nucleotides or base pairs in length.

An amplicon approach can be used to prepare DNA for microbiome profiling. This approach can comprise a number of steps, for example, PCR, sample quantification (e.g. Qubit, nanodrop, bioanalyzer, etc.), Blue Pippin size selection, 0.5× Ampure purification, sample quantification, DNA end repair, 0.5× Ampure purification, blunt end adaptor ligation, exo-nuclease treatment, two 0.5× Ampure purifications, and final Blue Pippen size selection.

In some embodiments, the method does not use an amplification step. Examples of such methods include preparation of samples for sequencing by Whole Genome Shotgun (WGS) sequencing. These approaches can provide a benefit by removing amplification bias that can skew microbial distributions. In addition, such approaches can allow for de novo discovery of pertinent elements, for example, bacterial plasmids, fungi and viruses.

The practice of the methods of the present disclosure can employ conventional techniques of immunology, biochemistry, chemistry, molecular biology, microbiology, cell biology, genomics and recombinant DNA, which are within the skill of the art. For example, preparation of a biological sample can comprise, e.g., extraction or isolation of intracellular material from a cell or tissue such as the extraction of nucleic acids, protein, or other macromolecules. Sample preparation which can be used with the methods of disclosure include but are not limited to, centrifugation, affinity chromatography, magnetic separation, immunoassay, nucleic acid assay, receptor-based assay, cytometric assay, colorimetric assay, enzymatic assay, electrophoretic assay, electrochemical assay, spectroscopic assay, chromatographic assay, microscopic assay, topographic assay, calorimetric assay, radioisotope assay, protein synthesis assay, histological assay, culture assay, and combinations thereof.

Microbiome Profiling

The present disclosure provides methods for measuring at least one microbe in a biological sample from at least one microbial habitat of a subject and determining a microbiome profile. A microbiome profile can be assessed using any suitable detection means that can measure or quantify one or more microbes (bacteria, fungi, viruses and archaea) that comprise a microbiome.

Figure 3:
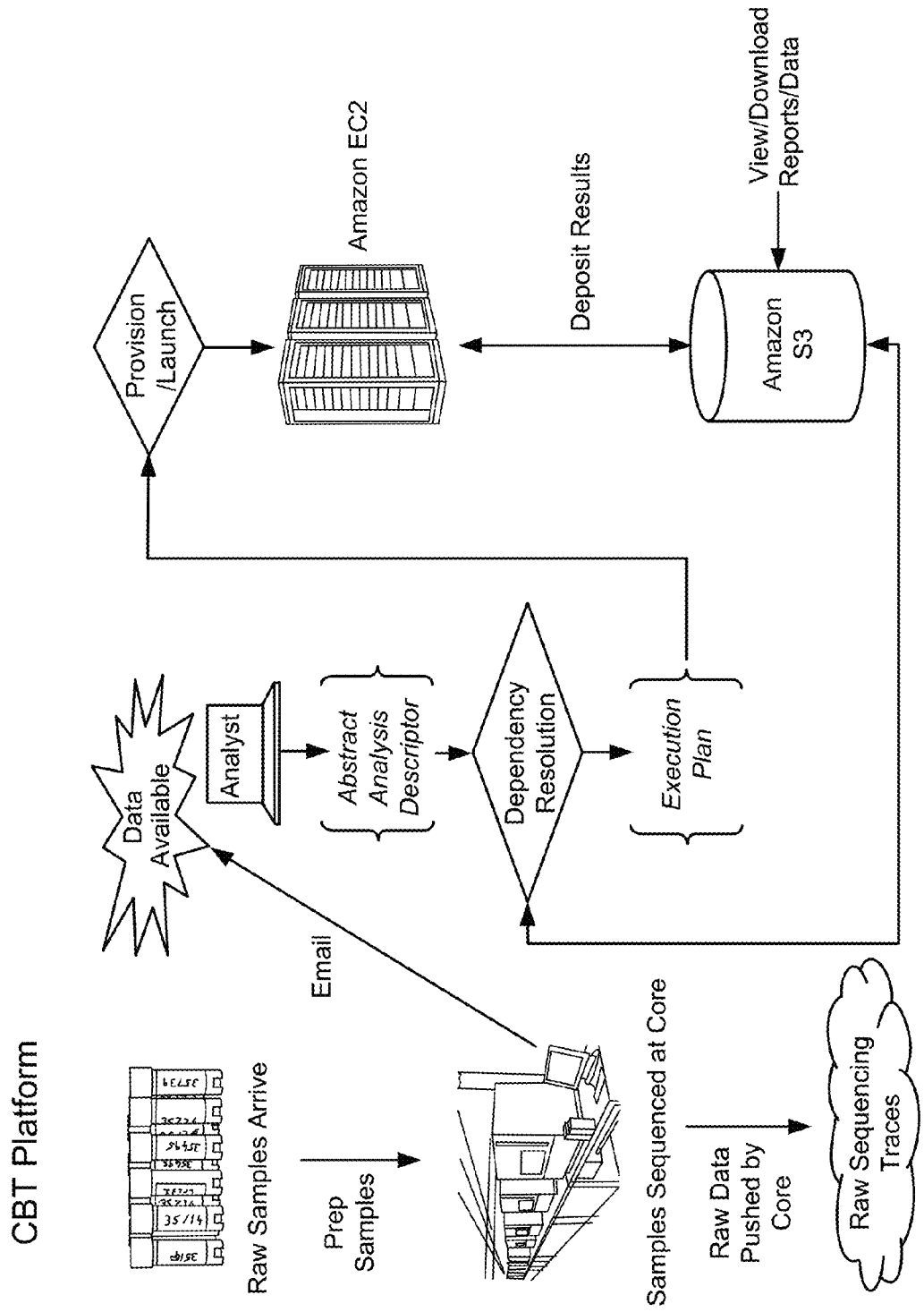
FIG. 3 is an illustration depicting an exemplary platform for a Complete Biome Test (CBT) (e.g. as a diagnostic test or as a development tool to develop therapeutics). The specific microbiotic actionable targets starting with microbiotic strains obtained from, e.g. fecal matter transplants (FMT), the microorganism(s), the genus, and the presence/absence of microorganism strain(s) related to health conditions or diseases can be determined using the Complete Biome Test.
Figure 4:
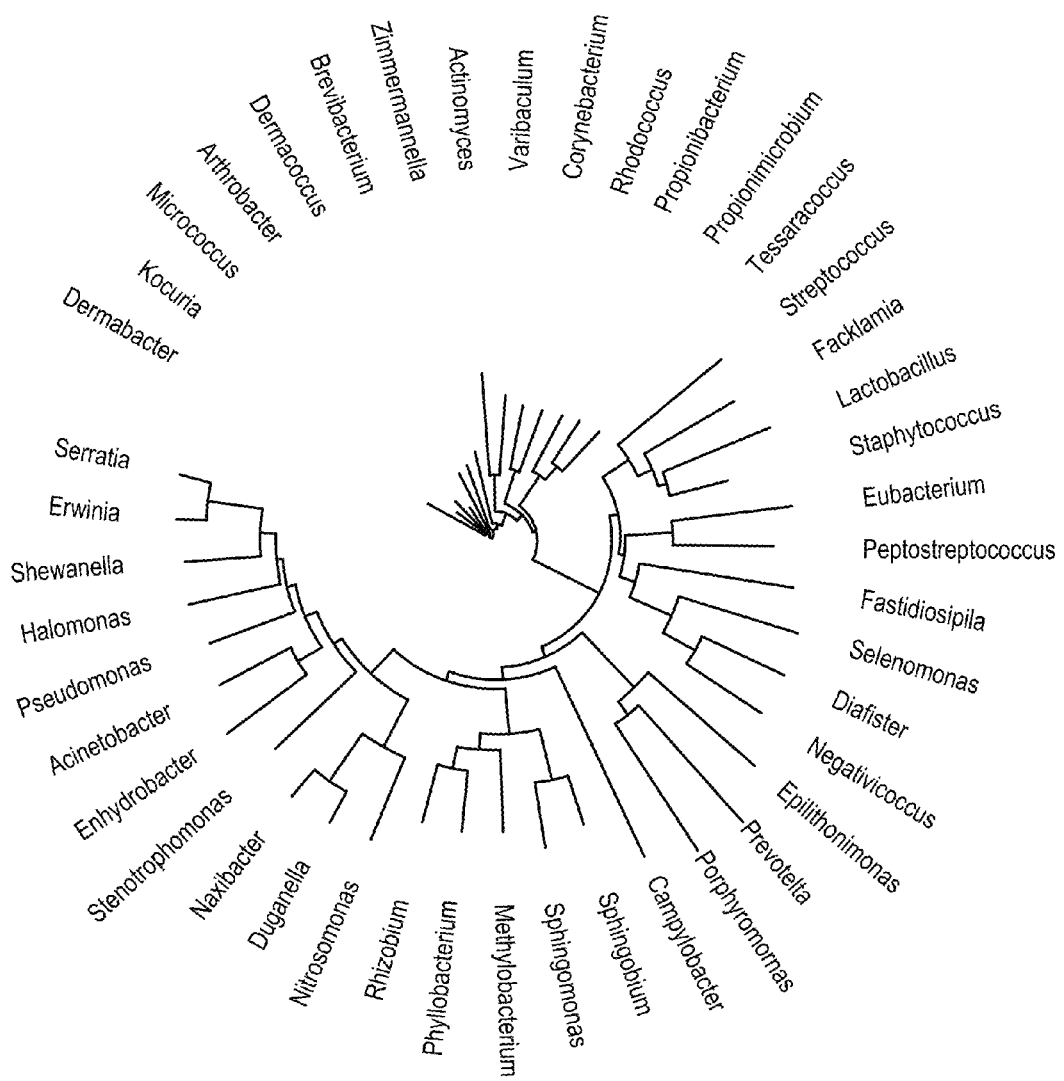
FIG. 4 (A) depicts the microbiome strain resolution using standard tests and (B) the increased microbiome strain resolution using the Complete Biome Test.
Figure 4:
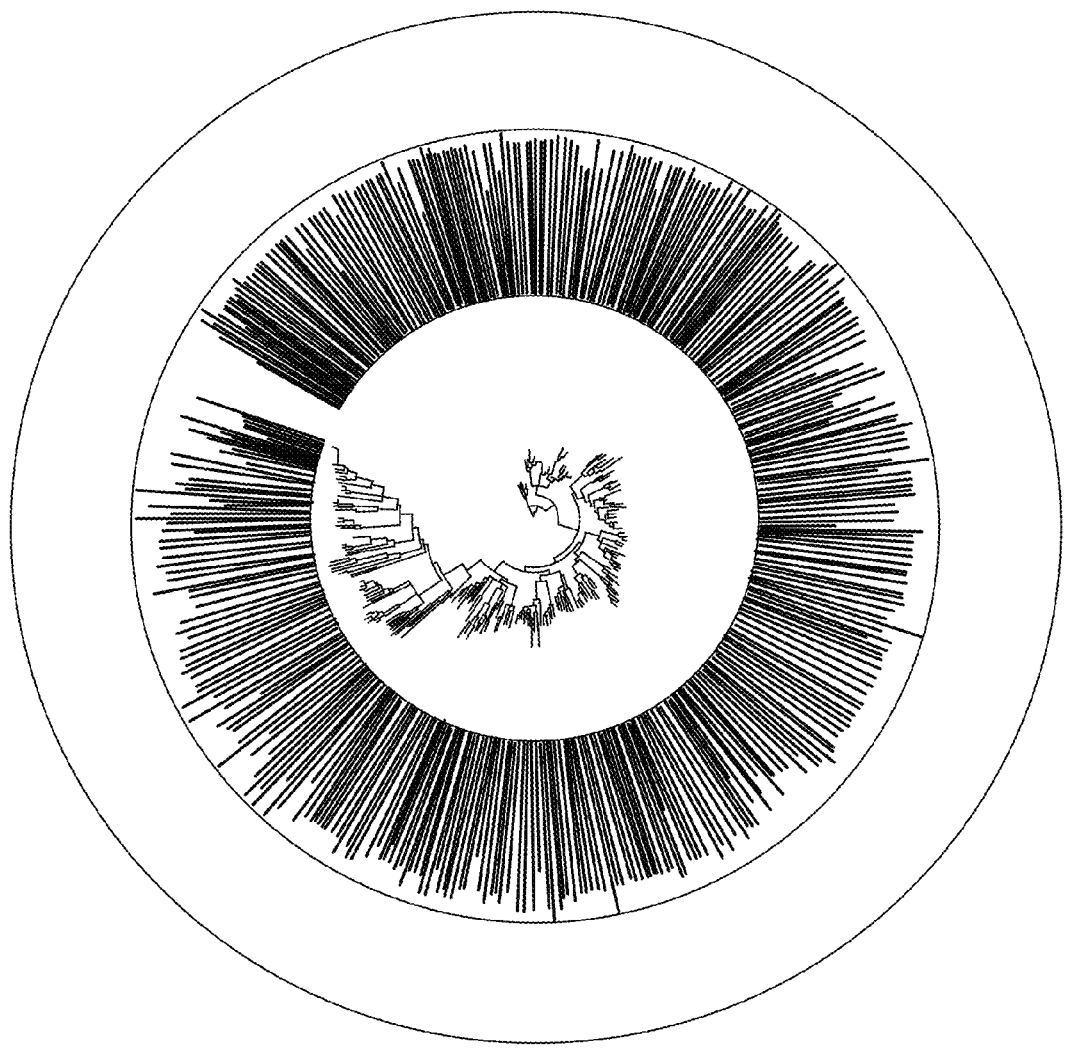
Figure 5:
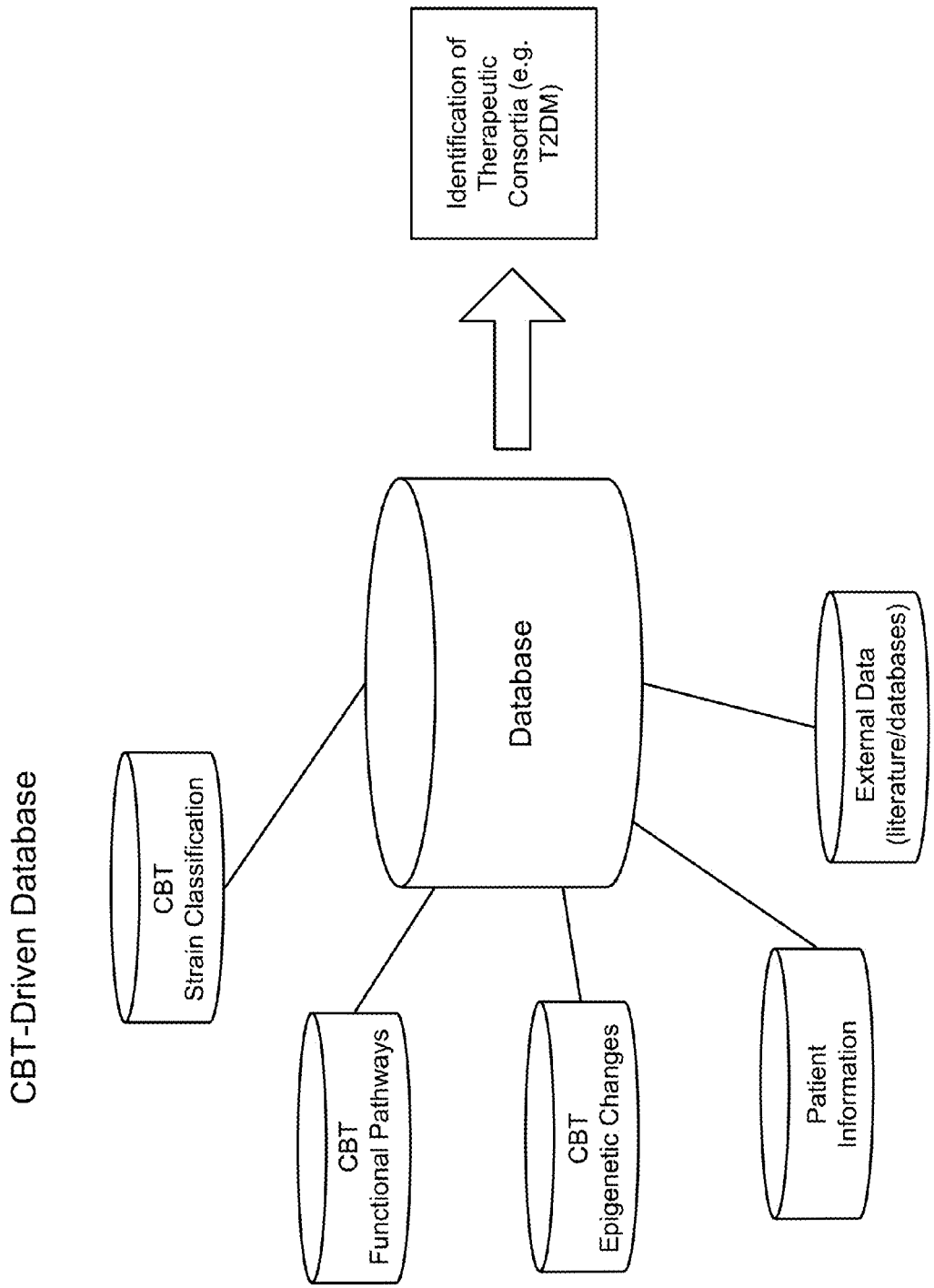
FIG. 5 depicts an illustrative process for generating a database using data obtained from the group consisting of: external data (e.g. scientific literature and/or databases), patient information, measured epigenetic changes, measured functional pathways, measured strain classification, and any combinations thereof. The database can be used, e.g. to drive identification of a therapeutic consortia (e.g. for treatment of health conditions or diseases).

A Complete Biome Test (CBT) can generate microbiome profiles with, for example, strain-level resolution. A CBT can be performed using microbiome profiling methods described herein. FIG. 3 provides an illustration depicting an exemplary platform for a CBT (e.g. as a diagnostic test or as a development tool to develop therapeutics). The specific microbiotic actionable targets starting with microbiotic strains obtained from, e.g. fecal matter transplants (FMT), the microorganism(s), the genus, and the presence/absence of microorganism strain(s) related to health conditions or diseases can be determined using the CBT. FIG. 4 (A) depicts the microbiome strain resolution using standard tests. FIG. 4 (B) depicts the increased microbiome strain resolution using the CBT. FIG. 5 depicts an illustrative process for generating a database (e.g., a CBT driven-database using data obtained from the group consisting of: external data (e.g. scientific literature and/or databases), patient information, measured epigenetic changes, measured functional pathways, measured strain classification, and any combinations thereof. The database can be used, e.g. to drive identification of a therapeutic consortia (e.g. for treatment of health conditions or diseases). FIG. 8 depicts how both the diagnostic and therapeutic approach outlined herein can comprise a targeted microbe strain selection or therapeutic consortia as compared to a composite fecal microbiome transplant.

Nucleic acid sample prepared from a biological sample can be subjected to a detection method to generate a profile of the microbiome associated with the sample. Profiling of a microbiome can comprise one or more detection methods.

Methods of the disclosure can be used to measure, for example, a 16S ribosomal subunit, a 23S ribosomal subunit, intergenic regions, and other genetic elements. Suitable detection methods can be chosen to provide sufficient discriminative power in a particular microbe in order to identify informative microbiome profiles.

In some applications, the entire genomic region of the 16S or 23S ribosomal subunit of the microbe is analyzed to determine a subject's microbiome profile. In some applications, the variable regions of the 16S and/or 23S ribosomal subunit of the microbe are analyzed to determine a subject's microbiome profile.

In some applications, the entire genome of the microbe is analyzed to determine a subject's microbiome profile. In other applications, the variable regions of the microbe's genome are analyzed to determine a subject's microbiome profile. For example, genetic variation in the genome can include restriction fragment length polymorphisms, single nucleotide polymorphisms, insertions, deletions, indels (insertions-deletions), microsatellite repeats, minisatellite repeats, short tandem repeats, transposable elements, randomly amplified polymorphic DNA, amplification fragment length polymorphism or a combination thereof.

In some embodiments, sequencing methods such as long-read length single molecule sequencing is used for detection. Long read sequencing can provide microbial classification down to the strain resolution of each microbe. Examples of sequencing technologies that can be used with the present disclosure for achieving long read lengths include the SMRT sequencing systems from Pacific Biosciences, long read length Sanger sequencing, long read ensemble sequencing approaches, e.g., Illumina/Moleculo sequencing and potentially, other single molecule sequencing approaches, such as Nanopore sequencing technologies.

Long read sequencing can include sequencing that provides a contiguous sequence read of for example, longer than 500 bases, longer than 800 bases, longer than 1000 bases, longer than 1500 bases, longer than 2000 bases, longer than 3000 bases, or longer than 4500 bases.

In some embodiments, detection methods of the disclosure comprise amplification-mode sequencing to profile the microbiome. In some embodiments, detection methods of the disclosure comprise a non-amplification mode, for example Whole Genome Shotgun (WGS) sequencing, to profile the microbiome.

Primers used in the disclosure can be prepared by any suitable method, for example, cloning of appropriate sequences and direct chemical synthesis. Primers can also be obtained from commercial sources. In addition, computer programs can be used to design primers. Primers can contain unique barcode identifiers.

Microbiome profiling can further comprise use of for example, a nucleic acid microarray, a biochip, a protein microarray, an analytical protein microarray, reverse phase protein microarray (RPA), a digital PCR device, and/or a droplet digital PCR device.

In some embodiments, the microbial profile is determined using additional information such as age, weight, gender, medical history, risk factors, family history, or any other clinically relevant information.

In some applications, a subject's microbiome profile comprises a single microbiome. For example, a subject's microbiome profile can comprise of at least one biological sample from only the subject's intestinal microbiome. In another example, a subject's microbiome profile can comprise of at least one biological sample from only the subject's stomach microbiome. In another example, a subject's microbiome profile can comprise of at least one biological sample from only the subject's gut microbiome. In another example, a subject's microbiome profile can comprise of at least one biological sample from only the subject's oral microbiome.

In some applications, a subject's microbiome profile comprises at least one biological sample from more than one microbiome. For example, a subject's microbiome profile can comprise of at least one biological sample from the subject's skin microbiome and at least one biological sample from the umbilical microbiome. In another example, a subject's microbiome profile can comprise of at least one biological sample from the subject's intestinal microbiome, at least one biological sample from the stomach microbiome, at least one biological sample from the gut microbiome, and at least one biological sample from the oral microbiome. In another example, a subject's microbiome profile can comprise of at least one biological sample from the subject's intestinal microbiome, and at least one biological sample from stomach microbiome. In another example, a subject's microbiome profile can comprise of at least one biological sample from the subject's gut microbiome, and at least one biological sample from oral microbiome. In some applications, a subject's microbiome profile can comprise of at least 2, 3, 4, 5, 6, 7, 8, 9, 10, 11, 12, 13, 14, 15, 16, 17, 18, 19, 20 microbiomes.

A subject's microbiome profile can comprise of one microbe. In some applications, a subject's microbiome profile comprises of, for example, 2 microbes, 3 or fewer microbes, 4 or fewer microbes, 5 or fewer microbes, 6 or fewer microbes, 7 or fewer microbes, 8 or fewer microbes, 9 or fewer microbes, 10 or fewer microbes, 11 or fewer microbes, no more than 12 microbes, 13 or fewer microbes, 14 or fewer microbes, 15 or fewer microbes, 16 or fewer microbes, 18 or fewer microbes, 19 or fewer microbes, 20 or fewer microbes, 25 or fewer microbes, 30 or fewer microbes, 35 or fewer microbes, 40 or fewer microbes, 45 or fewer microbes, 50 or fewer microbes, 55 or fewer microbes, 60 or fewer microbes, 65 or fewer microbes, 70 or fewer microbes, 75 or fewer microbes, 80 or fewer microbes, 85 or fewer microbes, 90 or fewer microbes, 100 or fewer microbes, 200 or fewer microbes, 300 or fewer microbes, 400 or fewer microbe, 500 or fewer microbes, 600 or fewer microbes, 700 or fewer microbes, or 800 or fewer microbes.

Algorithm-Based Methods

The present disclosure provides algorithm-based methods for building a microbiome profile of a subject. Non-limiting examples of algorithms that can be used with the disclosure include elastic networks, random forests, support vector machines, and logistic regression.

The algorithms can transform the underlying measurements into a quantitative score or probability relating to, for example, disease risk, disease likelihood, presence or absence of disease, presence or absence of a microbe, treatment response, and/or classification of disease status. The algorithms can aid in the selection of important microbes.

Analysis

A microbiome profile of a subject can be analyzed to determine information related to the health status of the subject. The information can include, for example, degree of likelihood of a disorder, presence or absence of a disease state, a poor clinical outcome, good clinical outcome, high risk of disease, low risk of disease, complete response, partial response, stable disease, non-response, and recommended treatments for disease management.

The analysis can be a part of a diagnostic assay to predict disease status of a subject or likelihood of a subject's response to a therapeutic. The diagnostic assay can use the quantitative score calculated by the algorithms-based methods described herein to perform the analysis.

In some applications, an increase in one or more microbes' threshold values or quantitative score in a subject's microbiome profile indicates an increased likelihood of one or more of: a poor clinical outcome, good clinical outcome, high risk of disease, low risk of disease, complete response, partial response, stable disease, non-response, and recommended treatments for disease management. In some embodiments, a decrease in the quantitative score indicates an increased likelihood of one or more of: a poor clinical outcome, good clinical outcome, high risk of disease, low risk of disease, complete response, partial response, stable disease, non-response, and recommended treatments for disease management.

In some applications, a decrease in one or more microbes' threshold values or quantitative score in a subject's microbiome profile indicates a decreased likelihood of one or more of: a poor clinical outcome, good clinical outcome, high risk of disease, low risk of disease, complete response, partial response, stable disease, non-response, and recommended treatments for disease management. In some embodiments, a decrease in the quantitative score indicates an increased likelihood of one or more of: a poor clinical outcome, good clinical outcome, high risk of disease, low risk of disease, complete response, partial response, stable disease, non-response, and recommended treatments for disease management.

In some applications, an increase in one or more microbes' threshold values or quantitative score in a subject's microbiome profile indicates an increased likelihood of one or more of: a poor clinical outcome, good clinical outcome, high risk of disease, low risk of disease, complete response, partial response, stable disease, non-response, and recommended treatments for disease management. In some applications, a decrease in one or more microbes' threshold values indicates an increased likelihood of one or more of: a poor clinical outcome, good clinical outcome, high risk of disease, low risk of disease, complete response, partial response, stable disease, non-response, and recommended treatments for disease management.

In some applications, an increase in one or more microbes' threshold values or quantitative score in a subject's microbiome profile indicates a decreased likelihood of one or more of: a poor clinical outcome, good clinical outcome, high risk of disease, low risk of disease, complete response, partial response, stable disease, non-response, and recommended treatments for disease management. In some applications, a decrease in one or more microbes' threshold values indicates an increased likelihood of one or more of: a poor clinical outcome, good clinical outcome, high risk of disease, low risk of disease, complete response, partial response, stable disease, non-response, and recommended treatments for disease management.

In some applications, a similar microbiome profile to a reference profile indicates an increased likelihood of one or more of: a poor clinical outcome, good clinical outcome, high risk of disease, low risk of disease, complete response, partial response, stable disease, non-response, and recommended treatments for disease management. In some applications, a dissimilar microbiome profile to a reference profile indicates one or more of: an increased likelihood of a poor clinical outcome, good clinical outcome, high risk of disease, low risk of disease, complete response, partial response, stable disease, non-response, and recommended treatments for disease management.

In some applications, a similar microbiome profile to a reference profile indicates a decreased likelihood of one or more of: a poor clinical outcome, good clinical outcome, high risk of disease, low risk of disease, complete response, partial response, stable disease, non-response, and recommended treatments for disease management. In some applications, a dissimilar microbiome profile to a reference profile indicates one or more of: an increased likelihood of a poor clinical outcome, good clinical outcome, high risk of disease, low risk of disease, complete response, partial response, stable disease, non-response, and recommended treatments for disease management.

In some applications, a dissimilar microbiome profile to a reference profile indicates an increased likelihood of one or more of: a poor clinical outcome, good clinical outcome, high risk of disease, low risk of disease, complete response, partial response, stable disease, non-response, and recommended treatments for disease management. In some applications, a dissimilar microbiome profile to a reference profile indicates one or more of: an increased likelihood of a poor clinical outcome, good clinical outcome, high risk of disease, low risk of disease, complete response, partial response, stable disease, non-response, and recommended treatments for disease management.

In some applications, a dissimilar microbiome profile to a reference profile indicates a decreased likelihood of one or more of: a poor clinical outcome, good clinical outcome, high risk of disease, low risk of disease, complete response, partial response, stable disease, non-response, and recommended treatments for disease management. In some applications, a dissimilar microbiome profile to a reference profile indicates one or more of: an increased likelihood of a poor clinical outcome, good clinical outcome, high risk of disease, low risk of disease, complete response, partial response, stable disease, non-response, and recommended treatments for disease management.

An accurate 16S Copy Number can be required to accurately quantify using 16S profiling. Using an incorrect database estimate of the copy number can be off by several factors, and in some cases an order of magnitude or more.

FIG. 12 illustrates that de novo assembly for *C. butyricum* using methods of the invention can result in the use of less contigs (e.g., 2 contigs) than those found in the database (e.g., 40 contigs).

FIG. 13 (A) illustrates that de novo assembly using a method of the invention can differentiate between several operon orderings and for this example strain of *C. butyricum* a 'type C' ordering was discovered. (B) Tabulates the exact genomic coordinates for five of the butyrate pathway genes for this strain.

Accuracy and Sensitivity

The methods provided herein can provide strain classification of a genera, species or sub-strain level of one or more microbes in a sample with an accuracy of greater than 1%, 20%, 30%, 40%, 50%, 55%, 60%, 65%, 70%, 75%, 80%, 85%, 90%, 95%, 96%, 97%, 98%, 99%, 99.2%, 99.5%, 99.7%, or 99.9%. The methods provided herein can provide strain quantification of a genera, species or sub-strain level of one or more microbes in a sample with an accuracy of greater than 1%, 20%, 30%, 40%, 50%, 55%, 60%, 65%, 70%, 75%, 80%, 85%, 90%, 95%, 96%, 97%, 98%, 99%, 99.2%, 99.5%, 99.7%, or 99.9%.

The microbial profile can have an accuracy of 70% or greater based on measurement of 15 or fewer microbes in the biological sample. Such profiling method can have at least an accuracy greater than 70% based on measurement of no more than 2 microbes, 3 or fewer microbes, 4 or fewer microbes, 5 or fewer microbes, 6 or fewer microbes, 7 or fewer microbes, 8 or fewer microbes, 9 or fewer microbes, 10 or fewer microbes, 11 or fewer microbes, no more than 12 microbes, 13 or fewer microbes, 14 or fewer microbes, 15 or fewer microbes, 16 or fewer microbes, 18 or fewer microbes, 19 or fewer microbes, 20 or fewer microbes, 25 or fewer microbes, 30 or fewer microbes, 35 or fewer microbes, 40 or fewer microbes, 45 or fewer microbes, 50 or fewer microbes, 55 or fewer microbes, 60 or fewer microbes, 65 or fewer microbes, 70 or fewer microbes, 75 or fewer microbes, 80 or fewer microbes, 85 or fewer microbes, 90 or fewer microbes, or 100 or fewer microbes, 200 or fewer microbes, 300 or fewer microbes, 400 or fewer microbes, 500 or fewer microbes, 600 or fewer microbes, 700 or fewer microbes, or 800 or fewer microbes.

The diagnostic methods provided by the present disclosure for the diseases provided herein can have at least one of a sensitivity of 70% or greater and specificity of greater than 70% based on measurement of 15 or fewer microbes in the biological sample. Such diagnostic method can have at least one of a sensitivity greater than 70% and specificity greater than 70% based on measurement of no more than 2 microbes, 3 or fewer microbes, 4 or fewer microbes, 5 or fewer microbes, 6 or fewer microbes, 7 or fewer microbes, 8 or fewer microbes, 9 or fewer microbes, 10 or fewer microbes, 11 or fewer microbes, no more than 12 microbes, 13 or fewer microbes, 14 or fewer microbes, 15 or fewer microbes, 16 or fewer microbes, 18 or fewer microbes, 19 or fewer microbes, 20 or fewer microbes, 25 or fewer microbes, 30 or fewer microbes, 35 or fewer microbes, 40 or fewer microbes, 45 or fewer microbes, 50 or fewer microbes, 55 or fewer microbes, 60 or fewer microbes, 65 or fewer microbes, 70 or fewer microbes, 75 or fewer microbes, 80 or fewer microbes, 85 or fewer microbes, 90 or fewer microbes, or 100 or fewer microbes, 200 or fewer microbes, 300 or fewer microbes, 400 or fewer microbes, 500 or fewer microbes, 600 or fewer microbes, 700 or fewer microbes or 800 or fewer microbes.

The methods provided herein can provide a health status of a subject with a specificity greater than 1%, 20%, 30%, 40%, 50%, 55%, 60%, 65%, 70%, 75%, 80%, 85%, 90%, 95%, 96%, 97%, 98%, 99%, 99.2%, 99.5%, 99.7%, or 99.9% receiver operating characteristic (ROC). The methods provided herein can provide a health status of a subject with a sensitivity lesser than 1%, 20%, 30%, 40%, 50%, 55%, 60%, 65%, 70%, 75%, 80%, 85%, 90%, 95%, 96%, 97%, 98%, 99%, 99.2%, 99.5%, 99.7%, or 99.9% ROC.

Methods for Treating a Subject

The disclosure provides methods for treating a subject. Altering the composition of a microbiome in a subject can have desired health consequences. Compositions of the disclosure can be administered as a therapeutic and/or a cosmetic for treating a health condition. Treatments designed to alter the host microbiome(s) can result in a reduction of patient symptoms, prevention of disease, and or treatment of the disease or health condition. For example, modification of the gut microbiome can reduce the risk for health conditions such as metabolic disorders.

The disclosure provides methods for the restoration of a microbial habitat of a subject to a healthy state. The method can comprise microbiome correction and/or adjustment including for example, replenishing native microbes, removing pathogenic microbes, administering prebiotics, and growth factors necessary for microbiome survival. In some embodiments, the method also comprises administering antimicrobial agents such as antibiotics.

Based on the microbiome profile, the present disclosure provides methods for generalized-treatment recommendation for a subject as well as methods for subject-specific treatment recommendation. Methods for treatments can comprise one of the following steps: determining a first ratio of a level of a subject-specific microbiome profile to a level of a second microbiome profile in a biological sample obtained from at least one subject, detecting a presence or absence of a disease in the subject based upon the determining, and recommending to the subject at least one generalized or subject-specific treatment to ameliorate disease symptoms.

Figure 1:
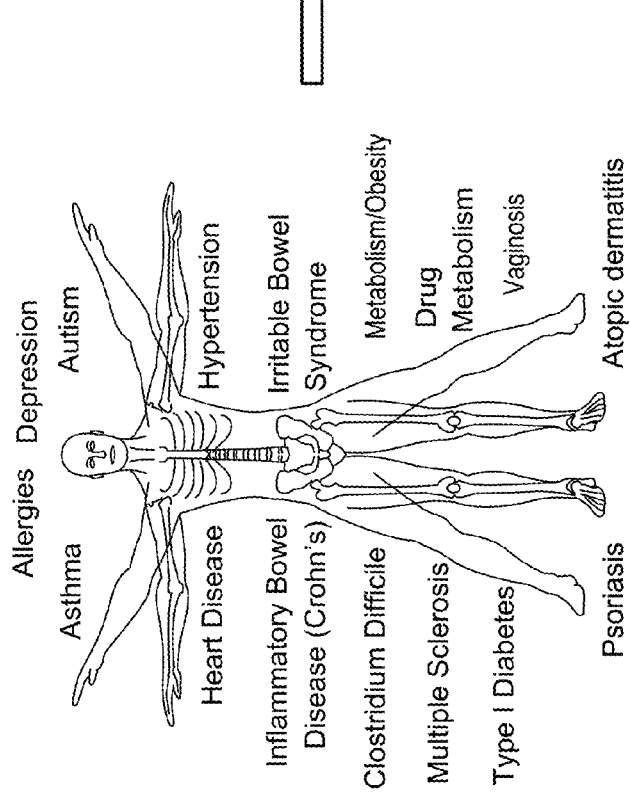
FIG. 1 depicts exemplary microbiome-related health conditions and diseases for which microbiome therapeutics and diagnostics can be used. These health conditions can include: preterm labor, chronic fatigue syndrome, skin health (e.g. acne), Type 2 Diabetes Mellitus (T2DM), allergies, depression, autism, asthma, hypertension, irritable bowel syndrome, metabolism, obesity, drug metabolism, vaginosis, atopic dermatitis, psoriasis, Type I Diabetes (T1DM), Multiple Sclerosis, *Clostridium Difficile*, Inflammatory Bowel Disease (IBD), Crohn's Disease, genitourinary disorders, and heart disease.

FIG. 1 depicts some non-limiting heath conditions that can be affected by the microbiome. These health conditions can include, for example, Type 2 Diabetes Mellitus (T2DM), preterm labor, chronic fatigue syndrome, skin conditions such as acne, allergies, autism, asthma, depression, hypertension, irritable bowel syndrome, metabolic syndrome, obesity, lactose intolerance, oral thrush, ulcerative colitis, drug metabolism, vaginosis, atopic dermititus, psoriasis, Type I Diabetes Mellitus (T1DM), Multiple Sclerosis, neurological disorders such as Parkinson's disease, *Clostridium Difficile* infection, Inflammatory Bowel Disease, Crohn's Disease, heart disease, diabetic foot ulcers, bacteremia, infantile colic, cancer, cystic fibrosis, multiple sclerosis, urinary tract infection, radiation enteropathy, drug metabolism, dental cavities, and halitosis. The present disclosure can provide for a diagnostic assay of at least one microbiome that includes a report that gives guidance on health status or treatment modalities for the health conditions described herein. The present disclosure can also provide therapeutic and/or cosmetic formulations for treatment of health conditions described herein.

Inflammatory bowel disease (IBD) can involve chronic inflammation of all or part of the digestive tract. IBD can lead to ulcerative colitis and/or Crohn's disease. IBD can be painful and debilitating, and sometimes leads to life-threatening complications.

Preterm labor can occur when contractions begin to open the cervix before 37 weeks of pregnancy. The earlier premature birth happens, the greater the health risks for the developing baby. Many premature babies need special care in the neonatal intensive care unit. Premature babies can also have long-term mental and physical disabilities.

Obesity can be a complex disorder involving an excessive amount of body fat. Obesity can increase the risk of diseases and health problems such as heart disease, diabetes and high blood pressure.

Peripheral neuropathy is the most common form of diabetic neuropathy. In peripheral neuropathy, the feet and legs can be affected first, followed by the hands and arms. Possible signs and symptoms of peripheral neuropathy can include serious foot problems, such as ulcers, infections, deformities, and bone and joint pain.

Bacteremia or septicemia can refer to the presence of bacteria in the blood. A diagnosis of bacteremia can be confirmed by a blood culture. Treatment can require hospitalization and intravenous antibiotics. Bacteremia can quickly progress to severe sepsis.

Acne is a skin condition that can occur when the hair follicles become plugged with oil and dead skin cells. Acne can appear on the face, neck, chest, back and shoulders. Depending on the severity of the acne, the condition can cause emotional distress and lead to scarring of the skin.

Infantile colic can refer to a condition involving an infant with excessive crying, irritability, or fussiness. Babies with colic can cry for more than three hours a day, three days a week for three weeks or longer.

Type 2 diabetes also known as adult-onset or noninsulin-dependent diabetes can be a chronic condition that affects the way the body metabolizes glucose. In type 2 diabetes, the body can either resist the effects of insulin or not produce enough insulin to maintain a normal glucose level. Untreated, type 2 diabetes can be life-threatening. Symptoms of Type 2 diabetes can include, for example, increased thirst and frequent urination, increased hunger, weight gain, weight loss, fatigue, blurred vision, slow-healing sores or frequent infections, areas of darkened skin, and acanthosis nigricans.

*Clostridium difficile* also called *C. difficile* or *C. diff* is a bacterium that can cause symptoms ranging from diarrhea to life-threatening inflammation of the colon.

Asthma is a condition in which the airways can become narrow, swell and produce extra mucus. The changes in the airway can make breathing difficult and trigger coughing, wheezing and shortness of breath.

Autism spectrum disorder (ASD) can be a serious neurodevelopmental disorder that impairs a child's ability to communicate and interact with others. The disorder also includes restricted repetitive behaviors, interests and activities. ASC can include autism, Asperger's syndrome, childhood disintegrative disorder and pervasive developmental disorder not otherwise specified.

Psoriasis is a persistent and chronic skin condition that can change the life cycle of skin cells. Psoriasis can cause cells to build up rapidly on the surface of the skin. The extra skin cells can form thick, silvery scales and itchy, dry, red patches that are sometimes painful.

Allergies can occur when the immune system reacts to a foreign substance such as pollen, bee venom or pet dander. The immune system's reaction to an allergen can involve inflammation of the skin, sinuses, airways or digestive system.

Cardiovascular diseases can affect the heart, arteries and veins of the body. Examples of some cardiovascular disease include heart valve disease, coronary artery disease, congenital heart disease in adults and congenital heart spontaneous coronary artery dissection, heart failure, heart rhythm disorders (arrhythmias).

Cancer can refer to any one of a large number of proliferative diseases characterized by the development of abnormal cells that divide uncontrollably and have the ability to infiltrate and destroy normal body tissues and organs.

Depression, major depression, major depressive disorder or clinical depression can refer to a mood disorder that causes a persistent feeling of sadness and loss of interest. Depression can affect how a subject feels, thinks and behaves and can lead to a variety of emotional and physical problems.

Cystic fibrosis is a life-threatening genetic disorder that can cause severe damage to the lungs and digestive system. Cystic fibrosis affects the cells that produce secreted fluids such as mucus, sweat and digestive juices that act as lubricants in the body. These secreted fluids are normally thin and slippery but in cystic fibrosis the secretions to become thick and sticky resulting in plugging up tubes, ducts and passageways, especially in the lungs and pancreas.

Multiple sclerosis is a disease in which the immune system attacks the protective sheath (myelin) that covers the nerves. Myelin damage disrupts communication between the brain and the rest of the body. Ultimately, the nerves themselves may deteriorate a process that's currently irreversible.

Urinary tract infection is an infection in any part of the urinary system (e.g. kidneys, ureters, bladder and urethra). Urinary tract infection can be painful. Serious consequences can occur if a urinary tract infection spreads to the kidneys.

Radiation enteropathy can refer to radiation-induced gastrointestinal injury. Radiotherapy is a mainstay of oncological treatment for a variety of malignant diseases. Radiotherapy can be administered to the abdomen and pelvis of patients with gastrointestinal (GI), urological and gynaecological cancers.

Drug metabolism can refer to the rate at which the body breaks down as drug after administration.

Chronic fatigue syndrome is a complicated disorder characterized by extreme fatigue that cannot be explained by an underlying medical condition. The fatigue may worsen with physical or mental activity, but may not improve with rest.

Type 1 diabetes, also known as juvenile diabetes or insulin-dependent diabetes, is a chronic condition in which the pancreas produces little or no insulin, a hormone needed to allow sugar (glucose) to enter cells to produce energy. Various factors may contribute to type 1 diabetes, including genetics and exposure to certain viruses. Although type 1 diabetes typically appears during childhood or adolescence, it also can develop in adults.

Dental cavities can be caused by the conversion of sugar from food to elongated, sticky sugar chains through a bacterially produced glucansucrase enzyme. One approach to treat and/or prevent cavities can be to reduce the proportion of *Streptococcus mutans*, which is the bacteria associated with tooth decay. This approach can leave enzymes such as enzymes used by the body to break down starches intact while simultaneously minimizing the rate of cavity formation.

Halitosis is a dental condition in which excessively bad breath can be produced by the microbial flora present in a subject's mouth. Examples of halitosis related microbes include gram-negative bacteria such as *Prevotella intermedia, Porphyromonas gingivalis, Treponema denticola*. Methods of the disclosure can be used to generate a list comprising problematic and protective microbes associated with halitosis.

Antibiotics can alter microbial populations in the gastrointestinal tract. This alteration can result in antimicrobial-associated diarrhea and/or colitis.

Obesity can occur in subjects with a body mass index of 30 or greater. Obesity can be associated with, for example, breathlessness, increased sweating, snoring, difficulty sleeping, inability to cope with sudden physical activity, fatigue, back pain, joint pain, high blood pressure, hypertension, high cholesterol levels, coronary heart disease, stroke, thirst, frequent urination, and diabetes.

A subject treated with the microbial compositions of the invention can lose weight. The subject can lose, for example, about: 0.1, 0.2, 0.3, 0.4, 0.5, 0.6, 0.7, 0.8, 0.9, 1, 2, 3, 4, 5, 6, 7, 8, 9, 10, 11, 12, 13, 14, 15, 16, 17, 18, 19, 20, 25, 30, 35, 40, 45, 50, 55, 60, 65, 70, 75, 80, 85, 90, 95, or 100 pounds of body weight.

A subject treated with the microbial compositions of the invention can lose weight. The subject can lose, for example, about: 0.1, 0.2, 0.3, 0.4, 0.5, 0.6, 0.7, 0.8, 0.9, 1, 2, 3, 4, 5, 6, 7, 8, 9, 10, 11, 12, 13, 14, 15, 16, 17, 18, 19, 20, 25, 30, 35, 40, 45, 50, 55, 60, 65, 70, 75, 80, 85, 90, 95, or 100 pounds of body weight.

A subject treated with the microbial compositions of the invention can gain weight. The subject can gain, for example, about: 0.1, 0.2, 0.3, 0.4, 0.5, 0.6, 0.7, 0.8, 0.9, 1, 2, 3, 4, 5, 6, 7, 8, 9, 10, 11, 12, 13, 14, 15, 16, 17, 18, 19, 20, 25, 30, 35, 40, 45, 50, 55, 60, 65, 70, 75, 80, 85, 90, 95, or 100 pounds of body weight.

The body mass index of a subject treated with the microbial compositions of the invention can be reduced to, for example, less than 30, between about 25 to 30, or less than about 25.

Microbial compositions of the invention can increase blood glucose levels. Microbial compositions of the invention can decrease blood glucose levels. An oral glucose tolerance test (OGTT) can be used to measure glucose tolerance. Fasting plasma glucose, measured before the OGTT begins, of below 6.1 mmol/L (i.e. 110 mg/dL) can be considered normal. Fasting levels between 6.1 and 7.0 mmol/L (i.e. 110 and 125 mg/dL) can be considered borderline (e.g., impaired fasting glycaemia). Fasting levels repeatedly at or above 7.0 mmol/L (i.e. 126 mg/dL) can be diagnostic of diabetes. Microbial compositions of the invention can decrease blood glucose levels to normal levels, for example, below 6.1 mmol/L (i.e. 110 mg/dL). Microbial compositions of the invention can decrease blood glucose levels to below diabetes levels or below borderline levels as described herein.

Metabolic Diseases

Modifying a patient's microbiome, e.g. gut, intestinal tract, and/or colon microbiome, can result in prevention and/or treatment of a metabolic health condition, including: T2DM, T1DM, obesity, metabolic disorder, insulin resistance, and other diseases.

In some embodiments, the metabolic condition is T2DM. In some embodiments, the metabolic condition is obesity. In some embodiments, the metabolic condition is T1DM.

Butyrate is an anti-inflammatory factor that can affects gut permeability. Low levels of butyrate producing bacteria (e.g. *Clostridium* clusters XIVa and IV) as well as reduced lactate producing bacteria (e.g. *Bifidobacterium adolescentis*) can be correlated with T1DM. Low levels of butyrate producing bacteria (e.g. *Clostridium* clusters XIVa and IV) as well as reduced lactate producing bacteria (e.g. *Bifidobacterium adolescentis*) can be correlated with T2DM. Low levels of butyrate producing bacteria (e.g. *Clostridium* clusters XIVa and IV) as well as reduced lactate producing bacteria (e.g. *Bifidobacterium adolescentis*) can be correlated with obesity. Low levels of butyrate producing bacteria (e.g. *Clostridium* clusters XIVa and IV) as well as reduced lactate producing bacteria (e.g. *Bifidobacterium adolescentis*) can be correlated with a metabolic disorder. Subsets of a formulation that comprises at least one primary fermenter and at least one secondary fermenter can be used for the treatment and/or mitigate progression of a metabolic health condition, for example, T1DM.

Figure 2:
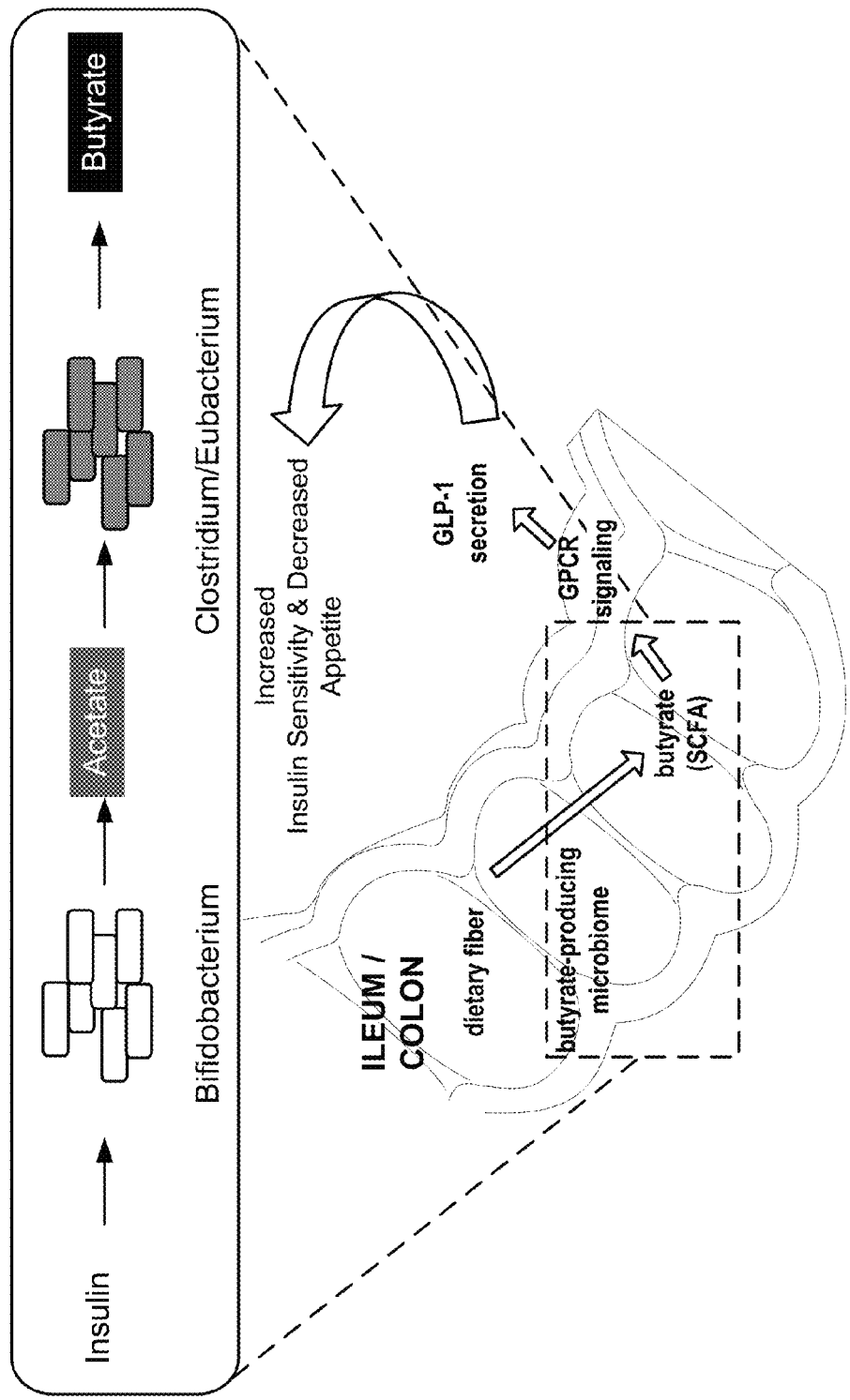
FIG. 2 depicts an illustrative microbiome mediated pathway that can be affected to create a Type 2 Diabetes Mellitus (T2DM) therapeutic. A formulation comprising a prebiotic (e.g. inulin), a primary fermenter (e.g. *Bifidobacterium*), and a secondary fermenter (e.g. *Clostridium* and/or *Eubacterium*) can be used for butyrate production.

FIG. 2 depicts a critical digestive pathway that can impact metabolic-related health conditions. Alteration of the pathway using microbial compositions of the invention can result in treatment. In the colon, dietary fiber can be processed by butyrate-producing microorganisms to produce butyrate (i.e. butanoate), which is a short chain fatty acid (SCFA). In turn, butyrate can initiate G-protein coupled receptor (GPCR) signaling, leading to glucagon-like peptide-1 (GLP-1) secretion which can result in increased insulin sensitivity and/or decreased appetite. By altering the butyrate-producing microbiome in a subject, e.g. with T2DM or insulin insensitivity, the pathway can be stimulated. In some patients, insulin sensitivity can be increased and/or restored to pre-diabetic levels with a microbial composition.

In some aspects of the invention, strains of interest are chosen by identifying a superset of bacteria that play a role in the functional pathway that leads to GLP-1 production (e.g. bacteria that have butyrate kinase, butyrate coenzyme A (CoA), and/or butyrate CoA transferase genes).

Butyrate kinase is an enzyme that can belong to a family of transferases, for example those transferring phosphorus-containing groups (e.g., phosphotransferases) with a carboxy group as acceptor. The systematic name of this enzyme class can be ATP:butanoate 1-phosphotransferase. Butyrate kinase can participate in butyrate metabolism. Butyrate kinase can catalyze the following reaction:

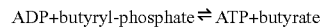

ADP+butyryl-phosphate ⇌ ATP+butyrate

Butyrate-Coenzyme A, also butyryl-coenzyme A, can be a coenzyme A-activated form of butyric acid. It can be acted upon by butyryl-CoA dehydrogenase and can be an intermediary compound in acetone-butanol-ethanol fermentation. Butyrate-Coenzyme A can be involved in butyrate metabolism.

Butyrate-Coenzyme A transferase, also known as butyrate-acetoacetate CoA-transferase, can belong to a family of transferases, for example, the CoA-transferases. The systematic name of this enzyme class can be butanoyl-CoA:acetoacetate CoA-transferase. Other names in common use can include butyryl coenzyme A-acetoacetate coenzyme A-transferase, and butyryl-CoA-acetoacetate CoA-transferase. Butyrate-Coenzyme A transferase can catalyze the following chemical reaction:

butanoyl-CoA+acetoacetate ⇌ butanoate+acetoacetyl-CoA

Butyryl-CoA dehydrogenase can belong to the family of oxidoreductases, for example, those acting on the CH—CH group of donor with other acceptors. The systematic name of this enzyme class can be butanoyl-CoA:acceptor 2,3-oxidoreductase. Other names in common use can include butyryl dehydrogenase, unsaturated acyl-CoA reductase, ethylene reductase, enoyl-coenzyme A reductase, unsaturated acyl coenzyme A reductase, butyryl coenzyme A dehydrogenase, short-chain acyl CoA dehydrogenase, short-chain acyl-coenzyme A dehydrogenase, 3-hydroxyacyl CoA reductase, and butanoyl-CoA:(acceptor) 2,3-oxidoreductase. Non-limiting examples of metabolic pathways that butyryl-CoA dehydrogenase can participate in include: fatty acid metabolism; valine, leucine and isoleucine degradation; and butanoate metabolism. Butyryl-CoA dehydrogenase can employ one cofactor, FAD. Butyryl-CoA dehydrogenase can catalyze the following reaction:

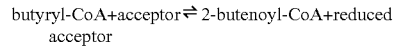

butyryl-CoA+acceptor ⇌ 2-butenoyl-CoA+reduced acceptor

Beta-hydroxybutyryl-CoA dehydrogenase or 3-hydroxybutyryl-CoA dehydrogenase can belong to a family of oxidoreductases, for example, those acting on the CH—OH group of donor with NAD+ or NADP+ as acceptor. The systematic name of the enzyme class can be (S)-3-hydroxybutanoyl-CoA:NADP+oxidoreductase. Other names in common use can include beta-hydroxybutyryl coenzyme A dehydrogenase, L(+)-3-hydroxybutyryl-CoA dehydrogenase, BHBD, dehydrogenase, L-3-hydroxybutyryl coenzyme A (nicotinamide adenine, dinucleotide phosphate), L-(+)-3-hydroxybutyryl-CoA dehydrogenase, and 3-hydroxybutyryl-CoA dehydrogenase. Beta-hydroxybutyryl-CoA dehydrogenase enzyme can participate in benzoate degradation via coa ligation. Beta-hydroxybutyryl-CoA dehydrogenase enzyme can participate in butanoate metabolism. Beta-hydroxybutyryl-CoA dehydrogenase can catalyze the following reaction:

(S)-3-hydroxybutanoyl-CoA+NADP$^+$ ⇌ 3-acetoacetyl-CoA+NADPH+H$^+$

Crotonase can comprise enzymes with, for example, dehalogenase, hydratase, isomerase activities. Crotonase can be implicated in carbon-carbon bond formation, cleavage, and hydrolysis of thioesters. Enzymes in the crotonase superfamily can include, for example, enoyl-CoA hydratase which can catalyse the hydration of 2-trans-enoyl-CoA into 3-hydroxyacyl-CoA; 3-2trans-enoyl-CoA isomerase or dodecenoyl-CoA isomerise (e.g., EC 5.3.3.8), which can shift the 3-double bond of the intermediates of unsaturated fatty acid oxidation to the 2-trans position; 3-hydroxbutyryl-CoA dehydratase (e.g., crotonase; EC 4.2.1.55), which can be involved in the butyrate/butanol-producing pathway; 4-Chlorobenzoyl-CoA dehalogenase (e.g., EC 3.8.1.6) which can catalyze the conversion of 4-chlorobenzoate-CoA to 4-hydroxybenzoate-CoA; dienoyl-CoA isomerase, which can catalyze the isomerisation of 3-trans,5-cis-dienoyl-CoA to 2-trans,4-trans-dienoyl-CoA; naphthoate synthase (e.g., MenB, or DHNA synthetase; EC 4.1.3.36), which can be involved in the biosynthesis of menaquinone (e.g., vitamin K2); carnitine racemase (e.g., gene caiD), which can catalyze the reversible conversion of crotonobetaine to L-carnitine in *Escherichia coli*; Methylmalonyl CoA decarboxylase (e.g., MMCD; EC 4.1.1.41); carboxymethylproline synthase (e.g., CarB), which can be involved in carbapenem biosynthesis; 6-oxo camphor hydrolase, which can catalyze the desymmetrization of bicyclic beta-diketones to optically active keto acids; the alpha subunit of fatty acid oxidation complex, a multi-enzyme complex that can catalyze the last three reactions in the fatty acid beta-oxidation cycle; and AUH protein, which can be a bifunctional RNA-binding homologue of enoyl-CoA hydratase.

Thiolases, also known as acetyl-coenzyme A acetyltransferases (ACAT), can convert two units of acetyl-CoA to acetoacetyl CoA, for example, in the mevalonate pathway. Thiolases can include, for example, degradative thiolases (e.g., EC 2.3.1.16) and biosynthetic thiolases (e.g., EC 2.3.1.9). 3-ketoacyl-CoA thiolase, also called thiolase I, can be involved in degradative pathways such as fatty acid beta-oxidation. Acetoacetyl-CoA thiolase, also called thiolase II, can be specific for the thiolysis of acetoacetyl-CoA and can be involved in biosynthetic pathways such as poly beta-hydroxybutyric acid synthesis or steroid biogenesis. A thiolase can catalyze the following reaction:

lation that comprises at least one primary fermenter and at least one secondary fermenter can be used for the treatment and/or mitigate progression of a metabolic health condition, for example, T2DM and obesity. The formulation can additionally comprise a prebiotic.

In some embodiments, a therapeutic composition comprises at least one primary fermenter and at least one secondary fermenter. In some embodiments, a therapeutic composition comprises at least one primary fermenter, at least one secondary fermenter, and at least one prebiotic. In one non-limiting example, a therapeutic composition can comprise *Bifidobacterium adolescentis, Clostridium indolis*, and inulin. In another non-limiting example, a therapeutic composition can comprise *Bifidobacterium longum, Faecalibacterium prausnitzii*, and starch.

*Akkermansia muciniphila* can be a gram negative, strict anaerobe that can play a role in mucin degradation. Levels of *Akkermansia muciniphila* can be reduced in subjects with metabolic disorders, for example, obesity and T2DM. *Akkermansia muciniphila* can protect against metabolic disorder, for example, through increased levels of endocannabinoids that control inflammation, the gut barrier, and gut peptide secretion. *Akkermansia muciniphila* can serve as a primary fermenter.

*Bifidobacterium adolescentis* can be a gram-positive anaerobe, which can be found in healthy human gut from infancy. *Bifidobacterium adolescentis* can synthesize B vitamins *Bifidobacterium adolescentis* can serve as a primary fermenter.

*Bifidobacterium infantis* can be a gram-positive, catalase negative, micro-aerotolerant anaerobe. *Bifidobacterium infantis* can serve as a primary fermenter.

*Bifidobacterium longum* can be a gram-positive, catalase negative, micro-aerotolerant anaerobe. *Bifidobacterium longum* can serve as a primary fermenter.

*Clostridium beijerinckii* can be a gram-positive, strict anaerobe that belongs to Clostridial cluster I. *Clostridium beijerinckii* can serve as a secondary fermenter.

*Clostridium butyricum* can be a gram-positive, strict anaerobe that can serve as a secondary fermenter.

*Clostridium indolis* can be a gram-positive, strict anaerobe that belongs to Clostridial cluster XIVA. *Clostridium indolis* can serve as a secondary fermenter.

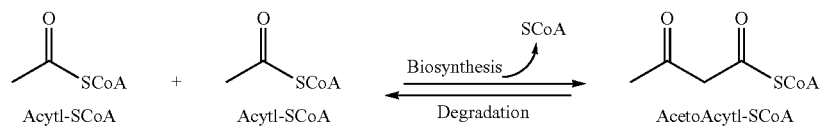

As shown in FIG. 2, production of butyrate can involve two major phases or microbes, for example, a primary fermenter and a secondary fermenter. The primary fermenter can produce intermediate molecules (e.g. lactate, acetate) when given an energy source (e.g. fiber). The secondary fermenter can convert the intermediate molecules produced by the primary fermenter into butyrate. Non-limiting examples of primary fermenter include *Akkermansia muciniphila, Bifidobacterium adolescentis, Bifidobacterium infantis* and *Bifidobacterium longum*. Non-limiting examples of secondary fermenter include *Clostridium beijerinckii, Clostridium butyricum, Clostridium indolis, Eubacterium hallii*, and *Faecalibacterium prausnitzii*. A combination of primary and secondary fermenters can be used to produce butyrate in a subject. Subsets of a formu-

*Eubacterium hallii* can be a gram-positive, anaerobe that belongs to Arrangement A Clostridial cluster XIVA. *Eubacterium hallii* can serve as a secondary fermenter.

*Faecalibacterium prausnitzii* can be a gram-positive, anaerobe belonging to Clostridial cluster IV. *Faecalibacterium prausnitzii* can be one of the most common gut bacteria and the largest butyrate producer. *Faecalibacterium prausnitzii* can serve as a secondary fermenter.

Non-limiting examples of genes involved in the generation of butyrate include: butyryl-CoA dehydrogenase, beta-hydroxybutyryl-CoA dehydrogenase or 3-hydroxybutyryl-CoA dehydrogenase, crotonase, electron transfer protein a, electron transfer protein b, and thiolase Measuring the microbiome of hosts can show that microbiomes lacking various strains of microorganisms can result in a health condition and/or disease state (e.g. T2DM and obesity). Restoring one or more lacking strains (e.g. via a bacterial strain such as *E. hallii* or treatment with fermented milk products) can result in alteration of the health condition. Some non-limiting examples include altering the gut microbiome such that the host has an increased capacity for energy harvest, increased insulin sensitivity, and/or decreased appetite.

To treat metabolic conditions, for example, T2DM, obesity, and/or T1DM, one or more of the following microorganisms can be administered to the colon: *Butyrivibrio fibrisolvens, Clostridium acetobutylicum, Clostridium beijerinckii, Faecalibacterium prausnitzii, Roseburia cecicola, Clostridium butyricum, Bifidobacterium infantis, Bifidobacterium longum, Bifidobacterium adolescentis, Streptococcus mutans, Ruminococcus gnavus, Roseburia inulinivorans, Akkermansia muciniphila, Fibrobacter succinogenes, Ruminococcus flavefaciens, Anaerostipes caccae, Eubacterium hallii, Clostridium indolis, Eubacterium rectale*, or any combination thereof. The microorganisms can be administered with a prebiotic.

In some embodiments, a pharmaceutical composition comprising one or more of the following microorganisms are administered for the treatment of metabolic conditions: *Butyrivibrio fibrisolvens, Clostridium acetobutylicum, Clostridium beijerinckii, Faecalibacterium prausnitzii, Roseburia cecicola, Clostridium butyricum, Bifidobacterium infantis, Bifidobacterium longum, Bifidobacterium adolescentis, Streptococcus mutans, Ruminococcus gnavus, Roseburia inulinivorans, Akkermansia muciniphila, Fibrobacter succinogenes, Ruminococcus flavefaciens, Anaerostipes caccae, Eubacterium hallii, Clostridium indolis* and *Eubacterium rectale*. The composition can additionally comprise a prebiotic.

Figure 6:
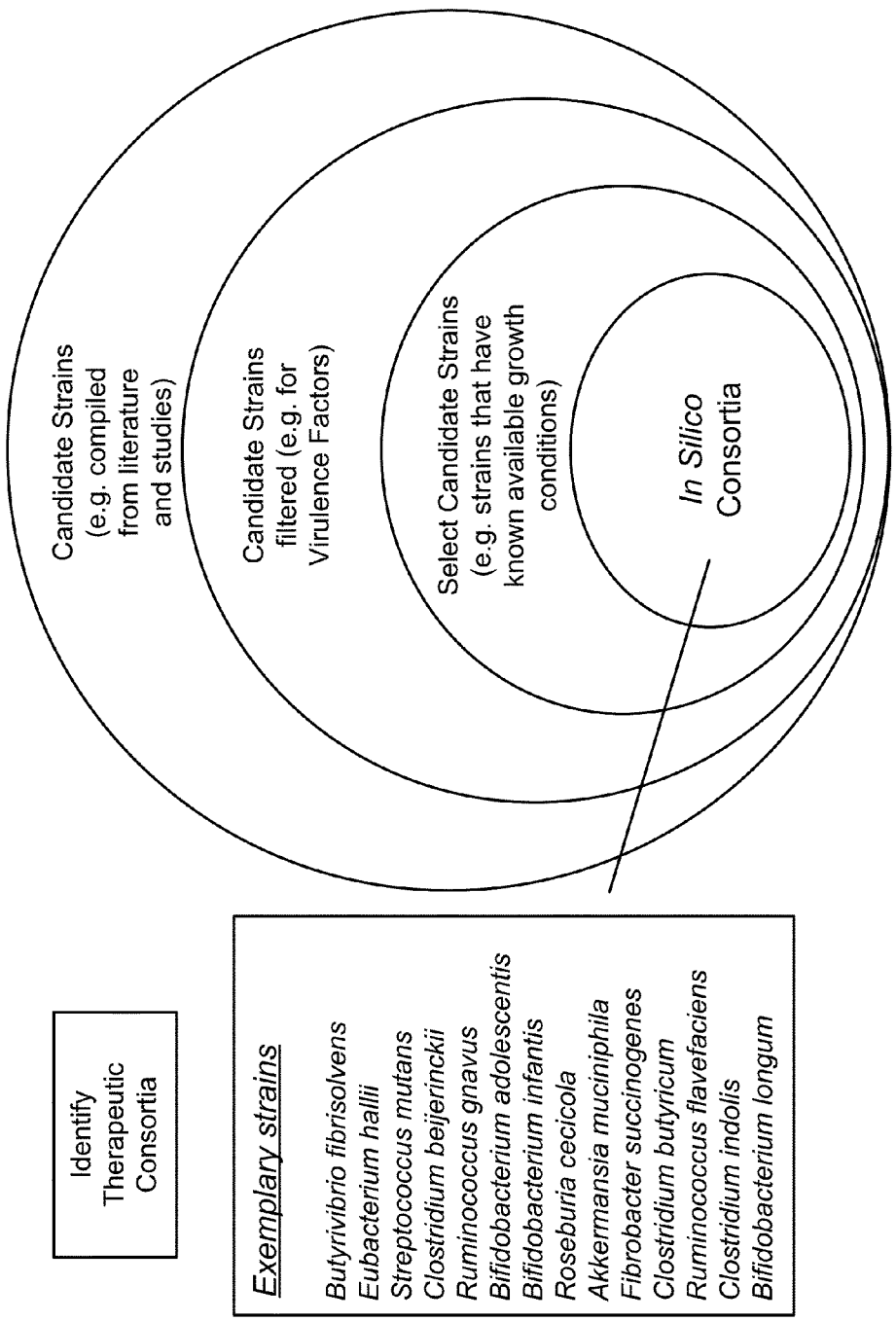
FIG. 6 depicts an exemplary process used to identify strains related to T2DM (e.g. to identify a therapeutic consortia). Exemplary T2DM strains found using this method include: *Butyrivibrio fibrisolvens, Streptococcus*

FIG. 6 depicts an exemplary method to identify microorganism strains to be used in the treatment of T2DM. A multi-tiered approach can be used to identify one or more microorganism strains for use as a therapeutic. Candidate strains can be found in scientific literature and studies. Candidate strains can be found by analyzing healthy and unhealthy hosts. Candidate strains can be filtered and/or selected for the ability to be administered to a patient (e.g. biosafety level, availability to be manufactured, growth conditions). Finally, an in silico consortia can be determined.

In some embodiments, the prebiotic and probiotic consortia are chosen to create an entirely self-sufficient system that does not require any external input. For example, a subject with T2DM can be treated with a combination of SCFA-producing probiotics and prebiotics comprising dietary fiber and other agents required for the activity of the SCFA-producing probiotics. In this manner, the prebiotic and probiotic form a self-sufficient system, wherein the probiotic converts the prebiotic dietary fiber to SCFAs (butyrate, acetate, propionate), which can trigger downstream signaling for controlling obesity, diabetes and promote weigh loss in the subject.

Also provided are methods to generate probiotics against a subject's microbiome composition. The microbiome composition can have an effect on the subject's disease status and clinical treatment response. Compositions of the disclosure can be tailored to suit the microbiome composition of a subject for effective treatment of symptoms associated with a health condition. For example, therapeutic formulations for obese individuals can differ from therapeutic formulations for non-obese individuals for the treatment of a specific disorder based on differences in their microbiota.

In some embodiments, methods for achieving weight loss by targeting rebalancing of the gut microbiome comprise: using specific probiotic strains, using appropriate prebiotics, diet recommendation, and periodic monitoring. For example, the weight loss methods can comprise replacing prevotellas (a group within the Bacteroidetes phylum) and selenomonas from the microbiomes of overweight subjects with native probiotic strains from a healthy subject. Prebiotics can comprise dietary fiber and agents required for sustenance of the native probiotics.

Also provided are methods of formulating prebiotics and/or probiotic combinations to treat health conditions. A composition comprising prebiotics and/or probiotics can prevent, for example, gastrointestinal infections through production of antimicrobial factors, stimulation of the host immune system, and/or competition with pathogens for nutrients or host binding sites. A combination of probiotics and prebiotics can provide a complete system for producing amino acids, polyphenols, vitamins, and other compounds of nutritive value in a subject.

Microbe Compositions

In one aspect of the invention, a strain consortia comprising one or more microorganisms selected from the group consisting of: *Akkermansia muciniphila, Anaerostipes caccae, Bifidobacterium adolescentis, Bifidobacterium bifidum, Bifidobacterium infantis, Bifidobacterium longum, Butyrivibrio fibrisolvens, Clostridium acetobutylicum, Clostridium aminophilum, Clostridium beijerinckii, Clostridium butyricum, Clostridium colinum, Clostridium indolis, Clostridium orbiscindens, Enterococcus faecium, Eubacterium hallii, Eubacterium rectale, Faecalibacterium prausnitzii, Fibrobacter succinogenes, Lactobacillus acidophilus, Lactobacillus brevis, Lactobacillus bulgaricus, Lactobacillus casei, Lactobacillus caucasicus, Lactobacillus fermentum, Lactobacillus helveticus, Lactobacillus lactis, Lactobacillus plantarum, Lactobacillus reuteri, Lactobacillus rhamnosus, Oscillospira guilliermondii, Roseburia cecicola, Roseburia inulinivorans, Ruminococcus flavefaciens, Ruminococcus gnavus, Ruminococcus obeum, Streptococcus cremoris, Streptococcus faecium, Streptococcus infantis, Streptococcus mutans, Streptococcus thermophilus, Anaerofustis stercorihominis, Anaerostipes hadrus, Anaerotruncus colihominis, Clostridium sporogenes, Clostridium tetani, Coprococcus, Coprococcus eutactus, Eubacterium cylindroides, Eubacterium dolichum, Eubacterium ventriosum, Roseburia faeccis, Roseburia hominis, Roseburia intestinalis*, and any combination thereof, can be used to treat a metabolic disorder such as obesity or T2DM.

A therapeutic consortium can comprise one or more microorganisms selected from the group consisting of: *Akkermansia muciniphila, Anaerostipes caccae, Bifidobacterium adolescentis, Bifidobacterium bifidum, Bifidobacterium infantis, Bifidobacterium longum, Butyrivibrio fibrisolvens, Clostridium acetobutylicum, Clostridium aminophilum, Clostridium beijerinckii, Clostridium butyricum, Clostridium colinum, Clostridium indolis, Clostridium orbiscindens, Enterococcus faecium, Eubacterium hallii, Eubacterium rectale, Faecalibacterium prausnitzii, Fibrobacter succinogenes, Lactobacillus acidophilus, Lactobacillus brevis, Lactobacillus bulgaricus, Lactobacillus casei, Lactobacillus caucasicus, Lactobacillus fermentum, Lactobacillus helveticus, Lactobacillus lactis, Lactobacillus plantarum, Lactobacillus reuteri, Lactobacillus rhamnosus, Oscillospira guilliermondii, Roseburia cecicola, Roseburia inulinivorans, Ruminococcus flavefaciens, Ruminococcus gnavus, Ruminococcus obeum, Streptococcus cremoris, Streptococcus faecium, Streptococcus infantis, Streptococ-*

*cus mutans, Streptococcus thermophilus, Anaerofustis stercorihominis, Anaerostipes hadrus, Anaerotruncus colihominis, Clostridium sporogenes, Clostridium tetani, Coprococcus, Coprococcus eutactus, Eubacterium cylindroides, Eubacterium dolichum, Eubacterium ventriosum, Roseburia faeccis, Roseburia hominis, Roseburia intestinalis*, and any combination thereof.

In one aspect of the invention, microbe compositions comprising one or more microorganisms selected from the group consisting of: *Akkermansia muciniphila, Anaerostipes caccae, Bifidobacterium adolescentis, Bifidobacterium bifidum, Bifidobacterium infantis, Bifidobacterium longum, Butyrivibrio fibrisolvens, Clostridium acetobutylicum, Clostridium aminophilum, Clostridium beijerinckii, Clostridium butyricum, Clostridium colinum, Clostridium indolis, Clostridium orbiscindens, Enterococcus faecium, Eubacterium hallii, Eubacterium rectale, Faecalibacterium prausnitzii, Fibrobacter succinogenes, Lactobacillus acidophilus, Lactobacillus brevis, Lactobacillus bulgaricus, Lactobacillus casei, Lactobacillus caucasicus, Lactobacillus fermentum, Lactobacillus helveticus, Lactobacillus lactis, Lactobacillus plantarum, Lactobacillus reuteri, Lactobacillus rhamnosus, Oscillospira guilliermondii, Roseburia cecicola, Roseburia inulinivorans, Ruminococcus flavefaciens, Ruminococcus gnavus, Ruminococcus obeum, Streptococcus cremoris, Streptococcus faecium, Streptococcus infantis, Streptococcus mutans, Streptococcus thermophilus, Anaerofustis stercorihominis, Anaerostipes hadrus, Anaerotruncus colihominis, Clostridium sporogenes, Clostridium tetani, Coprococcus, Coprococcus eutactus, Eubacterium cylindroides, Eubacterium dolichum, Eubacterium ventriosum, Roseburia faeccis, Roseburia hominis, Roseburia intestinalis*, and any combination thereof, can be used to treat a metabolic disorder such as obesity or T2DM.

In some embodiments, provided are therapeutic compositions to treat a metabolic disorder comprising a purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of a microorganism selected from the group consisting of: *Akkermansia muciniphila, Anaerostipes caccae, Bifidobacterium adolescentis, Bifidobacterium bifidum, Bifidobacterium infantis, Bifidobacterium longum, Butyrivibrio fibrisolvens, Clostridium acetobutylicum, Clostridium aminophilum, Clostridium beijerinckii, Clostridium butyricum, Clostridium colinum, Clostridium indolis, Clostridium orbiscindens, Enterococcus faecium, Eubacterium hallii, Eubacterium rectale, Faecalibacterium prausnitzii, Fibrobacter succinogenes, Lactobacillus acidophilus, Lactobacillus brevis, Lactobacillus bulgaricus, Lactobacillus casei, Lactobacillus caucasicus, Lactobacillus fermentum, Lactobacillus helveticus, Lactobacillus lactis, Lactobacillus plantarum, Lactobacillus reuteri, Lactobacillus rhamnosus, Oscillospira guilliermondii, Roseburia cecicola, Roseburia inulinivorans, Ruminococcus flavefaciens, Ruminococcus gnavus, Ruminococcus obeum, Streptococcus cremoris, Streptococcus faecium, Streptococcus infantis, Streptococcus mutans, Streptococcus thermophilus, Anaerofustis stercorihominis, Anaerostipes hadrus, Anaerotruncus colihominis, Clostridium sporogenes, Clostridium tetani, Coprococcus, Coprococcus eutactus, Eubacterium cylindroides, Eubacterium dolichum, Eubacterium ventriosum, Roseburia faeccis, Roseburia hominis, Roseburia intestinalis*, and any combination thereof.

In some embodiments, provided are therapeutic compositions to treat a metabolic disorder comprising an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of a microorganism selected from the group consisting of: *Akkermansia muciniphila, Bifidobacterium adolescentis, Bifidobacterium infantis, Bifidobacterium longum, Clostridium beijerinckii, Clostridium butyricum, Clostridium indolis, Eubacterium hallii*, and any combination thereof.

In some embodiments, provided are therapeutic compositions to treat a metabolic disorder comprising an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of a microorganism selected from the group consisting of: *Akkermansia muciniphila, Bifidobacterium adolescentis, Bifidobacterium infantis, Bifidobacterium longum, Clostridium beijerinckii, Clostridium butyricum, Clostridium indolis, Eubacterium hallii, Faecalibacterium prausnitzii*, and any combination thereof.

In some embodiments, provided are therapeutic compositions to treat a metabolic disorder comprising an isolated and/or purified microorganism population comprising bacteria selected from the group consisting of: *Akkermansia muciniphila, Bifidobacterium adolescentis, Bifidobacterium infantis, Bifidobacterium longum, Clostridium beijerinckii, Clostridium butyricum, Clostridium indolis, Eubacterium hallii*, and any combination thereof.

In some embodiments, provided are therapeutic compositions to treat a metabolic disorder comprising an isolated and/or purified microorganism population comprising bacteria selected from the group consisting of: *Akkermansia muciniphila, Bifidobacterium adolescentis, Bifidobacterium infantis, Bifidobacterium longum, Clostridium beijerinckii, Clostridium butyricum, Clostridium indolis, Eubacterium hallii, Faecalibacterium prausnitzii*, and any combination thereof.

In some embodiments, a therapeutic consortium comprises *Akkermansia muciniphila, Bifidobacterium adolescentis, Bifidobacterium infantis, Bifidobacterium longum, Clostridium beijerinckii, Clostridium butyricum, Clostridium indolis*, and *Eubacterium hallii*.

In some embodiments, a therapeutic consortium comprises *Akkermansia muciniphila, Bifidobacterium adolescentis, Bifidobacterium infantis, Bifidobacterium longum, Clostridium beijerinckii, Clostridium butyricum, Clostridium indolis, Eubacterium hallii*, and *Faecalibacterium prausnitzii*.

In some embodiments, a therapeutic consortium consists essentially of *Akkermansia muciniphila, Bifidobacterium adolescentis, Bifidobacterium infantis, Bifidobacterium longum, Clostridium beijerinckii, Clostridium butyricum, Clostridium indolis*, and *Eubacterium hallii*.

In some embodiments, a therapeutic consortium consists essentially of *Akkermansia muciniphila, Bifidobacterium adolescentis, Bifidobacterium infantis, Bifidobacterium longum, Clostridium beijerinckii, Clostridium butyricum, Clostridium indolis, Eubacterium hallii*, and *Faecalibacterium prausnitzii*.

In one embodiment, a therapeutic composition to treat a metabolic disorder comprises an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of *Akkermansia muciniphila*.

In one embodiment, a therapeutic composition to treat a metabolic disorder comprises an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of *Anaerostipes caccae*.

In one embodiment, a therapeutic composition comprises an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of *Bifidobacterium adolescentis*.

In one embodiment, a therapeutic composition comprises an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of *Bifidobacterium bifidum*.

In one embodiment, a therapeutic composition comprises an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of *Bifidobacterium infantis*.

In one embodiment, a therapeutic composition comprises an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of *Bifidobacterium longum*.

In one embodiment, a therapeutic composition comprises an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of *Butyrivibrio fibrisolvens*.

In one embodiment, a therapeutic composition comprises an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of *Clostridium acetobutylicum*.

In one embodiment, a therapeutic composition comprises an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of *Clostridium aminophilum*.

In one embodiment, a therapeutic composition comprises an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of *Clostridium beijerinckii*.

In one embodiment, a therapeutic composition comprises an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of *Clostridium butyricum*.

In one embodiment, a therapeutic composition comprises an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of *Clostridium colinum*.

In one embodiment, a therapeutic composition comprises an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of *Clostridium indolis*.

In one embodiment, a therapeutic composition comprises an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of *Clostridium orbiscindens*.

In one embodiment, a therapeutic composition comprises an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of *Enterococcus faecium*.

In one embodiment, a therapeutic composition comprises an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of *Eubacterium hallii*.

In one embodiment, a therapeutic composition comprises an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of *Eubacterium rectale*.

In one embodiment, a therapeutic composition comprises an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of *Faecalibacterium prausnitzii*.

In one embodiment, a therapeutic composition comprises an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of *Fibrobacter succinogenes*.

In one embodiment, a therapeutic composition comprises an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of *Lactobacillus acidophilus*.

In one embodiment, a therapeutic composition comprises an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of *Lactobacillus brevis*.

In one embodiment, a therapeutic composition comprises an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of *Lactobacillus bulgaricus*.

In one embodiment, a therapeutic composition comprises an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of *Lactobacillus casei*.

In one embodiment, a therapeutic composition comprises an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of *Lactobacillus caucasicus*.

In one embodiment, a therapeutic composition comprises an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of *Lactobacillus fermentum*.

In one embodiment, a therapeutic composition comprises an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of *Lactobacillus helveticus*.

In one embodiment, a therapeutic composition comprises an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of *Lactobacillus lactis*.

In one embodiment, a therapeutic composition comprises an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of *Lactobacillus plantarum*.

In one embodiment, a therapeutic composition comprises an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of *Lactobacillus reuteri*.

In one embodiment, a therapeutic composition comprises an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of *Lactobacillus rhamnosus*.

In one embodiment, a therapeutic composition comprises an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of *Oscillospira guilliermondii*.

In one embodiment, a therapeutic composition comprises an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of *Roseburia cecicola*.

In one embodiment, a therapeutic composition comprises an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of *Roseburia inulinivorans*.

In one embodiment, a therapeutic composition comprises an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of *Ruminococcus flavefaciens*.

In one embodiment, a therapeutic composition comprises an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of *Ruminococcus gnavus*.

In one embodiment, a therapeutic composition comprises an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of *Ruminococcus obeum*.

In one embodiment, a therapeutic composition comprises an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of *Streptococcus cremoris*.

In one embodiment, a therapeutic composition comprises an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA *Streptococcus faecium*.

In one embodiment, a therapeutic composition comprises an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of *Streptococcus infantis*.

In one embodiment, a therapeutic composition comprises an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of *Streptococcus mutans*.

In one embodiment, a therapeutic composition comprises an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of *Streptococcus thermophilus*.

In one embodiment, a therapeutic composition comprises an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of *Anaerofustis stercorihominis*.

In one embodiment, a therapeutic composition comprises an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of *Anaerostipes hadrus*.

In one embodiment, a therapeutic composition comprises an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of *Anaerotruncus colihominis*.

In one embodiment, a therapeutic composition comprises an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of *Clostridium sporogenes*.

In one embodiment, a therapeutic composition comprises an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of *Clostridium sporogenes*.

In one embodiment, a therapeutic composition comprises an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of *Clostridium tetani*.

In one embodiment, a therapeutic composition comprises an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of *Clostridium tetani*.

In one embodiment, a therapeutic composition comprises an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of *Coprococcus*.

In one embodiment, a therapeutic composition comprises an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of *Coprococcus eutactus*.

In one embodiment, a therapeutic composition comprises an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of *Eubacterium cylindroides*.

In one embodiment, a therapeutic composition comprises an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of *Eubacterium dolichum*.

In one embodiment, a therapeutic composition comprises an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of *Eubacterium ventriosum*.

In one embodiment, a therapeutic composition comprises an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of *Roseburia faeccis*.

In one embodiment, a therapeutic composition comprises an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of *Roseburia hominis*.

In one embodiment, a therapeutic composition comprises an isolated and/or purified microorganism population consisting of bacteria with at least about: 70%, 75%, 80%, 85%, 87%, 90%, 91%, 92%, 93%, 94%, 95%, 96%, 97%, 98%, 99%, 99.5%, or 100% sequence identity to the 16SrRNA and/or 23S rRNA of *Roseburia intestinalis*.

A therapeutic composition may comprise at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25, at least 26, at least 27, at least 28, at least 29, at least 30, at least 31, at least 32, at least 33, at least 34, at least 35, at least 36, at least 37, at least 38, at least 39, at least 40, at least 45, or at least 50, or at least 75, or at least 100 types of bacteria. A therapeutic composition may comprise at most 1, at most 2, at most 3, at most 4, at most 5, at most 6, at most 7, at most 8, at most 9, at most 10, at most 11, at most 12, at most 13, at most 14, at most 15, at most 16, at most 17, at most 18, at most 19, at most 20, at most 21, at most 22, at most 23, at most 24, at most 25, at most 26, at most 27, at most 28, at most 29, at most 30, at most 31, at most 32, at most 33, at most 34, at most 35, at most 36, at most 37, at most 38, at most 39, at most 40, at most 45, or at most 50, or at most 75, or at most 100 types of bacteria.

In some embodiments, combining one or more microbes in a therapeutic composition or consortia increases or maintains the stability of the microbes in the composition compared with the stability of the microbes alone as illustrated in FIG. 9. A therapeutic consortium of microbes can provide a synergistic stability compared with the individual strains.

In some embodiments, combining one or more microbes in a therapeutic composition or consortia can provide a synergistic effect when administered to the individual. For example, administration of a first microbe may be beneficial to a subject and administration of a second microbe may be beneficial to a subject but when the two microbes are administered together to a subject, the benefit is greater than the either benefit alone.

Different types of microbes in a therapeutic composition can be present in the same amount or in different amounts. For example, the ratio of two bacteria in a therapeutic composition can be about 1:1, 1:2, 1:5, 1:10, 1:25, 1:50, 1:100, 1:1000, 1:10,000, or 1:100,000.

In some embodiments, a therapeutic composition comprises at least one primary fermenter and at least one secondary fermenter. In some embodiments, a therapeutic composition comprises at least one primary fermenter, at least one secondary fermenter, and at least one prebiotic. In one example, a therapeutic composition can comprise *Clostridium indolis*, *Bifidobacterium adolescentis*, and inulin. In another example, a therapeutic composition can comprise *Faecalibacterium prausnitzii*, *Bifidobacterium longum*, and starch.

Microorganisms of the invention can be produced in any suitable medium for growth, some non-limiting examples include: RCM, GYT veg, BHI, PYGveg, nutrient media, minimal media, selective media, differential media, and transport media. The growth medium can comprise a trace mineral. The growth medium can comprise a salt. The growth medium can comprise a vitamin. The growth medium can comprise a buffer. The pH of a growth medium can be, for example, about 7. The pH of a growth medium can be, for example, about 3, about, 4, about, 5, about 6, about 7, or about 8. The growth medium can improve the maximum density a microbial strain can grow to. The growth medium can allow for higher strain concentrations. The growth medium can buffer acid production by a microbial strain, which can minimize the inhibitory effect of, for example, very low pH.

Table 1 shows trace minerals that can be added to a growth media:

TABLE 1

Trace minerals

| Trace minerals component | mg/L medium |
|---|---|
| $CoCl_2$ | 0.65 |
| $CuCl_2*2H_2O$ | 0.03 |
| $H_3BO_3$ | 3.52 |
| $FeSO_4*7H_2O$ | 1.50 |
| $MnCl_2*4H_2O$ | 0.26 |
| $Na_2EDTA$ | 25.01 |
| $Na_2MoO_4*2H_2O$ | 0.80 |
| $Na_2SeO_3$ | 0.39 |
| $NiCl_2$ | 0.65 |
| $ZnSO_4*7H_2O$ | 0.29 |

Table 2 shows vitamins that can be added to a growth media. The concentrations shown in Table 2 can be final concentrations in the growth media.

TABLE 2

Vitamin solution.

| Vitamin Solution component | mg/L medium |
|---|---|
| D-biotin | 0.2 |
| Ca-pantothenate | 2.5 |
| myoinositol | 20 |
| p-aminobenzoic acid | 0.5 |
| pyridoxine hydrochloride | 5 |
| riboflavine | 0.5 |
| thiamine dichloride | 10 |
| vitamin B12 | 0.2 |
| nicotinic acid | 5 |

Table 3 shows an illustrative growth medium:

TABLE 3

Illustrative growth medium recipe

| GYTveg broth (per liter): Component | Amount |
|---|---|
| Glucose | 10 g |
| HiVeg Hydrolysate | 5 g |
| Yeast Extract | 10 g |
| Na-thioglycolate | 0.5 g |
| Resazurin | 80 μl (of 14 g/l stock) |
| Vitamin solution | 10 ml |
| Agar (for solid medium) | 18 g |

Table 4 shows an illustrative growth medium.

TABLE 4

Illustrative growth medium recipe

| GYTveg + $CaCO_3$ (per liter): Component | Amount |
|---|---|
| Glucose | 10 g |
| HiVeg Hydrolysate | 5 g |
| Yeast Extract | 10 g |
| Na-thioglycolate | 0.5 g |
| Resazurin | 80 μl (of 14 g/l stock) |
| Vitamin solution | 10 ml |
| $CaCO_3$ | 20 g |
| Agar (for solid medium) | 18 g |

Table 5 shows an illustrative growth medium.

TABLE 5

Illustrative growth medium recipe

| PYGveg Component | Amount per liter |
|---|---|
| Glucose | 5 g |
| $K_2HPO_4$ | 2 g |
| Tween 80 | 1 ml |
| Cystein-HCl | 0.5 g |
| Yeast extract | 10 g |
| HiVeg Extract | 5 g |
| HiVeg Peptone #1 | 5 g |
| HiVeg Peptone #3 | 5 g |
| Vitamin Mix 100x | 10 ml |
| Salt solution | 40 ml |

Table 6 shows illustrative salts that can be added to a growth medium. The concentrations shown in Table 6 can be final concentrations in the growth medium.

TABLE 6

Salt solution

| Salt solution Component | grams per liter |
|---|---|
| $CaCl_2\ 2H_2O$ | 0.02 |
| $MgSO_4\ 7H_2O$ | 0.02 |
| $K_2HPO_4$ | 0.04 |
| $KH_2PO_4$ | 0.04 |
| $NaHCO_3$ | 0.4 |
| NaCl | 0.08 |

In some embodiments, the growth medium comprises PYGveg (e.g., Table 5), vitamins (e.g., Table 2), salt (e.g., Table 6), and a buffer.

Pharmaceutical Formulations

Provided herein are compositions that may be administered as therapeutics and/or cosmetics. One or more microorganisms described herein can be used to create a pharmaceutical formulation comprising an effective amount of the composition for treating a subject. The microorganisms can be in any formulation known in the art. Some non-limiting examples can include topical, capsule, pill, enema, liquid, injection, and the like. In some embodiments, the one or more strains disclosed herein may be included in a food or beverage product, cosmetic, or nutritional supplement.

The formulation can include one or more active ingredients. Active ingredients can be selected from the group consisting of: antibiotics, prebiotics, probiotics, glycans (e.g., as decoys that would limit specific bacterial/viral binding to the intestinal wall), bacteriophages, microorganisms and the like.

In some embodiments, the formulation comprises a prebiotic. In some embodiments, the prebiotic is inulin. The inulin can serve as an energy source for the microbial formulation.

A formulation can be administered by a suitable method for delivery to any part of the gastrointestinal tract of a subject including oral cavity, mouth, esophagus, stomach, duodenum, small intestine regions including duodenum, jejunum, ileum, and large intestine regions including cecum, colon, rectum, and anal canal. In some embodiments, the composition is formulated for delivery to the ileum and/or colon regions of the gastrointestinal tract.

In some embodiments, administration of a formulation occurs orally, for example, through a capsule, pill, powder, tablet, gel, or liquid, designed to release the composition in the gastrointestinal tract. In some embodiments, administration of a formulation occurs by injection, for example, for a formulation comprising butyrate, propionate, acetate, and short-chain fatty acids. In some embodiments, the administration of a formulation occurs by application to the skin, for example, cream, liquid, or patch. In some embodiments, administration of a formulation occurs by a suppository and/or by enema. In some embodiments, a combination of administration routes is utilized.

Microbial compositions can be formulated as a dietary supplement. Microbial compositions can be incorporated with vitamin supplements. Microbial compositions can be formulated in a chewable form such as a probiotic gummy Microbial compositions can be incorporated into a form of food and/or drink. Non-limiting examples of food and drinks where the microbial compositions can be incorporated include, for example, bars, shakes, juices, infant formula, beverages, frozen food products, fermented food products, and cultured dairy products such as yogurt, yogurt drink, cheese, *acidophilus* drinks, and kefir.

A formulation of the disclosure can be administered as part of a fecal transplant process. A formulation can be administered to a subject by a tube, for example, nasogastric tube, nasojejunal tube, nasoduodenal tube, oral gastric tube, oral jejunal tube, or oral duodenal tube. A formulation can be administered to a subject by colonoscopy, endoscopy, sigmoidoscopy, and/or enema.

In some embodiments, the microbial composition is formulated such that the one or more microbes can replicate once they are delivered to the target habitat (e.g. the gut). In one non-limiting example, the microbial composition is formulated in a pill, such that the pill has a shelf life of at least 1, 2, 3, 4, 5, 6, 7, 8, 9, 10, 11, or 12 months. In another non-limiting example, the storage of the microbial composition is formulated so that the microbes can reproduce once they are in the gut. In some embodiments, other components may be added to aid in the shelf life of the microbial composition. In some embodiments, one or more microbes may be formulated in a manner that it is able to survive in a non-natural environment. For example, a microbe that is native to the gut may not survive in an oxygen-rich environment. To overcome this limitation, the microbe may be formulated in a pill that can reduce or eliminate the exposure to oxygen. Other strategies to enhance the shelf-life of microbes may include other microbes (e.g. if the bacterial consortia comprises a composition whereby one or more strains is helpful for the survival of one or more strains).

In some embodiments, a microbial composition is lyophilized (e.g., freeze-dried) and formulated as a powder, tablet, enteric-coated capsule (e.g. for delivery to ileum/colon), or pill that can be administered to a subject by any suitable route. The lyophilized formulation can be mixed with a saline or other solution prior to administration.

In some embodiments, a microbial composition is formulated for oral administration, for example, as an enteric-coated capsule or pill, for delivery of the contents of the formulation to the ileum and/or colon regions of a subject.

In some embodiments, the microbial composition is formulated for oral administration. In some embodiments, the microbial composition is formulated as an enteric-coated pill or capsule for oral administration. In some embodiments, the microbial composition is formulated for delivery of the microbes to the ileum region of a subject. In some embodiments, the microbial composition is formulated for delivery of the microbes to the colon region (e.g. upper colon) of a subject. In some embodiments, the microbial composition is formulated for delivery of the microbes to the ileum and colon regions of a subject.

An enteric-coating can protect the contents of the oral formulation, for example, pill or capsule, from the acidity of the stomach and provide delivery to the ileum and/or upper colon regions. Non-limiting examples of enteric coatings include pH sensitive polymers (e.g., eudragit FS30D), methyl acrylate-methacrylic acid copolymers, cellulose acetate succinate, hydroxy propyl methyl cellulose phthalate, hydroxy propyl methyl cellulose acetate succinate (e.g., hypromellose acetate succinate), polyvinyl acetate phthalate (PVAP), methyl methacrylate-methacrylic acid copolymers, shellac, cellulose acetate trimellitate, sodium alginate, zein, other polymers, fatty acids, waxes, shellac, plastics, and plant fibers. In some embodiments, the enteric coating is formed by a pH sensitive polymer. In some embodiments, the enteric coating is formed by eudragit FS30D.

The enteric coating can be designed to dissolve at any suitable pH. In some embodiments, the enteric coating is designed to dissolve at a pH greater than about pH 6.5 to about pH 7.0. In some embodiments, the enteric coating is designed to dissolve at a pH greater than about pH 6.5. In some embodiments, the enteric coating is designed to dissolve at a pH greater than about pH 7.0. The enteric coating can be designed to dissolve at a pH greater than about: 5, 5.1, 5.2, 5.3, 5.4, 5.5, 5.6, 5.7, 5.8, 5.9, 6, 6.1, 6.2, 6.3, 6.4, 6.5, 6.6, 6.7, 6.8, 6.9, 7, 7.1, 7.2, 7.3, 7.4, or 7.5 pH units.

In some embodiments, the administration of a formulation of the disclosure can be preceded by, for example, colon cleansing methods such as colon irrigation/hydrotherapy, enema, administration of laxatives, dietary supplements, dietary fiber, enzymes, and magnesium.

In some embodiments, the microbes are formulated as a population of spores. Spore-containing formulations can be administered by any suitable route described herein. Orally administered spore-containing formulations can survive the low pH environment of the stomach. The amount of spores employed can be, for example, from about 1% w/w to about 99% w/w of the entire formulation.

Formulations provided herein can include the addition of one or more agents to the therapeutics or cosmetics in order to enhance stability and/or survival of the microbial formulation. Non-limiting example of stabilizing agents include genetic elements, glycerin, ascorbic acid, skim milk, lactose, tween, alginate, xanthan gum, carrageenan gum, mannitol, palm oil, and poly-L-lysine (POPL).

In some embodiments, a formulation comprises one or more recombinant microbes or microbes that have been genetically modified. In other embodiments, one or more microbes are not modified or recombinant. In some embodiments, the formulation comprises microbes that can be regulated, for example, a microbe comprising an operon or promoter to control microbial growth. Microbes of the invention can be produced, grown, or modified using any suitable methods, including recombinant methods.

A formulation can be customized for a subject. A custom formulation can comprise, for example, a prebiotic, a probiotic, an antibiotic, or a combination of active agents described herein. Data specific to the subject comprising for example age, gender, and weight can be combined with an analysis result to provide a therapeutic agent customized to the subject. For example, a subject's microbiome found to be low in a specific microbe relative to a sub-population of healthy subjects matched for age and gender can be provided with a therapeutic and/or cosmetic formulation comprising the specific microbe to match that of the sub-population of healthy subjects having the same age and gender as the subject.

In some embodiments, a formulation is administered before, during, and/or after treatment with an antimicrobial agent such as an antibiotic. For example, the formulation can be administered at least about 1 hour, 2 hours, 5 hours, 12 hours, 1 day, 3 days, 1 week, 2 weeks, 1 month, 6 months, or 1 year before and/or after treatment with an antibiotic. The formulation can be administered at most 1 hour, 2 hours, 5 hours, 12 hours, 1 day, 3 days, 1 week, 2 weeks, 1 month, 6 months, or 1 year before and/or after treatment with an antibiotic.

In some embodiments, the formulation is administered after treatment with an antibiotic. For example, the formulation can be administered after the entire antibiotic regimen or course is complete.

In some embodiments, a formulation is administered before, during, and/or after food intake by a subject. In some embodiments, the formulation is administered with food intake by the subject. In some embodiments, the formulation is administered with (e.g., simultaneously) with food intake.

In some embodiments, the formulation is administered before food intake by a subject. In some embodiments, the formulation is more effective or potent at treating a microbial condition when administered before food intake. For example, the formulation can be administered about 1 minute, about 2 minutes, about 3 minutes, about 5 minutes, about 10 minutes, about 15 minutes, about 30 minutes, about 45 minutes, about 1 hour, about 2 hours, about 3 hours, about 4 hours, about 5 hours, about 6 hours, about 7 hours, about 8 hours, about 9 hours, about 10 hours, about 12 hours, or about 1 day before food intake by a subject. For example, the formulation can be administered at least about 1 minute, about 2 minutes, about 3 minutes, about 5 minutes, about 10 minutes, about 15 minutes, about 30 minutes, about 45 minutes, about 1 hour, about 2 hours, about 3 hours, about 4 hours, about 5 hours, about 6 hours, about 7 hours, about 8 hours, about 9 hours, about 10 hours, about 12 hours, or about 1 day before food intake by a subject. For example, the formulation can be administered at most about 1 minute, about 2 minutes, about 3 minutes, about 5 minutes, about 10 minutes, about 15 minutes, about 30 minutes, about 45 minutes, about 1 hour, about 2 hours, about 3 hours, about 4 hours, about 5 hours, about 6 hours, about 7 hours, about 8 hours, about 9 hours, about 10 hours, about 12 hours, or about 1 day before food intake by a subject.

In some embodiments, the formulation is administered after food intake by the subject. In some embodiments, the formulation is more effective or potent at treating a microbial condition when administered after food intake. For example, the formulation can be administered at least about 1 minute, 2 minutes, 3 minutes, 5 minutes, 10 minutes, 15 minutes, 30 minutes, 45 minutes, 1 hour, 2 hours, 3 hours, 5 hours, 10 hours, 12 hours, or 1 day after food intake by a subject. For example, the formulation can be administered at most about 1 minute, 2 minutes, 3 minutes, 5 minutes, 10 minutes, 15 minutes, 30 minutes, 45 minutes, 1 hour, 2 hours, 3 hours, 5 hours, 10 hours, 12 hours, or 1 day after food intake by a subject.

Formulations provided herein can include those suitable for oral including buccal and sub-lingual, intranasal, topical, transdermal, transdermal patch, pulmonary, vaginal, rectal, suppository, mucosal, systemic, or parenteral including intramuscular, intraarterial, intrathecal, intradermal, intraperitoneal, subcutaneous, and intravenous administration or in a form suitable for administration by aerosolization, inhalation or insufflation.

A therapeutic or cosmetic composition can include carriers and excipients (including but not limited to buffers, carbohydrates, lipids, mannitol, proteins, polypeptides or amino acids such as glycine, antioxidants, bacteriostats, chelating agents, suspending agents, thickening agents and/or preservatives), metals (e.g., iron, calcium), salts, vitamins, minerals, water, oils including those of petroleum, animal, vegetable or synthetic origin, such as peanut oil, soybean oil, mineral oil, sesame oil and the like, saline solutions, aqueous dextrose and glycerol solutions, flavoring agents, coloring agents, detackifiers and other acceptable additives, adjuvants, or binders, other pharmaceutically acceptable auxiliary substances as required to approximate physiological conditions, such as pH buffering agents, tonicity adjusting agents, emulsifying agents, wetting agents and the like. Examples of excipients include starch, glucose, lactose, sucrose, gelatin, malt, rice, flour, chalk, silica gel, sodium stearate, glycerol monostearate, talc, sodium chloride, dried skim milk, glycerol, propylene, glycol, water, ethanol and the like.

Non-limiting examples of pharmaceutically-acceptable excipients suitable for use in the disclosure include granulating agents, binding agents, lubricating agents, disintegrating agents, sweetening agents, glidants, anti-adherents, anti-static agents, surfactants, antioxidants, gums, coating agents, coloring agents, flavouring agents, dispersion enhancer, disintegrant, coating agents, plasticizers, preservatives, suspending agents, emulsifying agents, plant cellulosic material and spheronization agents, and any combination thereof.

Non-limiting examples of pharmaceutically-acceptable excipients can be found, for example, in *Remington: The Science and Practice of Pharmacy*, Nineteenth Ed (Easton, Pa.: Mack Publishing Company, 1995); Hoover, John E., *Remington's Pharmaceutical Sciences*, Mack Publishing Co., Easton, Pa. 1975; Liberman, H. A. and Lachman, L., Eds., *Pharmaceutical Dosage Forms*, Marcel Decker, New York, N.Y., 1980; and *Pharmaceutical Dosage Forms and Drug Delivery Systems*, Seventh Ed. (Lippincott Williams & Wilkins 1999), each of which is incorporated by reference in its entirety.

A therapeutic or cosmetic composition can be substantially free of preservatives. In some applications, the composition may contain at least one preservative.

A therapeutic or cosmetic composition can be encapsulated within a suitable vehicle, for example, a liposome, a microspheres, or a microparticle. Microspheres formed of polymers or proteins can be tailored for passage through the gastrointestinal tract directly into the blood stream. Alternatively, the compound can be incorporated and the microspheres, or composite of microspheres, and implanted for slow release over a period of time ranging from days to months.

A therapeutic or cosmetic composition can be formulated as a sterile solution or suspension. The therapeutic or cosmetic compositions can be sterilized by conventional techniques or may be sterile filtered. The resulting aqueous solutions may be packaged for use as is, or lyophilized. The lyophilized preparation of the microbial composition can be packaged in a suitable form for oral administration, for example, capsule or pill.

The compositions can be administered topically and can be formulated into a variety of topically administrable compositions, such as solutions, suspensions, lotions, gels, pastes, medicated sticks, balms, creams, and ointments.

Such pharmaceutical compositions can contain solubilizers, stabilizers, tonicity enhancing agents, buffers and preservatives.

The compositions can also be formulated in rectal compositions such as enemas, rectal gels, rectal foams, rectal aerosols, suppositories, jelly suppositories, or retention enemas, containing conventional suppository bases such as cocoa butter or other glycerides, as well as synthetic polymers such as polyvinylpyrrolidone, PEG, and the like. In suppository forms of the compositions, a low-melting wax such as a mixture of fatty acid glycerides, optionally in combination with cocoa butter, can be used.

In practicing the methods of treatment or use provided herein, therapeutically-effective amounts of the microbial compositions described herein are administered in pharmaceutical compositions to a subject having a disease or condition to be treated. In some embodiments, the subject is a mammal such as a human A therapeutically-effective amount can vary widely depending on the severity of the disease, the age and relative health of the subject, potency of the formulation, and other factors. Subjects can be, for example, humans, elderly adults, adults, adolescents, pre-adolescents, children, toddlers, infants, or neonates. A subject can be a patient. A subject can be an individual enrolled in a clinical study. A subject can be a laboratory animal, for example, a mammal, or a rodent.

Pharmaceutical compositions can be formulated using one or more physiologically-acceptable carriers comprising excipients and auxiliaries, which facilitate processing of the microorganisms into preparations that can be used pharmaceutically. Formulation can be modified depending upon the route of administration chosen. Pharmaceutical compositions described herein can be manufactured in a conventional manner, for example, by means of conventional mixing, dissolving, granulating, vitrification, spray-drying, lyophilizing, dragee-making, levigating, encapsulating, entrapping, emulsifying or compression processes.

In some embodiments, the pharmaceutical composition is manufactured in a dry form, for example, by spray-drying or lyophilization. In some embodiments, the formulation is prepared as a liquid capsule to maintain the liquid form of the microbes.

Compositions provided herein can be stored at any suitable temperature. The formulation can be stored in cold storage, for example, at a temperature of about −80° C., about −20° C., about −4° C., or about 4° C. The storage temperature can be, for example, about 0° C., about 1° C., about 2° C., about 3° C., about 4° C., about 5° C., about 6° C., about 7° C., about 8° C., about 9° C., about 10° C., about 12° C., about 14° C., about 16° C., about 20° C., about 22° C., or about 25° C. In some embodiments, the storage temperature is between about 2° C. to about 8° C. Storage of microbial compositions at low temperatures, for example from about 2° C. to about 8° C., can keep the microbes alive and increase the efficiency of the composition, for example, when present in a liquid or gel formulation. Storage at freezing temperature, below 0° C., with a cryoprotectant can further extend stability.

The pH of the composition can range from about 3 to about 12. The pH of the composition can be, for example, from about 3 to about 4, from about 4 to about 5, from about 5 to about 6, from about 6 to about 7, from about 7 to about 8, from about 8 to about 9, from about 9 to about 10, from about 10 to about 11, or from about 11 to about 12 pH units. The pH of the composition can be, for example, about 3, about 4, about 5, about 6, about 7, about 8, about 9, about 10, about 11, or about 12 pH units. The pH of the composition can be, for example, at least 3, at least 4, at least 5, at least 6, at least 7, at least 8, at least 9, at least 10, at least 11 or at least 12 pH units. The pH of the composition can be, for example, at most 3, at most 4, at most 5, at most 6, at most 7, at most 8, at most 9, at most 10, at most 11, or at most 12 pH units. If the pH is outside the range desired by the formulator, the pH can be adjusted by using sufficient pharmaceutically-acceptable acids and bases. In some embodiments, the pH of the composition is between about 4 and about 6.

Pharmaceutical compositions containing microbes described herein can be administered for prophylactic and/or therapeutic treatments. In therapeutic applications, the compositions can be administered to a subject already suffering from a disease or condition, in an amount sufficient to cure or at least partially arrest the symptoms of the disease or condition, or to cure, heal, improve, or ameliorate the condition. Microbial compositions can also be administered to lessen a likelihood of developing, contracting, or worsening a condition. Amounts effective for this use can vary based on the severity and course of the disease or condition, previous therapy, the subject's health status, weight, and response to the drugs, and the judgment of the treating physician.

Multiple therapeutic agents can be administered in any order or simultaneously. If simultaneously, the multiple therapeutic agents can be provided in a single, unified form, or in multiple forms, for example, as multiple separate pills. The composition can be packed together or separately, in a single package or in a plurality of packages. One or all of the therapeutic agents can be given in multiple doses. If not simultaneous, the timing between the multiple doses may vary to as much as about a month.

Compositions described herein can be administered before, during, or after the occurrence of a disease or condition, and the timing of administering the composition can vary. For example, the microbial composition can be used as a prophylactic and can be administered continuously to subjects with a propensity to conditions or diseases in order to lessen a likelihood of the occurrence of the disease or condition. The microbial compositions can be administered to a subject during or as soon as possible after the onset of the symptoms. The administration of the microbial compositions can be initiated within the first 48 hours of the onset of the symptoms, within the first 24 hours of the onset of the symptoms, within the first 6 hours of the onset of the symptoms, or within 3 hours of the onset of the symptoms. The initial administration can be via any route practical, such as by any route described herein using any formulation described herein. A microbial composition can be administered as soon as is practicable after the onset of a disease or condition is detected or suspected, and for a length of time necessary for the treatment of the disease, such as, for example, from about 1 month to about 3 months. The length of treatment can vary for each subject.

Compositions of the invention can be administered in combination with another therapy, for example, immunotherapy, chemotherapy, radiotherapy, anti-inflammatory agents, anti-viral agents, anti-microbial agents, and anti-fungal agents.

Compositions of the invention can be packaged as a kit. In some embodiments, a kit includes written instructions on the administration/use of the composition. The written material can be, for example, a label. The written material can suggest conditions methods of administration. The instructions provide the subject and the supervising physician with the best guidance for achieving the optimal clinical outcome from the administration of the therapy. The written material can be a label. In some embodiments, the label can be approved by a regulatory agency, for example the U.S. Food and Drug Administration (FDA), the European Medicines Agency (EMA), or other regulatory agencies.

Dosing

The appropriate quantity of a therapeutic or cosmetic composition to be administered, the number of treatments, and unit dose can vary according to a subject and/or the disease state of the subject.

Pharmaceutical compositions described herein can be in unit dosage forms suitable for single administration of precise dosages. In unit dosage form, the formulation can be divided into unit doses containing appropriate quantities of one or more microbial compositions. The unit dosage can be in the form of a package containing discrete quantities of the formulation. Non-limiting examples are liquids in vials or ampoules. Aqueous suspension compositions can be packaged in single-dose non-reclosable containers. The composition can be in a multi-dose format. Multiple-dose reclosable containers can be used, for example, in combination with a preservative. Formulations for parenteral injection can be presented in unit dosage form, for example, in ampoules, or in multi-dose containers with a preservative.

The dosage can be in the form of a solid, semi-solid, or liquid composition. Non-limiting examples of dosage forms suitable for use in the invention include feed, food, pellet, lozenge, liquid, elixir, aerosol, inhalant, spray, powder, tablet, pill, capsule, gel, geltab, nanosuspension, nanoparticle, microgel, suppository troches, aqueous or oily suspensions, ointment, patch, lotion, dentifrice, emulsion, creams, drops, dispersible powders or granules, emulsion in hard or soft gel capsules, syrups, phytoceuticals, nutraceuticals, dietary supplement, and any combination thereof.

A microbe can be present in any suitable concentration in a pharmaceutical composition. The concentration of a microbe can be for example, from about $10^1$ to about $10^{18}$ colony forming units (CFU). The concentration of a microbe can be, for example, at least $10^1$, at least $10^2$, at least $10^3$, at least $10^4$, at least $10^5$, at least $10^6$, at least $10^7$, at least $10^8$, at least $10^9$, at least $10^{10}$, at least $10^{11}$, at least $10^{12}$, at least $10^{13}$, at least $10^{14}$, at least $10^{15}$, at least $10^{16}$, at least $10^{17}$, or at least $10^{18}$ CFU. The concentration of a microbe can be, for example, at most $10^1$, at most $10^2$, at most $10^3$, at most $10^4$, at most $10^5$, at most $10^6$, at most $10^7$, at most $10^8$, at most $10^9$, at most $10^{10}$, at most $10^{11}$, at most $10^{12}$, at most $10^{13}$, at most $10^{14}$, at most $10^{15}$, at most $10^{16}$, at most $10^{17}$, or at most $10^{18}$ CFU. In some embodiments, the concentration of a microbe is from about $10^8$ CFU to about $10^9$ CFU. In some embodiments, the concentration of a microbe is about $10^8$ CFU. In some embodiments, the concentration of a microbe is about $10^9$ CFU.

Pharmaceutical compositions of the invention can be formulated with any suitable therapeutically-effective concentration of prebiotic. For example, the therapeutically-effective concentration of a prebiotic can be at least about 1 mg/ml, about 2 mg/ml, about 3 mg/ml, about 4 mg/ml, about 5 mg/ml, about 10 mg/ml, about 15 mg/ml, about 20 mg/ml, about 25 mg/ml, about 30 mg/ml, about 35 mg/ml, about 40 mg/ml, about 45 mg/ml, about 50 mg/ml, about 55 mg/ml, about 60 mg/ml, about 65 mg/ml, about 70 mg/ml, about 75 mg/ml, about 80 mg/ml, about 85 mg/ml, about 90 mg/ml, about 95 mg/ml, about 100 mg/ml, about 110 mg/ml, about 125 mg/ml, about 130 mg/ml, about 140 mg/ml, or about 150 mg/ml. For example, the therapeutically-effective concentration of a prebiotic can be at most about 1 mg/ml, about 2 mg/ml, about 3 mg/ml, about 4 mg/ml, about 5 mg/ml, about 10 mg/ml, about 15 mg/ml, about 20 mg/ml, about 25 mg/ml, about 30 mg/ml, about 35 mg/ml, about 40 mg/ml, about 45 mg/ml, about 50 mg/ml, about 55 mg/ml, about 60 mg/ml, about 65 mg/ml, about 70 mg/ml, about 75 mg/ml, about 80 mg/ml, about 85 mg/ml, about 90 mg/ml, about 95 mg/ml, about 100 mg/ml, about 110 mg/ml, about 125 mg/ml, about 130 mg/ml, about 140 mg/ml, or about 150 mg/ml. For example, the therapeutically-effective concentration of a prebiotic can be about 1 mg/ml, about 2 mg/ml, about 3 mg/ml, about 4 mg/ml, about 5 mg/ml, about 10 mg/ml, about 15 mg/ml, about 20 mg/ml, about 25 mg/ml, about 30 mg/ml, about 35 mg/ml, about 40 mg/ml, about 45 mg/ml, about 50 mg/ml, about 55 mg/ml, about 60 mg/ml, about 65 mg/ml, about 70 mg/ml, about 75 mg/ml, about 80 mg/ml, about 85 mg/ml, about 90 mg/ml, about 95 mg/ml, about 100 mg/ml, about 110 mg/ml, about 125 mg/ml, about 130 mg/ml, about 140 mg/ml, or about 150 mg/ml. In some embodiments, the concentration of a prebiotic in a pharmaceutical composition is about 70 mg/ml. In some embodiments, the prebiotic is inulin.

Pharmaceutical compositions of the invention can be administered, for example, 1, 2, 3, 4, 5, or more times daily. Pharmaceutical compositions of the invention can be administered, for example, daily, every other day, three times a week, twice a week, once a week, or at other appropriate intervals for treatment of the condition.

Computer Systems

The invention also provides a computer system that is configured to implement the methods of the disclosure. The system can include a computer server ("server") that is programmed to implement the methods described herein. FIG. 7 depicts a system 700 adapted to enable a user to detect, analyze, and process data (e.g. sequencing data; strain classification, functional pathways, epigenetic changes, patient information, external data, databases, microbiome strains; therapeutic consortia, etc.). The system 700 includes a central computer server 701 that is programmed to implement exemplary methods described herein. The server 701 includes a central processing unit (CPU, also "processor") 705 which can be a single core processor, a multi core processor, or plurality of processors for parallel processing, or cloud processors. The server 701 also includes memory 710 (e.g. random access memory, read-only memory, flash memory); electronic storage unit 715 (e.g. hard disk); communications interface 720 (e.g. network adaptor) for communicating with one or more other systems; and peripheral devices 725 which may include cache, other memory, data storage, and/or electronic display adaptors. The memory 710, storage unit 715, interface 720, and peripheral devices 725 are in communication with the processor 705 through a communications bus (solid lines), such as a motherboard. The storage unit 715 can be a data storage unit for storing data. The server 701 is operatively coupled to a computer network ("network") 730 with the aid of the communications interface 720. The network 730 can be the Internet, an intranet and/or an extranet, an intranet and/or extranet that is in communication with the Internet, a telecommunication or data network. The network 730 in some cases, with the aid of the server 701, can implement a peer-to-peer network, which may enable devices coupled to the server 701 to behave as a client or a server. Peripheral devices can include, e.g. sequencers 725 or remote computer systems 740.

The storage unit 715 can store files, (e.g. any aspect of data associated with the invention). In some instances cloud storage is used. Cloud storage can be a model of data storage where the digital data is stored in logical pools, wherein the physical storage can span multiple servers and, in some instances, one or more locations. In some embodiments, the physical environment is owned and managed by a hosting company. Cloud storage services may be accessed, e.g., through a co-located cloud compute service, a web service application programming interface (API) or by applications that utilize the API, such as cloud desktop storage, a cloud storage gateway or Web-based content management systems.

The server can communicate with one or more remote computer systems through the network 730. The one or more remote computer systems may be, for example, personal computers, laptops, tablets, telephones, Smart phones, or personal digital assistants.

In some situations the system 700 includes a single server 701. In other situations, the system includes multiple servers in communication with one another through an intranet, extranet and/or the Internet.

The server 701 can be adapted to store information. Such information can be stored on the storage unit 715 or the server 701 and such data can be transmitted through a network.

Methods as described herein can be implemented by way of machine (e.g., computer processor) computer readable medium (or software) stored on an electronic storage location of the server 701, such as, for example, on the memory 710, or electronic storage unit 715. During use, the code can be executed by the processor 705. In some cases, the code can be retrieved from the storage unit 715 and stored on the memory 710 for ready access by the processor 705. In some situations, the electronic storage unit 715 can be precluded, and machine-executable instructions are stored on memory 710. Alternatively, the code can be executed on a second computer system 740.

Aspects of the systems and methods provided herein, such as the server 701, can be embodied in programming Various aspects of the technology may be thought of as "products" or "articles of manufacture" typically in the form of machine (or processor) executable code and/or associated data that is carried on or embodied in a type of machine readable medium (e.g., computer readable medium). Machine-executable code can be stored on an electronic storage unit, such memory (e.g., read-only memory, random-access memory, flash memory) or a hard disk. "Storage" type media can include any or all of the tangible memory of the computers, processors or the like, or associated modules thereof, such as various semiconductor memories, tape drives, disk drives and the like, which may provide non-transitory storage at any time for the software programming. All or portions of the software may at times be communicated through the Internet or various other telecommunication networks. Such communications, for example, may enable loading of the software from one computer or processor into another, for example, from a management server or host computer into the computer platform of an application server. Thus, another type of media that may bear the software elements includes optical, electrical, and electromagnetic waves, such as used across physical interfaces between local devices, through wired and optical landline networks and over various air-links. The physical elements that carry such waves, such as wired or wireless likes, optical links, or the like, also may be considered as media bearing the software. As used herein, unless restricted to non-transitory, tangible "storage" media, terms such as computer or machine "readable medium" refer to any medium that participates in providing instructions to a processor for execution.

Hence, a machine readable medium, such as computer-executable code, may take many forms, including but not limited to, tangible storage medium, a carrier wave medium, or physical transmission medium. Non-volatile storage media can include, for example, optical or magnetic disks, such as any of the storage devices in any computer(s) or the like, such may be used to implement the system. Tangible transmission media can include: coaxial cables, copper wires, and fiber optics (including the wires that comprise a bus within a computer system). Carrier-wave transmission media may take the form of electric or electromagnetic signals, or acoustic or light waves such as those generated during radio frequency (RF) and infrared (IR) data communications. Common forms of computer-readable media therefore include, for example: a floppy disk, a flexible disk, hard disk, magnetic tape, any other magnetic medium, a CD-ROM, DVD, DVD-ROM, any other optical medium, punch cards, paper tame, any other physical storage medium with patterns of holes, a RAM, a ROM, a PROM and EPROM, a FLASH-EPROM, any other memory chip or cartridge, a carrier wave transporting data or instructions, cables, or links transporting such carrier wave, or any other medium from which a computer may read programming code and/or data. Many of these forms of computer readable media may be involved in carrying one or more sequences of one or more instructions to a processor for execution.

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

EXAMPLES

Example 1

Media for Growing Bacteria Strains

A microbial strain of the invention can be grown using the media described in this example.

For preparing the media, combine all ingredients shown in Table 7:

TABLE 7

| Recipe for growth media | |
|---|---|
| PYGveg Component | Amount per liter |
| Glucose | 5 g |
| $K_2HPO_4$ | 2 g |
| Tween 80 | 1 ml |
| Cystein-HCl | 0.5 g |
| Yeast extract | 10 g |
| HiVeg Extract | 5 g |
| HiVeg Peptone #1 | 5 g |
| HiVeg Peptone #3 | 5 g |
| Vitamin Mix 100x | 10 ml |
| Salt solution | 40 ml |
| Salt solution Component | grams per liter |
| $CaCl_2$ $2H_2O$ | 0.02 |
| $MgSO_4$ $7H_2O$ | 0.02 |
| $K_2HPO_4$ | 0.04 |
| $KH_2PO_4$ | 0.04 |
| $NaHCO_3$ | 0.4 |
| NaCl | 0.08 |

Dissolve the ingredients in boiling water, which can contain less oxygen. Purge with nitrogen gas until the medium is completely anaerobic. Seal bottle with rubber septum. Let the medium cool down. Perform aliquoting of the anaerobic medium in a glove box to maintain anaerobic condition. Autoclave the medium for about 20 minutes at 121 degrees Celsius. Let the medium cool down and add the appropriate amount of 100× vitamins, shown in Table 8 below, to result in 1× final solution of growth medium.

TABLE 8

Vitamin solution

| Vitamin Solution Component | milligrams per liter |
| --- | --- |
| D-biotin | 0.2 |
| Ca-pantothenate | 2.5 |
| myoinositol | 20 |
| p-aminobenzoic acid | 0.5 |
| pyridoxine hydrochloride | 5 |
| riboflavine | 0.5 |
| thiamine dichloride | 10 |
| vitamin B12 | 0.2 |
| nicotinic acid | 5 |

Figure 14:
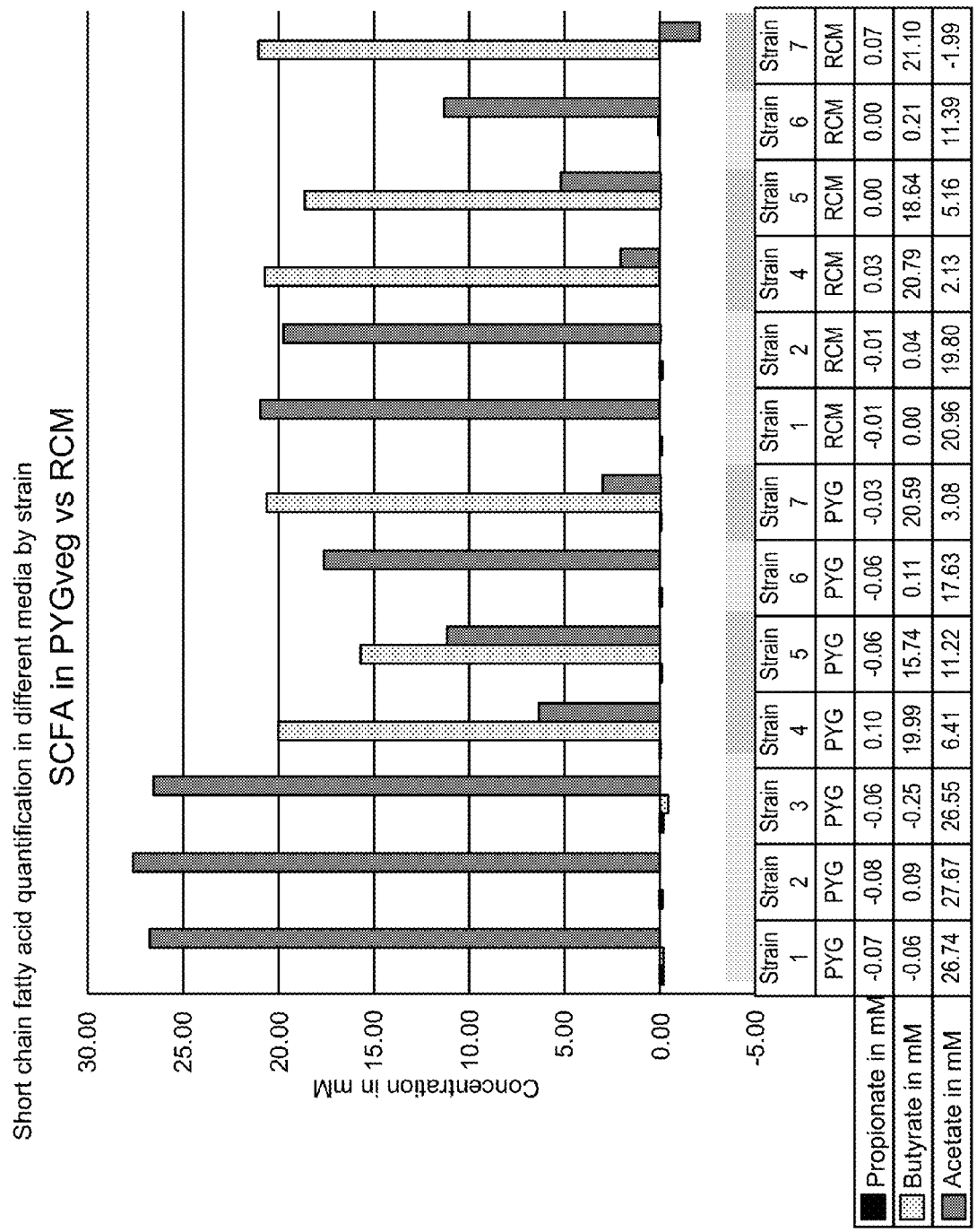

FIG. 14 illustrates exemplary data for short chain fatty acid quantification in different media (e.g., RCM, PYG) by strain. The short chain fatty acid quantification shows that the predicted genomic function of the strains matches the actual function. This can be similar for different media. In one non-limiting example, strain 1 can be *Bifidobacterium adolescentis* (BADO). In one non-limiting example, strain 2 can be *Bifidobacterium infantis* (BINF). In one non-limiting example, strain 3 can be *Bifidobacterium longum* (BLON). In one non-limiting example, strain 4 can be *Clostridium beijerinckii* (CBEI). In one non-limiting example, strain 5 can be *Clostridium butyricum* (CBUT). In one non-limiting example, strain 6 can be *Clostridium indolis* (CIND). In one non-limiting example, strain 7 can be *Eubacterium hallii* (EHAL).

Figure 15:
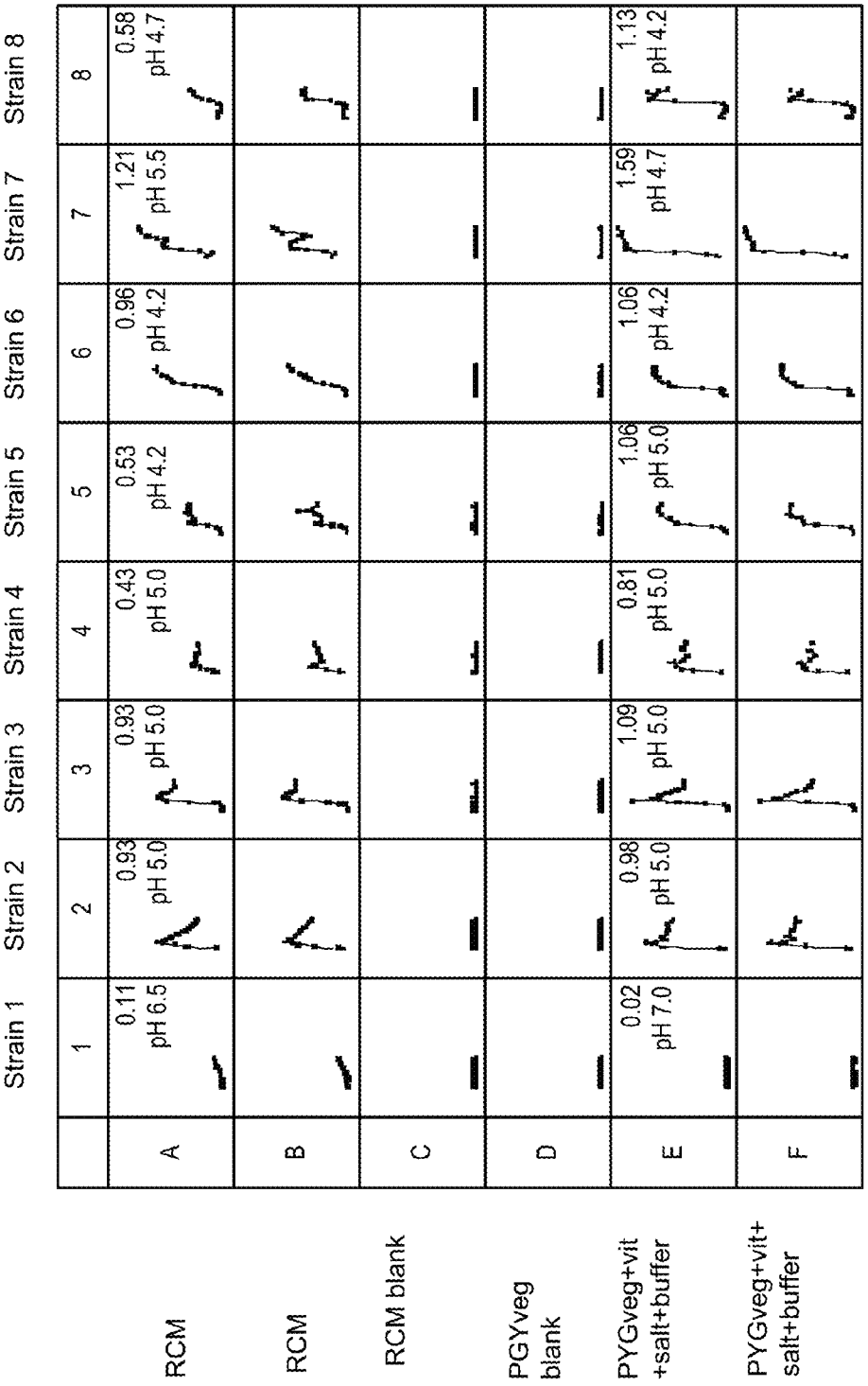

FIG. 15 illustrates that improved media of the invention (e.g., PYGveg+vit+salt+buffer) can result in higher peak bacterial density. In one non-limiting example, strain 1 can be *Akkermansia muciniphila* (AMUC). In one non-limiting example, strain 2 can be CBEI. In one non-limiting example, strain 3 can be EHAL. In one non-limiting example, strain 4 can be CIND. In one non-limiting example, strain 5 can be BLON. In one non-limiting example, strain 6 can be BADO. In one non-limiting example, strain 7 can be CBUT. In one non-limiting example, strain 8 can be BINF.

Example 2

Stability of Strains in Formulation

FIG. 9 illustrates the stability of microbial strains *Clostridium butyricum* (CBUT), *Clostridium beijerinckii* (CBEI), *Bifidobacterium longum* (BLON), and *Bifidobacterium infantis* (BINF) when present individually or alone as compared to that observed when present together in a formulation, for example, WB0002 and WB0003.

In one non-limiting example of the invention, WB0002 comprises *Clostridium butyricum* (CBUT), *Clostridium beijerinckii* (CBEI), *Bifidobacterium longum* (BLON), and *Bifidobacterium infantis* (BINF), *B. adolescentis, A. muciniphila, E. hallii*, and *C. indolis*.

In one non-limiting example of the invention, WB0003 comprises the strains *Clostridium butyricum* (CBUT), *Clostridium beijerinckii* (CBEI), *Bifidobacterium longum* (BLON), *Bifidobacterium infantis* (BINF), *B. adolescentis, A. muciniphila, E. hallii*, and *C. indolis*, and a prebiotic (e.g. inulin).

Example 3

Treatment of Metabolic Condition with a Microbial Composition

FIGS. 10 and 11A and B illustrate results of a preclinical study testing the effect of a microbial composition of the invention (e.g., WB0002 and WB0003) on diet-induced obese mice.

In one non-limiting example of the invention, WB0002 comprises *Clostridium butyricum* (CBUT), *Clostridium beijerinckii* (CBEI), *Bifidobacterium longum* (BLON), *Bifidobacterium infantis* (BINF), *B. adolescentis, A. muciniphila, E. hallii*, and *C. indolis*.

In one non-limiting example of the invention, WB0003 comprises the strains *Clostridium butyricum* (CBUT), *Clostridium beijerinckii* (CBEI), *Bifidobacterium longum* (BLON), *Bifidobacterium infantis* (BINF), *B. adolescentis, A. muciniphila, E. hallii*, and *C. indolis*, and a prebiotic (e.g. inulin).

As illustrated in FIG. 10, the microbial composition WB00003 resulted in increased weight loss during the dosing period.

FIGS. 11A and B illustrate glucose control in mice dosed with formulations of the invention as compared with controls.

Example 4

Treatment of a Metabolic Condition with a Microbial Composition

A subject with a metabolic condition, for example, obesity, insulin insensitivity, T2DM, and/or T1DM comes to a medical professional for treatment.

The medical professional prescribes a microbial-based oral composition comprising the microbial strains *Akkermansia muciniphila, Bifidobacterium adolescentis, Bifidobacterium infantis, Bifidobacterium longum, Clostridium beijerinckii, Clostridium butyricum, Clostridium indolis*, and *Eubacterium hallii*. The composition may additionally comprise *Faecalibacterium prausnitzii* in some embodiments. Each strain is present in a range of about 10^8 to about 10^9 CFU in the composition. The composition additionally comprises inulin at a concentration of about 70 mg/mL. The expected delivery form of the oral composition is an enteric-coated (e.g., pH sensitive polymer Eudragit FS30D) pill that can protect against stomach acidity and deliver to the ileum/upper colon region of the subject. The enteric coating is designed to dissolve at a pH greater than about 6.5-7. In some embodiments, the oral composition is administered as a liquid capsule.

The subject is administered the composition before food intake (e.g., 1 hour before meals) twice daily for fourteen consecutive days. In some cases, the composition is administered simultaneously with food intake.

The microbial composition alters the microbial habitat of the gut of the subject to that of a healthy subject. The subject loses weight. The subject's metabolic condition, for example, obesity, insulin insensitivity, T2DM, and/or T1DM is treated by the composition.

In some embodiments, a sample is taken from the subject to personalize the composition of the microbial-based oral composition. For example, if the subject has a low level of one or more of the microbial strains, a microbial-based oral composition may be administered that contains the one or more of the microbial strains that the subject is deficient in.

Example 5

Study to Evaluate Microbial Compositions in Treating a Metabolic Condition

Objective:
The purpose of the study is to assess the effect of microbial compositions of the invention in treating a metabolic condition, for example, obesity, insulin insensitivity, T2DM, and/or T1DM.

Methods:
Twenty subjects with a metabolic disorder, enter a double-blind, placebo controlled and randomized study.
1) Experimental group: Ten subjects are given oral compositions containing the active composition comprising: *Akkermansia muciniphila, Bifidobacterium adolescentis, Bifidobacterium infantis, Bifidobacterium longum, Clostridium beijerinckii, Clostridium butyricum, Clostridium indolis*, and *Eubacterium hallii* strains, and the prebiotic inulin. The composition can additionally comprise *Faecalibacterium prausnitzii*. The composition is taken once a day for 3 weeks before or simultaneously with meals. Parameters observed are weight of the subject and glucose tolerance before and after administration of the composition daily for 3 weeks.
2) Control group: Ten subjects are given a placebo pill. The placebo is taken once a day for 3 weeks. Parameters observed are weight of the subject and glucose tolerance before and after administration of the composition daily for 3 weeks.

Predicted Results:
Following treatment, subjects in the experimental group have a restored gut microbiome, reduction in weight in obese subjects, and increased glucose tolerance compared with the control group.

Example 6

Treatment of a Metabolic Condition with a Microbial Composition

A subject with a metabolic condition, for example, obesity, insulin insensitivity, T2DM, and/or T1DM comes to a medical professional for treatment.

The medical professional prescribes a microbial-based oral composition comprising the microbial strains *Clostridium butyricum, Clostridium beijerinckii, Bifidobacterium longum*, and *Bifidobacterium infantis*. Each strain is present in a range of about $10^7$ to about $10^{12}$ CFU in the composition. The composition additionally comprises a prebiotic at a concentration of about 70 mg/mL. The expected delivery form of the oral composition is an enteric-coated (e.g., pH sensitive polymer Eudragit FS30D) pill that can protect against stomach acidity and deliver to the ileum/upper colon region of the subject. The enteric coating is designed to dissolve at a pH greater than about 6.5-7. In some embodiments, the oral composition is administered as a liquid capsule.

The subject is administered the composition before food intake (e.g., 1 hour before meals) twice daily for fourteen consecutive days.

The microbial composition alters the microbial habitat of the gut of the subject to that of a healthy subject. The subject loses weight. The subject's metabolic condition, for example, obesity, insulin insensitivity, T2DM, and/or T1DM is treated by the composition.

Example 7

Study to Evaluate Microbial Compositions in Treating a Metabolic Condition

Objective:
The purpose of the study is to assess the effect of microbial compositions of the invention in treating a metabolic condition, for example, obesity, insulin insensitivity, T2DM, and/or T1DM.

Methods:
Twenty subjects with a metabolic disorder, enter a double-blind, placebo controlled and randomized study.
3) Experimental group: Ten subjects are given oral compositions containing the active composition comprising: *Clostridium butyricum, Clostridium beijerinckii, Bifidobacterium longum*, and *Bifidobacterium infantis*. The composition is taken once a day for 3 weeks before meals. Parameters observed are weight of the subject and glucose tolerance before and after administration of the composition daily for 3 weeks.
4) Control group: Ten subjects are given a placebo pill. The placebo is taken once a day for 3 weeks. Parameters observed are weight of the subject and glucose tolerance before and after administration of the composition daily for 3 weeks.

Predicted Results:
Following treatment, subjects in the experimental group have a restored gut microbiome, reduction in weight (e.g., in obese subjects), and increased glucose tolerance compared with the control group.

---

SEQUENCE LISTING (14 sequences)

SEQ ID NO: 1 - DNA, 2043181 bp, Bifidobacterium adolescentis WBS-01
cagacgctggttctgaacggcctgcgttccccgcatcaccgtgcagtgcgacggcgagctcaagaccggtcgcgacgtggtgtatcgccgcgctgcttggcgccgaggaattcggcttcgccaccgccgcgctgatcgtcgaaggctgcgtcatgatgcgcgcctgccagaagaacacctgcccgcagggtatcgccacccaggatccggagctccgagcacgcttcaagggcaagccggaacatgtcgtcaacttcttcatgttcatcgccgaggaagtccgcgaactgctcgcgcagctcggcttccgcacgctggaagaggccgtcggccatgtcgaatgcctcgaccaggacgaagccatcaagcgttggaagtccgacggcatcgacctgagcaacgtgctcatgcagccgggtccggttccgggaaccatcctgcacaagacgatcgatcagaaccatgagctcgacaaggcgctcgacaacaagctcatcgagcttgcccagccagcccttgacaagaaggagcccgtgcgtatcgaaatgccgatccgcaacgtgtaccgtacgctcggcaccatgctcggctatgagatcaccaagcgttacggcgaggaaggtctgccggacgacaccatcggcatgacgttccatggtgccggcggccagtccattggcgcgttcattccgcgtggcgaaaccatccgcgtctacggcgaagtcaacgactacgcgggtaagggcctgtccggcggccgcatggtggtccgtccagaggacggcatcaccttcgatccgcacgagaacgtgatcgcaggcaatgtcaccggcttcggcgcgacttccggccaaatgttcgtggccggccgcgcgcgaacgtttcgccgtacgtaacggcggcgccaccttcgtggtggaaggcgtgggcgaccacggctgcgaatacatgaccggcggtacggtcgtgattctcggctccaccggccgtaacctcggcgcgggcttctccggcggcaacgtgtacgtgctcgacctcgacatgaagcaggtcaacccggcggccgccaccaacggcgcgctgctgttcgagccgcttgacgccgatgccgacaagctggtgcacggtctcgtcaagcagcatgccgaagagaccggctccgccttcgcgaaggccctgcttgacgactgggaaaacagcgccaagcgattcacccacatcgttccgaagcacttcctcgccatgcagaaggcgatgaaggaagccgaggagaagaacatcgatttcaatacgcccggcgtctgggaacaggtgtacgagcaggttatggaaggagcgcgctgacatgggagatcctcgtggattcctgaaggtccgtacccgtcgcgaactggccgaacgccccgttgaagagcgaatcaaggactggttcgacgttcacaccgaatccggcctgcagtcctggaccaccgagcaggcggcccgctgcatggattgcggcactccgttctgcatgagcggatgcccgctcggcaacatcattccggaattcaacgatctggtccgtcaggagaagtgggaggacgcgtacaaccgtctgtccgaaaccaacaacttccccgaagtgaccggtcgcatctgcccggcattgtgcgaagccgcctgcgtgcttggcatccatcagccggccacgatgattcagaacgacgaacgcaccatcatcgatcaggcatggagccttgactacgtcaagcctctgccgccgcagcgtctgaccgaccagaccgttgccgtggtcggttccggcccatccggtctcgcctgcgcccagcagctcacccgtgccggccacaccgtggtcgtatacgagcgtgatgacgccatcggtggtctgatgcgttacggcattccgaacttcaaactcgacaagcgcctcatcgaccgccgagtcgagcagatgggagccgaaggcaccgtgttccgcaccggcgtggaaatcggcaaggacatctcctgggatgacctgcgttcccgctacgacgcagtggtggttgccatcggctccaccgtgccgcgtgacatgaagattccaggccgcgagctcaagggtatccatttcgccatggagttcctgccggacgccacacgtcgcgtgtacggtgtcaagccggtcaacgacatcaccgccgaaggcaagcatgtggtgatcatcggcggcggcgacaccggttccgactgcctcggcacatccctgcgccaaggcgctaaggacgtcaccgtgctgcagatcatgccgcaggaaccgaaggagcgtccggccaaccagccatggccgaccttcgcccgcctgtacaaggaaacctcctccatgaaggaaggtttcgaaacgcagcgcgccgaatacgtgtacaacaccgactcggtcaacttcgagggctccgacgaggacaaggccaaggtgaaggtggagaactccaccgccaccgaaggcttcgtcgccgacgagaacggacatgtcaccggtctgaaggtcgtcaacgtcgctccaggagagaacgggccgttcacccgccagccaggcaccgaacgagtgattcccgccgatctggtgctcatctccgtgggcttcctgcaccctgacaccaccacgctggtggatcagctgccggtcgaccttgacggtcgaggcaatgtggcgcgtaacgacaagttcgccacctcccaggacggcgtcttcgcctgcggcgatgccggacgtggccagagcctcgtcgtgtgggccatctccgaaggtcgctcctgcgcggccgcggtcgacgagtaccttaccggctccaccgaactgccggcaccgatcgtcgcttccaagcgtccaatgatgctgccgcgatagacaacactgttgtaagggtatgaacgaggtggcccggctcgcgaatagtgagccgggccacctgtttttcacccgaaatgcggtaaagtaatcccagcaccatgcaacaaaggagtgactaatgccaaatcgcgcagaacgacgtgcccaagccaagcgcaatcgcaggggagtgccacagcaatacgaccaaacccaaggccgcgcacgttccggcatgttggacgagtatcagctgcaggaaaagtcacgtcgtctgcaggacggcaccgatgggccatggaagccgagtgccagtacggtcacggaaacggaaaacgcgctgaacaccaatcctgattacaagaatccgaagatgttcaaggcaccccattccgtccgtcaatggttccgtgtggccagctgggtgctgattgcgctgtcggccatcgccttcctcgtggtcatgtggctgccgtcgcatccgatgtggctcatctccacagtcgccatcgtcttcgcagtcggtgtgctgagcctgttcttcacggccggcaacccgaagcacaatccgaatctcgaccaaaacggaacagccgtctgatcacaaaaacgatggaaagcggtgagacaaccagaagcatttgtctcaccgctttttctatcggattttaggtatgcgctacttgacttcgactaaccgtaaagggtatgcgagaatgctgtttcatcgtttttcagaaaaagaatggaactttctgaaaaacgatgaaaacaatgagtgtttttcgtgtctgatgttttacagtagaacaggaaacgctggaagactcgaggaggagattacagacatgaaggttgacattctatcgcgtgaatacccgcccaaggtgtatggcggcgcgggggtgcatgccgaagagctttccaaggtgctggcggaacgtgtcgatgtgacggtccgcgcattcgacgggccgcgcacggccgccgacattcccgcgattcccggaacagacccgaaagggtcgctcactgtcgtcggctacgacgtgccgaaggagcttgaggatgcgaacggtgcgctgaaaacgtttggcgtcgatttgcaaatcgccaacgacgttgatgccgacatcatccatgcgcatacatggtacgcatgccttgctggctatctcgccaaaatgctgcatgacaccccattggtcatcaccgcgcactcgcttgaaccgttccgtccatggaaacgtgaacagttgggcggcggctacaatctgagctcctgggctgagaaagacgcctacgagcatgccgaccgcgtgatcgccgtatccgcgggcatgcgtgaggacatcctcaccgcctatccgaaccttgacccggacaaggtggtcgtagtgcacaacggcatcaccatgagccagtttgaaaccccggcggatgacgatccgggctggaaggtgttcgaacgttacaacatcgaccgcagcaaaccgaccttgctgttcgtcggacgcatcactcgtcaaaagggtctgccgtacctgcttcaggcactgcacttcgtggacccgaacatccaggtcgttctgtgcgccggcgctcccgacacgccggaaatcatggaagaggtcaagaccgccttcgccaagctcgacgaggaacgcggcaacatcatctggattgaggagatgctgccgaagccggagctcaacgcactcgaacatggctgcgacgcattcatctgcccatccatctacgagccgctcggcatcgtgaatctggaagccatggcatgcggtctgccggtggtcgcctctgcgaccggtggcattccggaagtcgtcgtcgacggcgagaccggatatctggtgccggtcgaccaactgcatgacggcactggcacccccaccaaccctgacaaattcgtgcacgatatggccgacgccatcaaccgcatcatggctgaccctgaaaaggcgaagcggatgggacaggccggttacgagcgcgcccgcgaccacttcagctgggagtccatcgcagacaagaccgtcaaagtctacgaggacgtgcttgccgaacggaagtagaaccgaacctgtctgatcgcggataaccgatccggctgatcgacagccagaataatcctgaaatgcctcctgccgacgcactatgctggcaggaggcatcatcgtatccaagtggtttgtgaaaatggaggggaccatgaacgaacagaacatcgcgttgaaactggacgatgtggaattccgtcgccgcaggcgcgtaattctcaccaaagtcaatctggaagtcaaaaaaggcgagaaatgggtgctgttcggtcccaacggcatcggcaaatccacgttggtgcagatgatgagcacccgtggattcccatccgaaggcacagtcgacattctgggaaaacgtctgggcaaagtgaacgtgttctcctaccgcaaccgcatcggtttgagctcggccgaactcggacgcgcgttcccgccgcaggaagatcctcttgacgccatcgtgacggcgctgaccgcaaccaccggccgttggcgcgacacctatactgacgaggattacgccaaagcccgctcattgatgcgtgaattcggcatcgaatacctggaaggcaagatgatgttcaagctttccgaaggcgaacgcactcgcgtgcttatctgccgtgcgttgatggcggatcccgatttgctgattcttgacgagccgaccacgggtcttgatttgggtgggcgtgagattgctttgcgtgcgttgagtcgtgttggtgcggagcagtctgaccgcgccgtgattctggtgacgcaccgtcttgaggagattccgcaaggcttcgaccacgtggcgatcatgggacgtatcaccggcaacgaggcggatgcgtatgccgataacgtcgccggcaacgatccggcgccgggcactatcgtatatacgggtgatttggagcatggttttacttctgaacggttgagccaggtgtttggattggatttgaaggtcacgcatgcgaatggtcgttggaacgcgtacgcggtgtgatgtcgacgtcgccgtcacattgccgtcgcttcgtgccgtctgccggtatgacggcggatacggtagcataggttcgttgctgtccgtggaatgcggtctgcaatcgtaagccatagtcgtgaaatcgcatactgaacgaacgtacgaaggagcgtaaaccatgcgtcgagggccgcttgccgccggtgaaaaagtgcagttcacggaccgcaggtcgaataaaatcaccgatcagctggtgccgggtggtgtgacgcagacctcgcatggcatcatcctgcatgatgatgtgattggccagacggaaggatccgttgtcgtgacggtgagtgcgaaacgtgaggctcaggtcaaccagacgcatccggaacgcgacgcgaacaagccgtggaagggaacgcgtgccatcggtggttgggagttcgccgtcatgcgtccgcgcttggctgactatgtgctgtccatgccgcgtggcgcgcagatcatgtatccgaaggacatcgcgcaggtcatccagctcggtgatattcgttccggtatgaacgtgctggaatccggagccggttcgggcgcgatgagcatcaatctgctggatgccgtggggagggcggaagcctcaccaccatcgagatgcgttcggaattcgcgcgcgtcgccgaagccaacgcgacggtttactttggcaaacgtcccgcatggtgggatttgaggaccggcgatttcgattcggtcgcggctggtttgccggaacactccttcgaccgcatcatgcttgacatgcttgacccgtggaaccgtcttgaacaggcgtatcgcgtgatcgcgcctggcggcgtgctcgtcgcgtacgtcaccaccaccacgcagttgagccgtcttgccgaagcgttgcgcgaggtcggctgctggaccgagccggacatgcaggagactttggaacgtaattggaaggcgcaaggactggccatccgtcccgatcaccagatgattggacacaccggtttcctcatggtttctcgcgcgatggctccgggcttccaggcgttgcgtaaacgcgaccgtgccacgaaggacacgacgaccgacatcgattcgttgacgcccgaggagcgtgccgaacagcttgaggatctggaattgcgtgacatttccgatcgcaagctgcgcaaggtgctgcgtgacctcgacgcgcaggtcgaagccataaaggagtagatttagagcgtttcatgccatgtcccagcggaaaatctgagacaatggacattagacatttgaaatgcggcgctggaaccggatcggagcgtgcgattatgggaacgagcctgaagaaggtcgctaaaaaggccaaggaatacaagtatgtgctgctggcgatgcgccacgccaaaaccgagccgttcggcggcaacggcagcgacgtgggacgtgagctcaccgacaaaggacgtaagcaggccaaagccgtggccaaaggattggcggcgttcaaaatggtgcccactcgcatcgcatgctccagcgccacccgcgcccgtcagacctgcgatcgcatgctcaaggtgttcggcgacgatccgaaagtcgactaccggcaaagcctgtacgaaggcggcgtgcaatccgtgttcgacgagctcgcgcaaaccaaggaaaagcatcgcacgctgctcgtgcttggccacgaaccgaccatttcgatcgcctgccaatggctggccagcaccgaatccgatccgacgttgcttgacctgctgaatctcggcatgtccccggcctcgatcgccgtattcggctcgaacgagccattcaaccagtggcagctgcacagcggcgaactcatcgcgctgcttaccgccaaagacttcgagtagggcttgcgtgttccgggctgattcggaacgatgagcattccgcagagtgctgtgatttgacttcaagcggcttcaaggttgtatggtgctttctgaaccgatgttcagaatgatggataggagagcccatatgaacaatcccagtgcgttccctcttggggaaccaaatgacggtttcgcccagtatttcgacggacagagctggcttgcgccggtacttgacgcgcctgaagtgtcaatccacaatgtgacgttcgaacctggatgccggaaccactggcatatccaccatcacgcggcccagattctcattgcggttggagggcgtggctactaccagcttgagggcgaagagccgaaggagcttgaaccgggacaggccgtccgtattccgccggacgttaagcattggcacggtgccgcccctcgcgaagctttcagccatttggcgttcatgattgcggatggcacgggcgacgtgacgaatgaatggctggaacccgtagaccccgacgcatacgagacattgcgttaaatccgcttgccgggctgttctgcattattgatccataaacataaatgtgtgaatatagacggcatacggactgcgttataaggacagtttataacgacattcaaattttcttgatgtcttatagctggcggttttgtgatagcttgagcgggttgcattgttcatatcagatggaggattcatgtccgctcttacttccgtctccggtttcccgcgcatcggccagaaccgtgagctgaagaaaatcatcgaagcgtattggaagggcaacaccaccctcgatgaggtgcgtgccacagccaaggaactgcgcgccaagcattggaagctgcagcaggccgccggcatcgacctgattccgagcaacgacttcagctattacgaccagatgctcgacactgccatcctgctcaacgtcattccgcagcgctaccagcgtctcgccttcgagaacccggaagagaccctcttcgcaatgggtcgcggctatcagggcgagaagggcgacgtgaccgccctgccgatgaagaagtggttcaccaccaactaccactacctcgtgccggaaatcgactccgccaccgacatcaagctcaacagcaccaagccgttcgacgaattcaacgaggcgaaggcgctcggcatcaccaccaagccggtgctcatcggcccgtacaccttcctcaagctcgcccgcaatccgcaggccgaggagctcgactacgacaagggcctcgtcaacgcggtcgccgcggtgtacgccgaagtcgtcgccaagttcgccgaactgggcgtgcagtggatccagatcgacgaaccgtacctcgtgctcgacaaggagccgggcgacgtcgaactgttcaagagcctgtacgccaagatcctgcccgcccgcgaaggcaaggtcaaggtgctgctcaacacctacttcggacacatcgccgacgtgtacgaaaccgtcaacctgctcggcttcgacggcatcggcctggacctgaacgaaggcaaggacgaaaacctcgccgccgtcgaaaagtacggcgtggcagaaaaaaccaccatcttcgccggcgtgatcaacggccgcaacatctggcgcaacaactacgccgtgagcctcggcctggtcgacgcgctgaagcaggtcaccgccaacgtggccgtctccaccgccagctccctgctgcacgtgccgttcagcaccgaaggcgaggacggtctcgccgacgacgtgcgcaagcacttcgccttcgccgtccagaagctcgacgaactgcacgaagtcgccgtgctcgccgacgcttccgacgacgagaagaaggcatccgccgaactcgcagccaaccaggcgctgttcgacggcacccgcgtcgccgccgatcctgcggtcgccaagcgaatcgcaagccttaccgacgccgacttcgtacgtcagccggcacgcgccgaacgccagaaggagcagcgtgaggcgctgaacctgccgctgctgcccaccaccaccatcggctccttcccgcaaaccaaggaagtgcgcgccgaacgcgccaagctgcgcaagggcgagatcaccaaggccgaatacgacgaattcatgaagaaccagatcgacgcctgcatcaagcatcaggaggaaatcggcctcgacgtgctcgtccacggcgaattcgaacgcaacgacatggtcgaatacttcggccagaacctcaacggcttcctgttcaccaagaacgcgtgggtgcagtcctacggcacacgttgcgtcaagcctccgatcgtgtggggcgacgtatcccgcgccaacccgatcaccgtggaatggagcgcctacgcgcagtcccgcaccgatcatgtgatgaagggcatgctcaccggtccggtcaccatcctcaattggtcctggccgcgcgaggacatcacccacgagcagcagacccagcagctcgcgctcgccatccgcgacgaagtgctcgatttggagaaggccggcatcaaggtcatccagatcgacgaggccgcactgcgcgagaagctgccgctgaggaagaccgactggcacaagaagtacctcgactgggccattccggcgttccgtctggtgcattccgccgtcaagccgaccacgcagatccacacgcacatgtgctattcggagttcaacgacatcatcaaggacatcgacgcgatggacgccgacgtgatctccttcgaagcctcccgtggcgaccttgtggtgctcgacgccatccacgacgccaacttcgaaaccgaagccggcccgggcgtgtacgacatccactctccgcgcattccgtccgaacaggagatcgaggaccgcatctacgagatcctgaagaagatggacgtcgaaaaggtgtggatcaacccggactgcggcctgaagacccgtggcaacgccgaaacctggccgagcctggagaacctcgtcgcagcggccaaggccgtgcgcgccaaactcgccaagtaaggccggcataggcataaacaggcaagatttccaaggaatcacatgcattcgccaatcttctcgctggaggtgttccctcccaagcgcaccagccctgtgggtaccatctacgatacgttggatggcctgcaggggctggaccccgacttcatctccgtcacctacggcaccggcaaatcgtccgaccgcacgttgaccgcacgcatcgcgcatacggtgaacgaatacggcattccggccgtggcgcacctgaccgcgcaataccttgacaaagacgacgtggatgaggcgctcgacctgttcgaccaggccaaagtctccggcgtgctcgctttgcgaggcgaccgtgtggaaggagccgaaccggcgggagtgttcgaccatgcgagcgatctggcggcctacatccgcgagaagcgtccggatctcaagatctacggcgcctgctatccggaaaagcacccgcaggcggccacgcttgaggaggatatcgacaatctcaagaagaaggtcgacgcgggcgtaagccacctcatctcccagctgttctacgacaacgaggatttccttcgattcgtggacaaggctcgtgccgccggcatcgacgttccgatcgaagccggcatcatgccggtgatgaacgcgaagtcggtgctgcgcatgtcgaagatgtgcgaatcgcgtgttcctgaaaaacttgccgtcctgcttgacaagtgggggagcgacaccgcgctgcttaaagaggcgggtatcgcttacgcgtccgaacagatctgcgacttggcggcacgcggcgtcgacggcgtgcacctgtacacgatgaaccatccatgcgtcagccggcgcatctggtccaacgtcaaaccattcttcgtctgattcagacgatgcaacaaacacgaaagggatgatttccggcaactgtcggaaaccgtccctttcgccatacttacggatatgaacgattactatgggaaccatggcttcttctacgcatcagtttgaggtgctcgatctgattcgggcgggattgcaggatctggacacggcacgcacgttgcttgacgagttgcgcgccgacggcatcgacgacgaccggctatgcctgctgatgaaaacattggaacagacctgcgagcccgacatcgcgctacgcaacctcgtcgacatcatcaaagcgttgcaaagccaaggccgcgacttccaccaggtcatcaccgacgacgccggactcgtacgactcgtcaccgtgctcggcgtgtccgacggaatgggcaagctcatgcgcttccgccccgaactcgtcatggccgcagccagcgactcatgcgaaagccatctgtacaaccacgcgcaacgccgcgcgcatgtcctcgaagcggtcggtgccgacccggccgacaatcgcatgccaaaagccacgaaaccactcgccgaagcggcgaccgcgctacggcagacctacagaaaacagctcgccgccatcatggcgcaggacgccaccgcggacgacccaatcgaaatacaaccgagaatcagccaggaactgtccgatcttgccgacgcggccctggaaggcgcgctcgccatcgcccgcaacgaagtggacagcagcgaacacgtgcgcttcgccatcatcggcatgggcaagctcggcgcacgcgaactcaactacgtatccgacgtggacctcatctacgtggtggaaccggcggacgcggacaccaacggcatgaccctcaaccgtgtcggcaccaaaatggccaccaccctgcagcgcgtatgccaatccgtcatcatgggcgtcgccgaacctacattgtggcagatcgatggcggactgcgccccgaaggcaaggacggcccgctcgtacgcaaactcgaatcgcacgaagcctactacgaacagtgggcggaaaactgggaattccaagccctgctcaaggcccgccccgtggccggtgaccccgacctcggccaagcgtacatggacatgacccgaccgttcgtatggaccgcctccaaacgcgacaacttcgtctacgactgccagcagatgcgcaaacgagtcgaagacctcatccccgcgcccctgaaggaccgtgaaatcaaactcggccgcggaggcctacgagacgtggaattcaccgtgcagatgctccaactcgtccacggccgcgccgacgagaccctgcgcaccagctccaccctcgaatcgctgcaacgcctcgccgaaggcgggtacgtctcacgcagacaagccaagaagctctcctgggactaccgcttcgaacgcgtcatggaacaccgccagcaaatgtgggcgctcaaacgcacccacctgttcccggacctcggcaaagccagtctcggcggcatcgaacgcaaacgcgacgccaacgacgacgaactcaaccacaacctcgaactgcgcagactcgcccgggccttccacatgcaccctgaggaactcgtcgacaaatacgacgaaacccgacgtgaagtgcgccacctgcacatggacatctactaccggcccatgctgcccatcaacgccggcctcgacgacgaacaagtggaactgtccgccaacgccatgcaggaacgcttcgcctccatcggattcgccgaccccgacgccgccatgcgccacgtcaccgcactgaccgccggcatctcccgtgccgcgaaaatcaaccgcatcctcctgcccgccgtcctccaatggctcggcgaagggcagaaccccgacatggggctgctcaactggcgcaaactcgaagaacactttggcacggacagcgaatacctcggcttcctgcgcgactcgccgtccgccgcgcaacgcctgtgccacgtcctgtccaattcacggttcctgggcgacgcgctcaacaaatccgtcgaatccgtcacctggctcggcagcgacaacgacctgcagccacgttcgcgcgaaagcctcgacgtgcagacacacgcctccctcgaacgcaacgtaggcagcatcaacgacttcgccaactccatccgcgccatgcgacgccacgaaatcgaacgcatcggactagggtggatgagcggcgtcatcgacgacaaggcgtcgctcgcaggtatgaccgacgtatacgacacggccatcgacgcatcgctcacctgggccatccgccaccaaacgcaggaaatgggattcgacgaagcgccggcggcaatcgccgtcatcggcatgggacgctacggcggcagggaagtgaacttcagctccgacgccgacgtcatcatcatctaccggccgtccgataacgccgacgacaaccaagccaacctcttcgcacgcaaagtgcaggaagacctccgcgccatcctgcaaggaccgaccacgctcgaacccaaaatcgaactcgacatggacctgcggcccgaaggcaaaaacggacccctcgtgcgctcctacgcgtcctgcgaggaatactaccgttcctgggcgagcacatgggagcaccaggcgctcctgcgtgcgcgttacgcggcaggcgacgcggcgctcgccgaggatttcctgatgaacgtcgccgacccgctgcgctatccgaagatcgatttgacggaggcgcaggtcgccgaaatacgcaagctcaaggcgcgtatggaagccgagcgattgccgcgcggcgtgcgtagggaccgtcacctgaagctgggcaaaggtggtctgtccgacgtggaatggacgattcagctgctgcagttgcagcatgccggcgacaacgcgaacctgcgagtcaacggcacgatgcaggcgttggacgagttggagcggcgcaagctggtttccgccggcgacgccgtcgtattgcgacgcgcatggtggatgtgcacggccgcgcgcaacggcagctacctgtggagcgggcgcgtcaaccaggcggatatcctgccggatgacacgtattcgctgggaggactcgccgtctatctcggatacgacgcgaatcgcggacagcatttcgaaaacgatctgcttgccgtaatgcgcaaggcgcgcgacgtgacggaacgtctgttctacggcctttcatgaaacgattcgagcgggcgctcggtgaacacgcggtgaacgctccgggtcagtgtttcgggctatagttggctaggtcactttcagtggccaccttcaaccacaagttgcatgaaaggtgagccgttgtcctcagtactcgaaccggcggtcgaaacgccgatggtcggaaaaagcgtcatcactctcgatgatctttccattcgtcagattcaggaaatgctgcacaaagcgcagtacatcgattcccatcgtaaagaagtggcacacacctgcgaaggcagggtgcttgccactttgttttatgagccgagcacgcgcacgcgtctgagtttcgaaaccgccatgctgcgcctcggcggcaaggtgatcggtttcgccggcgcccagctcgcctccgtcaccaagggcgagacgatcgccgacacgttgaagacggtgtccaactacgtcgacgtggtggccatccgccatccgaaggaaggcgccgcgctggtcgcatcccgcgccgcctccgtgccggtcatcaacgcgggcgacggcggacacatgcatccgacgcagacgctcgccgacctggccacgcttcaatcgcgcttcggccgtgtcaccaacctgaccgtcggcctgtgcggcgatctgaccttcggccgcaccgtgcactccctgatcgaaacactgtgccgcttcggcaacgtcaacttcgtgctcatcagccccgacgagctcaagaccccgcagtacgtgcttgaccgcatcaacgccaccgaatcctgctcctacaccgaagtcaaggatctggtctccgtcatcggcgatcttgacgtgctgtacatgacccgcgtgcagaaagaacgtttcttcaacgaggacgattatctgcgtctgcgcgacacctacatcctcgacgaagccaagatggcgtacgccaagaaggacatggccgtgctgcacccgctgccgcgcgtcaacgaaatcgccgtggaagttgacgacgatccgcgtgcagcctacttcgaacaggtcaagaacggtatgctcatgcgcatggcattggaaagctcggtggtcggtgacgaactgccgggatacgaaccgctcgcagccaaggaggttgaagcctgatggaagtcaccagcattcagaacggcatcatcatcgatcacgtgcccgccggaaccgcgctcaaggtacttgagtatctgaagatcgacccgtccaaaaccaaactcgcgttgatcatgaacgccgacagccacatgtacggcacgaaggacatcatcaaaatcgaggatgagaccgaatccatcgacctcgacgtgctcggcctcgtggcgcgcaccgcgaccgtcggcatcgtccgcggcggcaaaatcgtcgaaaagaagaagccgaccctgccggaacatgtcgtcaacatcatcaaatgcgtgaacccgcgctgcgtcaccaccaccgagcctgcggtgcagatgttccatctggtgcattccgaccgtcaggaataccgttgcgactactgcgacgaggaagcgaagttctgaaatcatgaccctcacccttcacgacatcaaggtctggaacaccggcgaagtcattgacctcgtcgtcccctccgacacggacgcgtccgtggacgcctcggcgatgaccatcgcccccggattcgaagacccgcacgtgcatttccgcgatcccggacagacctacaaggagtccatgatctccggctgcgcggcggcggcatccggcggatacacgaacgtgctcatcatgccaaacaccgtgccggccatggatggcgtgaaggtggaggccggccagccgggcgcctccgaagtgctcgacgccgaatacgacacggtcatcgattacctgcagcattacgaggccgctcatggcgtgaaactgccggtgcgctacgacctatgcgtatgcgcctcaaaggggcgtgccggccatgaggccaccgaagtggccgactggatcggctacctgcccgaacatggcgacgagcataaggacgcctaccagctggcgcatccggtgaccgccatcagcgatgacggttccgcggtgacccccagcattctcgaacaggtgttcgaaaacgtcaaggagtcgggactgtacctcatcgagcattgcgaacaccacgacaccggcgcggtcaatgacggtccggtgtcccgcaagcttggcgttccaggcattccggaggacacggaactcaaaatcgtcgaacgcgacattgacatgtcccgcaaaaccggcgtgcacgtgcacttccagcacgtcagcaccgcgatctccttcgacgccatccgcaaagccaaggccgaaggacttccgatcacctgcgagaccgcgccgcattacatcgcattgaacgacgaggcgctgcttaagtacggcactttggccaaaatgaacccgccgctgcgctccgaagcggaccgccaggccaccatcgcagccgtcgccgacggcacggtcgatttgttggccaccgaccatgcgccccacaccatggaagagaaggaactcggcttcctcgacgcgcccaacggcatcatcgggctggaatgcgcatacggcgtctgccacaagatacttgtcgacggcggattcatttccgacgaacgtctcatcgaactcatgtccaccggtccggccgaactcatgggccacgacaaaacggacatcacggcggtactcgacgactacgccgacgccgtgccgggagacgacgacaccaagcgcgtgcttgatctgggccgcgtgcccgaaagcgaccaggtggatctcgtggtgctgaacaccggagaggaatggaccgtcgacccggagaagttccactcctcggcacgtaacaccccattcggcggatggcaggtcaccggccggccgctcgccaccatcatcggctcgaagctggccttcagccgcatcgacaaggaggactgatggaccgtctgatcgaagccatcgaagacaagcagaatccaagcgtcgtgggactcgaccccaccgaagcgctggtgccgaatcaggtcgtggccagcttcgccgaggaaatcgccgaacaggtggaggatccgacggaagcgccggcagcccaactgtccgtcgccttcttcgaattcaaccgcgccatcatcgacgcagtagccgacatcgtcccggccgtcaaaccgcagatcgccatgtatgaggcgctcggaccagccggcatcgacgcctacagcatgacctgcgaatacgccaaacagcagggactgtacgtcctcggcgacgtcaagcgcggcgacatcggctccaccgcagccgcctacgcccaccatctgagcggtgtgaacgcgggggagcacgctttcgacccgtggcatgaggacgcggtcaccgtgaacccctacctcggcaccgacggcatcaccccgttcgtcgaagccgccactggtgccgacaaggacatcttcgtactggtacgcacctccaatccatccagcagcgaactgcaggaactcgaactcgcctcaggcgagcgcgtgtacgagcatgtcgccgacctcgtggaaggctggggagccgaaaccatcggcgcgaacgggtattcccgtgtcggcgcggtggtcggagccacccatcccgaggaaggcaaggcgttgcgggcgcgcatgccgcacacgttcttcctggtccccggttacggcgcgcagggcggtaccgcccaaggcgtggccggcatgttcgacaaagacggcatgggcgcgctcgtcaattcgtcgcgtggcatcatcggagcctggaagaagtccagcaaatacagcgaatccatgagcgcagacgatgcgcttgacttggtcgccgaatcggcgcgcgaggccgcgaaggacatgcgcgacaatctgcgcgcggtactgccgtaagctaccagaacaatcgaacgaaacacaggaaagggagtcatgaccgccgcagcaacgttcatgccgaccgtcggccaggcgagggaagcgggattcttccccagcaggcacacggtcgaaatcgtcgacaaccgcatgctggccgatggcgtgtaccgattgacattccgcgacgaattcatcgcgggacatgccaagccggcgcagttcgtcgacgtgtattccaacaatccgagcagactgatgccccgcccgttcggcgtggcagaagtggatggcgatgaggtgagccttatcttcgccgtcgtcggcaaaggcaccgccgaattctccgaattgcgtgcgggcgacaccattcgggtgatgggtcctctcggcaactccttcaacaccaaggagaacgcgaactacgtgctggtggccggcggtctcggcgtgccgccgctggtgcgcgccgcgcaggccatcgccgaatcggaggggtcgacgagcaccgcggtgttcggataccgcaacgtgcgtttcggagacggatacgtcggccggtacgcggacaagacatacagcatcgacgaatccgaaggcaatgtcgtaacgctccttgaccgtattgaaaatgaactggtgaacggcgagctgaagccggtcatcctctcatgcgggccgttgccgatgatgaaggccgtcgccgcatgggcggcgaaacgcggcatcgaggcacagctgagcttggaacagcgcatgggctgcggatacggcacatgcgtgctgtgcaccgtcgacaccgccgaaggacgattgaaggtctgctcggacggacctgtgttcacccgcgaacaattgggatggggggagtgagcatgaccgcagaacaacatgcgaacctgtacgaacagcacgaatggaagcatcccacccaggtggctggtatcccgtggaagaatccggtggcgaccgcttccggcacgttccaatatgctgccgtgcgctggttctatgacgtgagccagctgggcgccgtcaccactaaaggcgtgtctccggtgccatgggaaggcaatcctggcatccgtactgcggaaggcccctccagcaacatcaacgccgtcggcctgcagaatcccggcgtggaccattaccttgaggacgatctgccgaaactcaaggccatcaacgccaccgtcatcgccaacgtcgccggacactgcgacgacgactacgcggaagtcgtgtccaagctcgacgattccccggccgacatgctggaaatcaacgtgagctgtccgaacgtgtccgcaggcggcatgagcgtcggcaccgacccggtggctttgagccgcctcatcaccagactgcgcaagctcaccgacaagaagatgatcgtcaaactcaccccgaacgtcaccgacatcaccgtgccggcacgagccgcggtggaaagcggagccgacgcattgagcctgatcaacacgctgctcggcatgcgcatcaacatccgcaccggcgagccggtcatcacgcacgtcaccggcggcgtgtccggcccggccgtcctgccggtcggactggccgcggtatggcgcgtgcgcgccgcattgccagaaataccgatcatcggcatcggaggcatcgactccggcgagaccgcgctcgaatacctgtatgccggcgccaacgccgtcgaagtcggcgcggccgcattgttcgagccgaccgcgccgctgcgcgtggcccgcgaactcgacgatctgctcgacgaacgtcccgaactcgccgacaagctcgccaaaggcgagacctggcgctgaaatttcgtaatcgatcaatgtaaggagaacaagcaaatgaccgcatcgctcgaccatcgtttcaccgagttcctgctggaatcgcaggcgttgaaattcggcgagttcacattgaagtccggccgcaagtcgccgtacttcatcaacgccggcgcattcaacgacggacgcaagatcgcccgtctcggcgcgttctacgccgagaagattgtcgaggagatcgaggcgggcaacctgcccaaggatgtcgacaccgtgttcggccctgcctacaagggcatcccgctgggcgtgtccaccgccatcgcgctgacgtccgcccatggcatggaggtcggctacaccttcgaccgcaaggagaagaaggaccatggcgacggcggcatgatggtcggcacgcagcttgcggacggcatgaaggtcctgctcgtcgacgacgtgatgaccgccggcaccgctgtgcgcgaggtcatcccgaagctcaaggccgaggcgaacgtcgaggtcatcggcctggtactgagcgtggaccgcatggagaagaccaaggattccgacacgtccgcggtgaaggccgtcgaagccgaattcggcttcccggtgttcgccatcgccaacgtgaaggagatcttcgaagccggccagcgcatccagaacgccgacggcaccccgtacgtcacaccggagatcaaggccgccgccgacgcgtacctggaacagtacggcgcctgactgcggcgttcgcgctgaaccgcgctcatcggctgttataatctcggatatgacagaaaggcactgtgctgctttcgggcagtacagtgccttttcgttgtggttcctctgttccggggtcagtcgatgagcgtgtagccgtggctggcgaccaccgacttgagcttctccaagtacgtttcggcggccttggacagcttcgcgcgctcattggtgatccatccgacaagcatcgtctcatcggtgtcgagcggcacggtgacgatcttctcgttgttgagatcgccgttgtcgatgccggtgcataccgtgtagccgttcaggccgatgatgaagttcagaatcgtggcgcggtcggtcacgttgatctgcttggggagtactccggccagacggcctcctccgcgaagaagaagctgccttcctcgccctgctcgtattggatgaacgggaacggcttcagatcgtccatggtgaccttcttcttgccggccagcggattgtcgcgcgagatgaacacgtgcaacggcgcgcggaacagcggatggaactcgagatgcttctcgcgcagcagcttgccgatcacgtccttgttgaagtcggacaggtagatgatgccgatctccgaaagcatgttcgccacctggttgatgatgtccttcgtgcgggtctcgcggatggtggactcgtattcgtcggacttggtggactcgatcatctccacgaacgcctccacggcgaacatgtaatgctgcgtggacacggagcacagctgtttgcggggtttcgcgttcttgtaccgttcctccagcagcgacgcctgatcgaggacctgacgcgcgtaggtgaggaattccgcgccgtccacggtcaacgcgatgccttgggaggaacgggtgaagatctcgatgccgagctcgttctcaagctccttcaccgaggagctcaacgcgggctgggatacgtacagctcgtgcgaggcctcgttcatggagccgcattccactattttgacgatgtatttcagctgaaggagggtcataacgcccatttataccagcgtcgctttacgaaacgacgatttatagcgcttcgttttgcatagtggacacgcggtcggtggatgtgcggcctacagcggacgatgatatgggcgcatggccgaggcccgttccgcgggacgcaggcgcacgtccgccgcgctcacacgcgcacgcccaaggattccaggtccctgcgcgcctggtcggcgtcgacgaaacggaaggcgtgcatgccggccgaccgcgccccggcgacgttcttcgcggtgtcgtcgaggaacacgctgctctcggggcttaggccgaaacggctcatcgccagttcgtagatgtcggcgttcggcttgtgcatcttctccacgccggagacgacggtgccctgcagcagttcggcaagctgcgggaacttctcgaatgcgaaatggaacgtctcatgggaccaattcgtcaatccccacacgccatagccggccgccttcagatcgcgcagcagccgctccatgccgggcagcatgcgtggcagcgcgtcgtcgtaatgcgcgatgtaataacggaagatcccggcgacgcgttctccctgctcggccaccacatcgggccatatcgaatcgaagtcctccccggcgtccatacggtcctcgtatccgaagaagccgcaggggtcgtcgtcggcgcagatgcggtcgacggtcgcgtcgtcgaatctgccttcaagacatgcccgtgtccgccaatccagcaacactccgcagaaatcgaaaacgacgtcggtgatggtcggaactgcaacggtcatcgggaaacccttcttgtagcgtgcgtctgtcttccgccagtgtaccgtacccatgttcgtgaaggacgttttcgtcttcgcatgcggcgtttcctgaaagtcattggggcggaaaggctcgcttgggttttgaaaaaggctaatctagacgttttcggcgattgtgatgattgtcatgccgaccatttcgaacatacaatcaatccgaaattaaatcaacatgttgtctgaatagacgggtgtcctagtggaaagcattaggaaggggccgacgatggcatatatcgaaatggtgcacagcttcaagcgctaccatatgggcgacatcacaatcaccgccaacaacgatgtgagtttcggcatcgaacgcggcgagcttgcgatcattctgggatcatccggagccggcaaatcgacggtgctcaacatcctgggcggcatggacacgaattccgaaggcaaggtcatcatcgacggcgtcgacatctcggacttcgacgcgaagcaactgaccgattaccggcgcaacaacatcggattcgtattccagttctacaatctggtggccaacctcaccgccaaggagaacgtggaactcgcctccgaactcgtcaagaacgtggccgatccagtgcagacgctggtcgatgtgggacttggcgaccgcatcgacaatttccccgcgcagctttccggcggcgagcagcagcgcgtggccatcgcgagagccgtggcgaagaacccgaagatcctgctatgcgacgaaccgaccggcgcgctcgactaccataccggcaagcaggtgctccgcatcctgcaggacatgagccgcaaacgcggggcgacggtggtgatcgtgacgcacaactccgcgatcgcccccatcgcggacagggtgatccgcatgcacgacgcccgcgtcaaatcaatcgaaaccaacgagcatccgatggacatcgaggagctggaatggtgaaacgcatgctgtggaaggacatccggcaaacactgtccaagtcgaaaggccgggtcgtgtccatcgtatgcctcatggcgcttggctcattcgcgctggtgggactgaaggtcaccgggccggacatgcaggcgaccgccgccgacttctacgggcgtaacaacctcgccgacatcaccgtggtctccaactacggcatctccaaagacgacgagaggatcatcggcaaggccgacggcatcaaggaagtcgaatacgggtacttcaaggacgtggtcatctccggcaccgacaggagcatgcgcatctattccaaacccgatgccgtctccacctatgacgtgacggaaggacgactgccgaagcggaccggcgaaatcgcgttggacatgaaagaacgcgacagattcgccgtcggcagcaccttgaacgttaccgagaaaacggacatcgcaggcggcaccgtgctacgccaccacaaattcaccgtcgtcggtttcgtccgggccagcgagactctgtcctgcctcaacatgggacaatccacggccggcggcggcgagctcaaaggctatgccgtggccgttccgggagagttcgattccgacgtgaagatgatcgcccgggcgacctacgaagacaccgagggattggactactggagcgccgaataccgcgatgccgtgcagaagcataaggatcagctcgtgacgttgctcgcgaaccagccaaaagcccgcgaagcgacgatacgcagccaacagcgcaagaaaatcgacgaggccaaggacaaagtcaaaacatccaaacagcagcttgccgacgcgcaacggcagctggacgatgccaaacagcagatcgacaacgccaaggaccagttgagcgaaggcagcgccgaggcagtggaggaagggtcggcggccgcggcccagctggccacggcgcaagcgcaactggcctcggccaacgcgtcggtcgcctccggacagacgcaactgcaggcggcacagacgcaactggctcaaggacagaaccagctctccgattcatggaaccagctggcgaacggcaaaacgcagctggacgcggcgcgagaacaactcgaaacaagcaaaaccgtgctcgacaaagtcggcgcgacgctcggcaaatgggaacagaccggcatcaccggcaaactctacgaacaaatacgcggcaaatacgacatggcgatcaaccagtacaacgaagcctgcgccgaatacaacagacagctgaacgcctacaatgcgggactgcaacaataccagaacgccgtagcgcggctcgaccaaggctcgcaggcgtatcggagcaatgcggacaatctcgcacaggcatccaaacagatggccgaaaaacaaaacgagctcggcaaagcggtgtcgcaggccggcaagcaagtcgcagacggcgtcacgcagcttatccaaggccagagggacatcgacaaggccgaaacggaataccagagcaaactcgccgaattcaacgcgcagaagcccgaagccgaacgcaagatatccgaagccgaacggcagataaccctcgccgaggagaagatcgacaatctcacagtcccggcctattccgtcagcggccgccgcgaaggcccgacctcgcaaggctaccgcgtgtacatggtcatcgaaggcatcgtggcgaaactggcggacatcttcccgatcttcctctacttcgtcgcggcgctcgtcaccttcagcaccatgggacgcatggtggacgaggaacgcaccaattccggaacgttgaaggcgctcggctacggcaacgcggatgtgatgctcaaattcaccgtatacggattcgccgcatccaccctgggcacatgcatcggcgtgctcgccggccacacgctgctgccgcttatcgtcgcccacgcatacagcgcgggattcaccatgccggacatcatgctcaaattccacccctggatcaccatggccgcattcgcacttgcatggataagcgccgtcgtgccgtcatggctggccgcgtccaaggaactgcgcgaaaaaccggcgagcctactgctgcccaagccgccggccaaaggctcgaaaattcttttggaacatttcccaccactatggaaccgtctgaatttcacacacaaagtgaccgcccgtaacatcttccgatacaaaacacgcatgttcatgacgatcttcggcgtatgcggagcggtattcctgctgacggccggcctcgccgtccaatcctcgatcggacagataggaaaccgacagttcgaggaactcatccactacgacctgatcgtcgccgaggaatccgacaccaacagcgcgcaacgcgaggaaatcgccacgacgctgaagggcaaaaccgtccaatcctcgacagcggtgcgctacgaggaactgtcgaaaaccgcaggcaaggagaacgataagcagtcgatcaccctgctggccatcgacgacgcatacaacttcaacgaatacctgacattacgcgaccgcaaaacacaccaaccacagatactggtcaacaatggcgcggtaatctccgaacggctcgccgaaatgctcaacgtctcggtcggcgacaccttcacggtaaacgacgaaaacggcgcgcaacgcaccatcaaagtcgccggcatcagcgaaatgtacatcggccatttcatattcatgaacgcgcaatgctacgaacacgtgttcggcgaccagtacagcacaaacgcatacatggtcggactgaaagaccacagcaacgccaacacggaacgccaaggcgccaaattcatgaaactggccgccgtgcgcggcgtcgtgcagaacacgacgcagaagaacatggtgtccacaatcgtgggatcgctcaaccagatcatggaagtgctgattctcgtggccgtgctgctggccgtggtgatcctctacgacctgaccaacctcaacgtgtcggaacgcatacgcgagctatccacgatcaaagtgctcggcttccacaccagcgagaccacgatgtacatctaccgcgaaacgatcctgctgtcactgctgggcatactcgccggatacggcttcggagaatggctgcaccgatacatcatcaccgaagtgccacccgacgaagtcatgttcgacctcgccatcagctggatcgcattggcggccccggccatcgtcgtggccgtggtactagccgtgctcggctggatcgtataccgccagctcgaaacggtggacatgctcgaagcactgaaatcagtggaatgaccctccacgaaacggtcagcggagcagctcgccaaaagcccggggaacagccgcgacgacatcaccggcaacaatcggatgcccgatcgcgctcgccggagtcttgcccgcatgcccatacagatgcggacgatgccatccgcgctgctccgacccgctggccatcgcgccggcaagcccatgcatatacgcggcggccgcggcgacctccggaaccaaagccggatcgtcggacagcatgtcgtcctgctgcgccagcaacgcgcccaacacgccggccagcacatcgcccgaaccggcggtggccatccaggcaggcgcgcgcccggacaggatgatccgcgtgttcccatctccatcagctccaaccacaatggtgaccgcgcccttaagcagcaccgtggcccccgtaagctcatgcgcgcgcaacgccgcccgcaatggccgggcctccacccactgcctggaaacaacatcagccatatcggcatccaaccgattcagcaatgcggccaattcgccggcatgcggagtgataacgacctgcggcacaacatggcacggcagcaaatccaacgcgccggcatcaaccacaatgggaggcatgccctccgcccgctcgttccgcgagccatcgccatcctccaacgcgtaatgatccagcagcgcggcaatggtcgcacgctgcatgtcatcaccggaagcaacgtcaccctcggcgggcacgccggatccaaccacccacgactgcacccggcccttgcccaacacagcctccggcaacacggccaatatcatatcctgcgcacgctgcggccccagataacgcaccatgcccacattcgcgcacgccgcggccctcgccgacaacacggcagcacccggataccgcgccgaaccagtcaccaaaccaaccaccccacgcgaatacttgccatccgcaagagacggaagacgaaccgaatccgccacaaaatcgccatccgtcatctcggcaaacggaacagcatcatcgacatcgaaaccgaaatcgaccaacgtgatccgtccgcaagcatacgaagccggcggcaccatcgcacacggcttcatcgcaccgaacgtcaccgtcacatccgcaggaatatacggccccggcaacgaaccatcatcaacacccacacccgacggcgcatcgacggccaccaccaacggcaaatcagcggaagggtcattgttcggcaacgcaggcttgtccggcaacacgccatccatacccaaagacgaagccaacgtgccagcgacaccacgcaacgcgccggccacgccaatccccgtcatagcatcaagcaccacatgcgcaccccgcgcacactcgaccgcagcctgcagccgctcaccagcctcacccgcggaaaaaccagacgtgcacccaggaatatcagccgccggatccaacaccaacacacgcccacccgcacgaacaaactccctaaacgcatcctcatgcaacgaacggccaacagcaaccgcggtaacctgcgcaccctcacgcgccaactcagcccccgcatacaagccatcgccaccattgtccccagcgccagccaacaccgtgacccgcgcatcctcaacatccaaatcctcatcatcaagcaacgacaacgtcacacgagccaccgcagaagcagccatacgcatcaacggcacaccatcatccaacaaaggacgctccaactgccggacaacatcggcggaataggaactatacaacaacgtctgcaaacggtcggcatcatcggagacatccatggaaaatccttcccctcggcgtggaaccacaaacaccactttagtcgtatattaaaaacaacaaacaaaaacggcatggacgccaaacaagaaaacggagcggaacatggcatacatcgaaatgaaaaacagcaccaagctctaccacatgggatccaccaccatcaccgccaacgacaacgtctccttcaccatcgaacaagacgaactcgccatcatcctcggcgcatccggcgcaggcaaatcaacagtgctcaacatcctaggaggcatggacaccaacacctcaggacaagtaatcatcgacggcaaagacatctccaactacacacccaaacaactcaccgcataccgccgcaccgacatcggcttcgtattccagttctacaacctcgtcgccaacctcaccgcacgcgaaaacgtggaactcgcctcacaaatcgttcccgacgcacaagacgcccgacaggcgctcgccgacgtagggcttgcggaccgcgtcgacaattttcccgcgcagttgtcgggcggcgagcagcagcgtgtggcgatcgctcgagcggtggcgaagaatccgaagattctgctgtgtgacgaaccgaccggcgcgcttgactacaacaccggcaagcaagtgctccgcattctgcaggacatgagccgcaagaagggcgcgacagtggtgatcgtgacgcataattctgcgattgcgccgattgcggaccgtgtaattcgcatgcatgatggacgtgtgtcatcgattgaggtcaacgagcatccgatggatatcgaagagcttgaatggtgacgttgcgacacgctgtgatacgtatgatttgcgtaaatggctgattcgtgtaatatatgtgacttgtgcacggaagctaagtcttccggtgggaacattcctgcgtagctcagttggcagagcatccgactgttaatcggacggtcactggttcaagcccagtcgcaggagcgcagtttcgggtactccggaacatattcctgcgtagctcagttggcagagcattcgactgttaatcgaacggtcactggttcaagcccagtcgcaggagctttttagcccttggttttccaagggcttttttgtttccgtaagaacttttcgctgctattccaacgaatcgagcacgtcgtcaatgagtgtgcggtcgtgtgccgcatcagccttgagtcgagggaagcgacgtatgacgttgtcgggacttgcgttggccgcacgtgccacattcgattttgactcgccatgcgccacggcgatttccgcgagccgatccactagcgaatccgaaacctgccgtatttgctcgccaacccataactgggacaattcgggtgaaagcgtgtaatcgtcctgcagctcgcttgaagcctcctgaatggcggcccatagcaccatgaatggcttgcggtagtaggcgatgcgttcctcggacggctcgctctccaactgctgcaatgccttgcgttgcgtagtgttgtcactcatgcgtcccatcgtatgccacgttcggtggcgttttggcatgtcatggcgcgacacgcccggcatctgtggataagtgttgttctccgaccacaaggtcgttccaagtcgacgggcggtcttcgaacgtgccatgatatcgattcccgatagagacgcggaccacaggaggcctcatgaacaaatgggaataccgtcgtcgtgttcgacacaataagatgtccgatgacattgacaagcgcaaccggcaccggtgcgccgcggcgatggccgtatgcgtattggcgaatatcgcgttcacgatatgctgcgcgcaacctacggcgtcggcatacgcgcaatcggctgatgacgtggcgcatgaagtcgcacaagcggcatgccgcacatcaatgcagtggcctttggagcacgcgcaagtaatcggcgaatatgatgcgccggctaaacaatggttgcctgggcatcgcggtttggatttgcgtgcacggccgcaagacgccatcatcgcgcccgcggatggtgtggtcgccttcagtggcaaagtggcgggcaaatccgtggtaacgcttcgccacggtgcggaaacaggaagcctgacgtcgacgtttgaacccgcggtcactacgcgaccggtcggggccgtcatcgccaagggggagcgtttcgctcgtgttgaaggtggctcggaacattgcgccgatggatgcctgcattggggcctcaagagcggaggacgtgattatgcggatccgtcgggcagagtgaggtcgatgcgggttgaactgaaaccgttgtaacggccatatccacgggtgttgtcgttgttcctggggtcgtggccttaaagaaaaagtgcggtattccggctatgatgctgtctgtacattagatttcgaggagcgagaagcttatgatcaaggaatacacgcgccctttggaacagggaattgactcggacaaaaacatcttctcagtacttgaggagcgtgtggaacgcactcctgacgacaatcttgtcgaatacaagaacgctcagggcgaatgggcggcgttcaccgctgcggagttcaaaaacaaggtcgtcgccctcgccaaaggacttatcgctcgtggcgtaatgcctggagattcggtatccattatcgcgcatacctgctggcagtggaccgcgcttgatgtggccatcatgtccatcggcgcccttaccgttccggtctatgaaacgaattcgccggcgcaggtgaagatgattttcaatgatgccaatgtcaagatggcgttcgctgaggatgatttccagcgcgacaaaatcgaatccgtccgtgatcagtgcccggatcttggcgacgtgtacgtcatcggacttggtgcaattgacacgatcatcgaatacggccgcgcggtctccgacgccgaattccttgaacgtgaacaagcggtcaaaggctccgatctagccaccatcgtatatacgtcgggatccactggcaccccgaagggcgttgaactgacgcatgccaatttcgtgttcatcacctattccggcgtcaactccatgccggacatcgccatgaaaccgaatcgtcgactgctgctgttcctgccgctcgcccatgtattcgcccgatacatgcagttcttctgctttgccggaaacgtttcactcggtctgtccagcaatctgaagaccattctcgccgatttcaaggcgttcaaaccgacgttcatcctcgccgtgccgcggattttcgaaaagatctacaatgcggcctcgcagaaggccggagccggtttcaagggacgtgttttcgctgacgccacccagacggcatgcgattggtcgcatgctcagcagtccggtgggagcattccactcgcgctgaacgcaaaacatgccctgtacaacaagctggtgtattcgtcaatcatggaagtgttcggcggccacgtcgagtatgcggtctccggcggagcgccgcttgattcctctatcgcgcatttcttcaacggtgtcggtctgtcgctattggaaggctacggcatgaccgaaacgtgcgccccctcgagtgtcaatccgaccgaaggctacaagatcggcaccatcggcttgcctctgcaaggcgtgaccatgggggtcgacgaagaaggggagctgtgcataaagagccctgccgtatgcgccggataccacaacaatcctgacgttaccaagcagcaaattgtcgatggatggctgcataccggtgatctcggctccattgatgatgacggcttcgtttccatcgtcgggcgtaagaaggatctcatcatcaccgcaggcggcaagaacgtctccccatgcgagatggaagcatccatcatgacttcgccggtggtgagccaatgcgtcatgatcggcgatcgcaagccattcatcgccgcaatcatctcccttgatttggcggagacgaacctatggctggaatccaagggagcggaacaggtcgctgatttggatgaagcctcgaagaatcccattgtgcgtgcggaagtggagcgtgccgtcaacaaagccaatgagctcgcctcacgtgccgaatcaatccgcaagttcgaaatcgttcccgacgagttcactgaggagaacggtttggtcacgccgagcatgaaggcccgcaggcaggcagtggttgaacattaccggacgttgatcgacaaggtcatctacgtgccgaggaagccggcggctcacgccgaatgatgttcgaaatatggtgggggccggtgacatccgagtgatgccatcggcccccaccatatccggaagaatcccggaagaatcccggaagaatcataggcccgcatccgccagcgaaatgtagccgggttcaatcagcgttttcttgagattgtcggcgctgatcgccaatgtctcctcatggatggtcgtaattttcttcccctcgaccgttgcggaacggatgaaaccgagtttggaaagtttgcccgaagtgttcagtcgcacgcatgtctgcgcgatgtcatcggccaacgccttgcggttctccatggcggtcatccattgcttgccgttgacgatgttcggcatggaactgatataggccccatagccggtgatgatcggccattttgcgttttccttgttatcggaatcgctgtcgtcatccgatgacgacgtcttcgcagggtcaggcactgcctgccgtttcaggtcttttttgcccgtgatgctgtccacgatgccggagattgagatggaagggttgatatcggctgaggaacctgtgtagccgagtttgtccaactcgtcggcgatgttcttcgccacatagtcgttgcaggagatgacgccatcaaggtggacagggtgcgaatcgtccttgtccgcgtcgagacgttcggcaagcaccgatttgatttgttcggcttttgacgaatcgaatgccacggaccgccagtcatccttggtggtcgaagcggtgagcgtctcggaaggagatgccgctttgccgtccttgaaatacggttcgagcactttccagatgcctttgaacatgttctgggcgaaggacgtgtccgttttggcatcatgtccgtcggccgcgtcgtaggggagtagtacctcgatttgcttgggggcatcggacgatgccttgtcgagctcgagcttgttgacgagctctttggcttgcagttctccaatctgctcggccgtggtcatcggcacgtacacgtccggcgcatacccttgaagcgtattggagatcagaacgaccttcattccttcattctgcgcaagctgcaacgccgaaaccagccgttgcgctgattgcgcataatcctgttcgtcctcatccgacgcgtcggagttccacgtgatatcatgccgtgcatagtcgccgtattgcctgtcggattccggcatctcggcgacaggcgccaccaccaaggtggttttggctttcgtggacgaatgctcggtcccgttgatgtgattcaccacatagtcttggacgctttgactttgtttgtcgaggttcgaagcggttttcacggtgatgtcgccgcttttgacaccggtccgtttcaacgaggacacgatttcgggaacgagtttttcccatttgctcaatggcgtctgttgagagatggtgatgctgtctgtcggagcgaaaatcgccacattgccggcatcggctgttgcgctggattgtgatgacggctgttgctgcgattgcgaatcaccgttgggcgagcaggcccccatggctgttgccatgcagaccgatgccagcagagcgagcagacgtttcgccgggattgtgcgatgcagaatcatgccatgtcctttgcggaagaatagacgttccttatactgaccatcgattgtaatatccggacgtcaaaaagcccgtacgcgtgtgtgattgcgcatacgggctttcgacagctcagatagattactctgccagagcctttgccagattctcgtcgagggcgttcatgaaaccctcggtatcgagccaaggctggtccggtccgatgagcatggccagatccttggtcatctgtccgccttcgacggtggagatgatgactttctccaaagtttcggcgaaatgcttgacttccggagtgttgtcaaggtcggcgcgatgcttcagaccgccggtccatgcgaagatggaggcgatcggattggtcgaggtcttttcacccttctgccaacggcgataatggcgggtcacggtgccgtgcgcggcttcggcttcgacggtctgcccgtcgggagtcatcagcacggaggtcattaggccaagggagccgaatccctgtgcgacggaatccgactgcacgtcgccatcgtagttcttgcaagcccagatatagccgccatgccacttgagggagcttgccaccatgtcatcaatgagtcggtgctcgtaggtcaggccagccgcctcgtacttgtccttgtattcgttttcgaacacctcggcgaacgtatccttgaactggccgtcgtacgccttgagaatcgtgttcttggtggacaggtacaccggatagccgcgcatcagaccatagttgaagcaggcgcgtgcgaaacctcggatggaatcgttcacgttgtattgcacctgggcaactccgccgtcagggccataattgtaaacgacgtgctcaatcggctcggagccgtcttccggagtgaaggttacggtgagggtgccggctcccggaaccttgaaatcagtggctttgtactggtctccgaaggcgtgacgtgccacgacgatcggcttggtccatcccgggaccaggcgaggcacattgctcatgacgattggctcgcggaagatggtgccgccgagaatgttgcggatggtaccattgggggacttccacatcttcttgaggccgaactccttgacgcgcgcctcgtccggggtgatggtggcgcatttgacgccgacatgttcgcgctggatggccttcgccgcgtcgacggtcacctgatcgtcggtggcgtcgcggttttcgatgcccagatcgtaataatccaaatccacgtcgaggtacggcaggatcagacggttcttgatgtctttccagatgacacgggtcatctcgtcgccgtcgagttcgacgactttgccttcgaccttgattttggccatggtttgtcctccctgtcggaattgaaggtgatgggttccgtcttattacatgtgtgttaattccgtatggaaatgtccaaaaccgtggggacacgcgcgaaggcactgtcatagctgagcattagccttgaaaccatgtctcaggaaattgaaatcggtttgggcaagaagggccgtctggcctattcgctggacgatgtctccatcgttccctcccgtcgtacccgtgatcctcaggatgtgtccacctcttggcaggtcgacgcctatgaattcgacgtgccggtcatcggcgccccgatggattccgtgaccagcccggccacggccatcgccatgggcaagatgggcgcgcttggcgtgcttgacctagaaggattgtggacccgctatgacgatccccagccgctgctggacgaaatcgcgcagctgtctgcggacaaggccaccgaacgcatccagcagatttacgctgagccgatcaagccggaactcatcgtcgaacgtctgcatgagattcgtgatgccggcgtcaccgtagccggcgcgctgtctccgcagcgtacgcaggattattattccaccgtgcttgaggccggtgtcgatctgtttgtcattcgtggcaccgtggtgtcggcggagcatgtctccaaggaccatgagcccctgaaccttaagaaattcatctatgacctggatgtccccgtcattgttggcggcgcggccaactacacggctgcgttgcatttgatgcgcacgggagccgctggcgtgcttgtcggcttcggtggcggtgcggtatccgccaaccgcaacacgattggagtgcacgcgccgatggccacagccatcgccgatgtcgccgaggcccgccgcgattacatggacgaatcgggcggacgctatgtgcaggtgattgccgacggcggtatgggtgattccggcagcttcgtcaaggcattcgcgctgggcgccgatgcggtgatgctgggctcgcctctggcacgcgcctccgaggctcctggcaaaggcatgcattggggcgccgaggcccgccaccagacgttgccgcgcggattccgcactaacgtgggcaccgtaggttccttgcaggaggtcatgttcggcccgagccataacgccgacggaaccaccaattttgttggggcgcttcgcagagccatggccacgaccggttatgtcgatttgaagagcttccaacgttgtccggttacggtcgcttcgagccactgatcagatagcttcgtcctgtggataaaaaagttatccacaatccctccgtcgacttgacgggggattgtctttatgtattaatgtttttggtccttctcagtgaagagagttggatgacattaaataggtaaagaaatgagggatccatggcaatggacgacttatctgacgatggcgtttcacctccggaatggcagtccggctctgagcgggagccggaagacgacaaggagatagaaggcaatgagcctgacgaaatcccaccgtcagaccctgattcgtatgtcggtcttaaagaagcggaaaacaatggccaatggctgcagtgcataggaaaatccgtcgagaagcttccttcatatgatgggtttttggaaacacaattatccggtatgcgggtgcccttccatgttatccggtccgattccacaccgtgggacgcgaagcaagcctattccttggcgttattgggcgcgcgcatgtcgtgcgatgccatcgacatcttccgtggtcggcaaaagccggcgcatgtagagcgtattctaacggaggactgtatgcgtaggcttaaaatcgcagcttccataataggccattatatgaaggaagacgcaaatctatatgccaagattggtctgcttcccatcaacgtgtccgccattaacggctggttgacttcgaccacgaaattcgaatgtgcggctttgctcaacatcggcgaaacgcggttgagatgcaacaccgcattcaggctcaaaggctccacgtggaagtgcgtcttggctgatttcgggtgatcgcattgatgcgatgatacggtaggaatctgcaaaaagcccttggcgtcgatgttcgcagtcgatgccaagggctttcagcgtgccttaagcatacgggaactactatagagaaccatgttgagagaatttgtaccagagccggcctacagcaccacggatgatgacacggtatatgcgttgctgtcgcgtcgtgcgcagaagaatccggatgatcttatcgcacaatggcaggatgatgagactcggcaatggcatgatgtgacggcaggccagatgctcgctcgtgtgcgcgccgtggcgaagggccttatcggtcttggagtcaaagccggaagcatggtggtcatttactctcccacctgttacgagtggggtgtggtcgatttcgcatgcgcggccatcggcgcggtaagcgttccgatttatgaaaccgattcggccaagcaggccgcttccatcgtggaagaggtggagccggttattgccttcgctggagattccgcccacacgcagacgctcgaacagattcgtgacatgcatgaagggctgcgttacgtgttcaatttcaaagcggacggtcttgacgcggttgccgatttcggagagggcgtcgatgacgatacccttgatcaggtcattgcccggatcaaggcggacgacatgctcaccatcgtttacacatcgggctccacgggacgtccgaagggtgcgatgctgtcccatcgcaacttcacgcatatcgtgctcaatggctacatcattcttgacgagatgctgtaccagcccaacaggttgatgctgttcctgccgttggcgcactgcttcgcccgctatatccaatacgtggcgattggcggacaaggcgtggtcggctatctgcctggagccaagcatctgctcgccgatctgcgcagtttcaaaccgacgtatttgcttggcgtgccacgtgtgttcgaaaaagtgtacaacgctgcctcgcagaaggccggtgcgggtattcgcggcagggtcttcgccaaggcgttcgatcatttcgtgcaatggtccaaggacgagcaggacgggggacatcattcgatggtggcccgagccgagcattccttcttcatgtccgtcgtcggcaagtccattcgttccgcgcttggtccgaacctgaaatatctggcatgcggcggcgccccgctgaacgtcgaccttgcccacttcttcaatggcatggatggcatcacgttcattcaggggtacggtatgacggaaaccgcggctccgatgatcgtcaactggcaaaatgcgaatcgcgtcggttccgttggtaagcccgggccgggtatgggtgtgcgcaccgatgatgatggcgagctgcaggtcatgggccccaatgtttttcttggctactacaagaatcctgagaagaccgctgaagtcaaaatgcctgatggttggctgaggaccggcgatctgggggccatcgacgatgatggattcgtgtatatcaccggccgcaagaaggacatcatcatcacagccggaggcaagaacgtcagccccgccccgatggaggacatcatcgacacctgtcctatcgtgtcccatgctgtggtcattggcgatggcaagccgttcatcagcgctttgattgaactggatcctgatatgactcgttcttggctttcccagcagggtcttgatgccgatatgtccatgaagcaggtagcggaaaacgatgccgtgcgcgctttcgtgcagcagtatgtcgaaaaggccaacgcgaacgtttcccgtgcggaatccgtacgaaaattcgagattctcgatgaggaattcaaccaacaggacggcaccttgacggcaagcctgaaagttgttcgtcccaaggtgctgcagcgctacgcagacgtcatcgaaaacgtgatttacgcgccaaaaccctccaacaggccgttgccgaagaccgtccagattctcgaccgcaccaccgaaaccgtcaagcaggcgtcggaaagcatgcggcaggcttctgaatccgtcagcccgaaggttcggcaggcatttgataccatgcaggagagaatcaagaagcagtccgatgaaccggatgacgagacggcaccgtccgtcgagccttccgcaaccaagaacaacgaggagcgttaattttggcaatccgtgagattcgagtcgtacctgatccagtgctgcgcaccccatgcgatcccatcaaggagatcacgcccgcggtgcgccatctggtgcaggatttgttggataccgttgatgacccgggacgcgccggattgtccgccaaccaaatcggcgtgagtctgcgtgcgttttcctacaatatcgacggcaaaatcggctatgtgcttaacccggtgttggaggaggccagcggagagcaatatggcgatgaaggctgcctttccgttccaggattgtggtacaagactcgtcgcgccgattatgctcgcgtgcggggcattgatctggacggcaagccggtagtgttggaaggccatggcatcatgggccgcatgctgcagcacgagactgatcatttggacggtcacgtctatcttgatcgtctggaaaaggaagaacgccgcgaggcgatgcgttacatgcgcacccatcgcaagtgatcgaaacagcgaacgacgattcaaccatggggccacgtcagaaagacgtggccccatggtatttttagtatttgtgcgccaatttggtgagaagcgctgccgcgagtgcttcaaaccgcccaattattgtcaaccggtgcgcaaccaattcgcgtcatgctcgcgacgacctgtgtcggtcggctgatgcctgcaaggcattggctgcacgcaggaacgcatgaccaggcaagaaccgacaaagaaagaggtagcaataccatggctcagatcactatgagcgacatgctgaaggcaggcctgcacttcggccaccagacccgtcgttggaacccgaagatgaagcagttcatcctcacccagcgcaacggcatccacatcatcaacctgttcaagtcgctcgacatgatcgacaaggcctacgacttcatcaaggccactgttgcccacaacggcaccgtgctgttcgtcggcaccaagaagcaggctcaggaagctgtttccgctcaggccacccgcgtgaacatgccgtatgtctccgagcgttggctcggcggcatgctgaccaacttccagaccgtgtccaagcgcgtctcccgcctcaaggaacttgaggaaatggacttcaccgacgtgcacggctccggtctgaccaagaaggagctgctgctcctcgagcgtgagaaggacaagctggctaagcagctgggcggtatccgcaacatgaaccgcaccccgtccgccatgttcgtggtcgatgtgaacaaggaagctctggccgtcgaggaagcccacaagctgggcattccggttgtcgccatcgtcgacaccaacgccgatccggaatccgttgagtatccgatcgccgccaacgatgacgccatccgcggcatcgaactgctgaccagcctcatggctgacgcagtggccgaaggtctgctggagcgttccggcaaggccgccaaggccgaaggcgaagccgagcagccgatggctgcttgggaaaaggagctcctcaccgagggcgctccggcagctgaagccccggctgaggctgaaggcgaaaccaaggccgagtgagaccatgctctatgatgggaggtgctatgcctcccatcatcggggcatcaccaaattttcagaggagacaaatcaatggcagcaatcactgcagctctgatcaagcaggtgcgcgaggaaaccggcgccggcatgatggacgtcaagaaggccctgaccgaagccgaaggcgatgtggctcgcgccaaggaaatcatccgcgccaagggcatccaggccgctggcaagcgtgaaggccgcaaggctcaggaaggcaccatcgcctccaccgttgtcgaatccgccaacggccagaccggctatgcggtcgagctgaactccgagaccgacttcgtggccaagaccccgaagttcgtggaattcgccggcagcgtgctcgatgacgccgtcaaggccgaagcatcctccgtggatgaggttctggcagcagcctccggtgacaccaccgtgaaggaagccgtcgaggaagccgctgctctgttcggtgagcacgtcaaggtaggccagttcgccaaggtcgagggtccgcatgtcgaggtctacgcccacaagaagtccgctgagatgccgccgagcatcgtggccatgattgccaccgatgaagccggcgctgctgtggctcatgaggccgctctgcagatttccgcgatgggcgcccagtggctgacccgcgaggatgttccggctgatgtgctggaatccgagcgtcgcgtggccaccgagaagaccacggaggagctcaagagcaagggcaagccggaggccgtgatcgagaagatcgctccgaagatcgtggaaggccgtctcggcgcattctacaaggagaccgtgctgcttgagcaggcgtacgtcaaggatccgtccaagaccgtcggcgacctgttcaaggaagtcgggggaaccgcgctttccttcgctcgtgtggaggtcggcaagggcgacgccgagtgaatctgatgtgaattgagctcacgctttcgaacgtgggcttggcatatctccaatgtccgcaatccaacaggattgcggacatttttttgcactaaaccccatcgtgttttggtgtctgtgtttgccgatagtcttgaaaacggtaaatttcatgggttttcgggtaagaaaggcatttcatgactggcgaaaacactggcgacaatccccgcagggtactgctcaagctgtccggagaggcattcggcggaggcaaagtcggcatcgacaccaccgtcgttcgtcgtattgcggaggaaatcgttcccgcggtcaagcaaggtgtgcaggtcgccatcgttgttggtggcggcaacttcttccgtggcgccgaactgcagcaggccggcatcgatcgttcccgcggcgactatatgggcatgctgggaacggtgatgaactgcctcgctctgcaggatttcctcgagcaggagggacaggccacgcgcgtgcaaaccgccatcaccatgggacaggtcgccgagccgtacattccgcttaaggccattcgtcatctggaaaagggacgcgtggtgattttcggcgccggagcaggcatgccgtatttctccactgacaccgtgtccatccagcgttctctggaaatccactgcgatgaggtgctgatgggcaagaacggcgtggacggcgtatacactgccgatccgcgcaaagacgagaacgccaagcgcttcgccacgttgagctataaccgtgcattggtcgacaatcttgcggtcatggatgctgcggcgctttccatggcgcgggacaacaagcagcgtatccgtgtcttcggactcgagggcgccggcaatgtgacccaggctttgctgggcgaggagatcggcaccatggtttccaccgcggaatccaccctcgccgagtgacgacattcaaagccgaatatcgattaaaccaacaatattaaaggagcaaacaatggcaactatcgtcgatcaggccaaggcgcagatggccaagtccgtggaatccaccaaggagaacttctccggtattcgcaccggtcgtgcgaatccggcgctgcttaacggcatcaccgttgactattacggcgcaccgaccccgctgaaggccgttgccaccatcggtgttccggagccgcgcaccttggcggtcactcctttcgatgcgtcccaggccaacgccgtggagaaggcgcttcgtgattccgatctcggagccagcccccgtcgcgacggcaacgtcattcgcctgaccatgccggagctgaccgaagagcgtcgcaaggaatatgtcaagattgccaagggcaaggctgaagacggcaaggtcgcggtgcgcaacattcgtcgcaaggccaaggaatcccttgacaaggccatcaaagacggcgacatgggcgaggacgaaggcgatcgtctgctcaaggaactcgacaaggtcaccaagcagaccaccgacgagcttgacgctctgctggaaaccaagcagaaggagatcatggaggtctgattccttcgaatctccataatcatcaatcgacgcacggtaccacaggagagaccacgatggaaaaacaggagcaacgcgaaaaagaagccgaagaggccattaacgccatcaacaagaaaaccggacgcaacatgccgcaggccatcgccacggcggtcgtcctgatcgccatcatcttggcatgcctgttgatcagcgttgatttgttcgtctatcttgtcgtgctgttcatggtgctcgcattgtgggagctgcgcgtcgatttcgccaccgcgggattgcatattcccgtggtggcgctgtgggcatgttccgcggtgactttgctggccacctactacagtaagcatcatattgtggctatgacggtctgtgtactggcctccttgctgcttgtagcgatcgccgcaagtgccaaggtgacgttcggcagtcggctttccctggccgtggcggacaaactgtcgcacaccgatgcaggtgctcgtctcgaatcgtcgttcaatcatgaacagggtgaagtgcgccacagccgactgagccatgtggcagtctccatgttcaccgttctgtacattccgctgcttgcctcctgcctgatcatgccgttgacgttcaacggtcatccggtggcacatgccatcatgcttgtcttcatgcccgcgctgagtgacaccggtggtctgtttgcaggtgcatggcttggcaaacataaactcagtccccgtatctcaccgaagaaatcatgggagggcctggcaggatccatcttgtttgccatggccggttcttttgtggtgatgttttgcacttacgagccatccgtttggacggttcgatggtgggtgcctattgtcgctggtttcatgatcggtatagccggaaccttcggcgacctatgcgcttccatgctgaagcgtgacattggtattaaggatatgggccatctgcttaaaggtcatggcggagtgatggatcgtgtcgactccatcctcctgtgcgctcctttcgtgtgcgtgctcctgtgggccaccggaatgtgagaaagggccaataaccgtgaattccatgaatgatcagccggaaacaggcatcactcctggaggcacttcgggcgccttccgggatgtgctgtcgaaagaccatgcccgccgtggcaagccgccactgcatttcgccgatatgtccgaagaggaacgtatcggtaaggccaaggaacttggattgccgaaattcagggtcaaacagctggctaatcattactatggccatttcgatgtcaatgcggaagaattttccgattttccggcggcaagacgctccgacgcggctgaagctttcttcccggaactcatccatgaggtgacacgccaagtcgccgatggaggcaccaccatcaaaacgttgtggcgcctgtttgatgggtcgctgatcgaatccgtattgatgcgttatcccaccagaaccacgctttgcatttccagccaggtcggctgcggcatgggttgcccattctgcgccactggacaactgggactgaccaggaacatgtccgcaggtgaaatcgttgagcaggttcgtgtggccgcgaaggccatgcgtgacggtgaagtggccggaggctccggacgactgagcaacatcgtgttcatgggcatgggcgaaccaatgggcaactataaatccgtcttgagcgcagtccgccaaattagttccatgcctcccgaaggcttcggcatctccgcacgtaacatcacggtttccaccgttggcgtggtgcctggcatcaggaaactggccgaagaaggcatcccagtacgtctcgcagtatccctgcacgcgccgagcgatgaattgcgcgatgaacttgtgcccatgaacaagcgtttcaacaccaaacaggtgctcgacgctgcgcatgattattatctggcttccaaacggcgagtcagcatcgaatacgccttgatgcgcggcatcaacgaccaggcggaacatgccaaattgctggcgaagcgtctgaaccactatggagatgattgggcgcatgtcaatccgattccgctcaatccgatcgagggatcgaagtggaccgcgtccaaaccagaagacgagcgtagattccttgagattctccataacgctggcatcacagccacactgcgtgataccagaggacaggacattgatggcgcatgcggacagcttgcagccaaagaacgtgactgattcctccgaaaggcccggttctgtccgctactcggaatccgcatgaaccgacgtaacgtattgcggttactcttgcaatcattgcaaccgttatgcgtgaaggagtagagcagcatgtcactggcggtccgagtcattccatgtcttgatgtcgatgcgggacgagtggtcaaaggcgtgcatttcgagaatcttcgcgatgcaggagacccggtcgaactcgccgcggaatactaccgccagggcgcggacgaactgacgttccttgatgtgacggcgtcaagctcccataggcagaccatggtcgatgtggtgagccgcaccgccgaacagatttttattccactgactgtcggcggcggcgtacgtacccctgaagacgtcgattccctgcttcgttgcggtgcggataaggtcggcgtcaacaccgcggccatcaatgaccctaccctcatcagtcgtgtcgccgaacgattcggcaatcaggtgcttgtgctgtccgtcgatgcacgtcgcgaacagggagaacgacatacgcagtcaggtttcgaagtcaccaccatgggcgggcgcaaatccactggcattgacgccatttggtgggtcaagcgcgcccaagaacttggtgcgggggagattctccttaattcaatggatgccgatggcacccaacaaggcttcgatctggagatgatcaaagctgtccgcaaggaagtcaaaatcccgattatcgcttctggcggcgccggcaaagcctcggattttccgccggcaatcgaggcgggcgccgatgccgtgctcgctgcctcgattttccattacggcaaagtcaccattggtgaagtcaaagacgccatcaaggcagccggatacaccgtacgctgaatagaaccacggaaactacgcaaaccaaccctgtagtactgaacaacgaatcgcaataccatcatgaccaacgaagcatacgacaacaccaccactctcgacccgcgcatcgcacagcgtctcaagcacgatgacaaaggcttggtcgcggccgtcatccagcagttcgataccaaagaggtactgatggtcggctatatgaacgacgaagccatcagacgtaccctcaccaccggacgcgtcacattctggtcgaggtccaggcaggagtattggcgtaagggcgatacgtcgggacatgcccagtatgtgaagtccttcgcgctggattgcgatggagatgccattctggtagaagttgaccaagtgggagcggcttgccataccggcaaacgttcctgttttgaagaaggcggacagctgcctgtggtcgtgggccatcgaaccaaagaacaggagggtcagcggtgagcgaatgcagcgtacagaccctcaagtggggtgctacatggccaagccgtgagcagttccatgaattggccgaccaaggctaccgtgtcatccccatcgtacgtcgtttgctggctgattcattgaccccagtcggcttctacgagcgtctcgcaggaggccgttccggtacgttcatcctcgaatcggctgaatttggcggagcgtggagtcgatacagcttcatcggcgtgcattccatagcgcagctgcgttcgaacaacggcaaagccgattggctgggacaggtgcctgtcggagtgcccaccgacggtgatgttgtcgaagtggcacatgccgcgctgaagacattgaaggctccgcacgtcgagggattgccgaatctgaccagtggcctcgttggtactgtcggatgggattccatccgacattgggaaccgacgctccgtgccgaagccccgaatgagaccggacagccggaaaccgttctggctctcgccacggacatcgcagtagtcgaccacgtgtctggctcggtatggctgattgccaatgctgtgaatgtcgatgaccgtccgactcgtgccgatgccgcctacgatgaagcgctggcacgtctggatgatatgcagcgcaaggctgccgcacccgtcgaaaacgaagcccgggtcaatgtgctcgacgagtcggtcggccagccccaactgcgattccgcacggagaaaagcgattacgaacgttccgttgaagaggccaaacgccatatcatcgatggcgatgtgttccaagtggtcatttcgcagcgactggatattgattctcccgccgatccgtttgatgtgtatcgtgtgctgcgtaccctcaatccgagcccgtacatgtatttcatggcactcaccgatgctcaaggacgtgatttcaacgtcatcggttccagcccggaaacactgatcaaggtggacaacggccatgccatgtctttcccaatcgccggttccagaccacgaggcgccactcctgaggaagatgaacgtctcgccaaggaactattggcagacccgaaggaacgcagcgagcatatcatgctggtcgatctggcccgcaacgatctgagccgcgtgtgccgtccggaaagcgtcgaagtcgtttccttgatggacatcaaacggttcagccatatcatgcacatctgctcaactgttaccgggcaggtcgatccgcatatgacggcgttcgacgtgttcacttccgccttccccgcggggacgctgtccggagcgccgaagccgcgcgccatcgagattatcgatgaacttgagccggccgaccgtggtatttacggcggcaccgtcggttattttgatttttcaggcaacctcgatatggccatcgccattcgaactgcattcattcgcgaccatgaagcgagcgtgcaggccggagctggaatcgtcctcgattccgtgccggccagtgagtggcaggagactcgcaacaaggccgaagccagcgttgaagcggtacagatcgccgcgcagcttcgccagttgtgagtcacattctgaccgttcaattgtgttgtgaaaggaagcagtaatgtctgtgctcgatgaattggtggcgggagccgtcgaggatcagcgatcaagagaaaacaacgtgccgctcgctgaggtcaagcggatggcgttcgaggcttcagcgccaatcgatgcgcgccagtggctgaaaaaggcggatggcattccggtcatcgccgagatcaagcgtgcctccccatccaaaggccatttgagcgatattccggatccggccgctttggcccgcgaatacgagcagggaggtgcaagcgcgatttccgtgctgactgaaggccgtcggttccttggctctcttgaagatttcgacaaggtgcgcgccgcagtgaggattcccgtgctgcgcaaggatttcatcgttaccgaatatcagatttgggaagcacgtgcgcatggtgccgatctggtgctgctcatcgtcgccgcattggacgacgtcaagctcaagtcgctgctcgatctcgcgcatagcctcaatatgacggtgctggtggaaacacacacccgtgaggagattcaacgggccatcaatgccggggccaaggtcattggcatcaacgcccgcaatcttaaagacctcaaggtggatgtgaacaagtacaacgaactggccgcggatttgccggacgatgtgattcgcgtggcggaatccggtgtgttcggttcggttgagcttgaggattacgcccgtgccggcgcggatgcggtgctggtgggagaaggcgtggccaccgcggccaaccatgagcaggcagtggaacgattagtaaaggcaggagcaagagtgaaggcatccgaacagaccccgttggcaagccatgaaggaccatatttcggacagtttggcggacgctatgttccggaagcgctgatcacggcgctcgacgagcttgaacgcgtgtatacggaagccaaggccgatccggaattccataaggaattggcgcggttgaaccagcagtatgttggacgtccgtccccattgactgaagcgcctcgtttcgcgcagaggctcaaggagaaaaccggtcttgatgcccgtgtgttcctcaagcgtgaagacctgaaccacaccggcgcccacaagatcaacaacgcgcttggacaggccctactggtcaagcgcatgggcaaaacccgtgtgatcgccgaaaccggtgcaggccagcatggtgtggccactgccacggtctgtgccatgctgggactcaagtgccgcatctacatgggacagatcgatgcccgccgtcaggcgctgaacgttgcccgcatgcgcatgcttggcgcggaggtcgtcgaagtcaccttgggtgatcgcatcctcaaggacgccatcaacgaggcgctgcgcgactgggtcaccaacgtcaaagacacccattatctgctcggcacggtcgcaggacctcatccgttcccatccatggtgcgcgacttccaaaagatcatcggagaggaagcgaaacagcagctgcaggattggtatggcatcgaccatcccgatgctatctgcgcatgcgtcggcggcggctccaatgccatcggcatcatgaacgccttcctcgatgacgaacgagtgaacctgtacggttacgaggccggcggtaacgggcccgaatccggtcgccatgccattcgattcgcgccaggtaccggtgaactgggcatgttccaaggagccaagagctatctgttggaaaaccccgaaggccagacccttgacacgtactccatctccgcaggcttggattacgcctccgtcggccccgaacatgcatggctcaaggatatcggccgcgtcaactattcctgggccactgatcaggaagccatgagcgcgttcaaggatctgtgcgaaaccgaaggcatcatccctgccatcgaaagctcccacgcagtggccggcgcgtacaaggcagctgcagacctcaaggccaaagggtatgagcatccggtcatgatcatcaacatctctggccgtggagacaaggacatgaacaccgccggcaaatggttcggatacctgaccgacgagcaggccaaagccttggaatccaacggcgcgcaaggcaacaacgcggacggcgagtgagaaaaggagcaaccatcatgacgaacgcaacatcatccacgccgtccggccagccactcggcatcagccacaagccaagcccgacggaaaccatgttcgatgaattcaaagccgccgacaagccggcattcatcggatatctgccatacggattccctgatccggattattcgctcaaagctttccgcaccatggtcgaacacggcgtgaacgcggtcgaaatcgggctgccgtattccgaccccgtcatggacggtcccgtcatccaggcggcatcgcaaatcgccatcgacaatggtgaaaaaatcgccaacgtattcaaagcggtggaaacagtggcgaacgccgggggagtgccattggtcatgagctattggaacctcatcttccattacggcgtcgaacgattcgcacgtgatttcgaaaacgccggtggagccggtctcatcaccccggatctcattccggacgaggccggcgagtggatcgaagcctccgaccgtcacggactcgaccgcatcttcctggtatctccggattccaccgaagaccgtctgaaagtcgttgcggacaatgcgcggggtttcgtctatgctgccgcccgcatgggcgtcaccggagaacgctccaccatcgatgcatccccgaaggaactggtcgcccgtacccgcaaggccggtgcgaaaaacgtgtgcgtaggcatcggcgtgtccaccgcggaacagggggctcgtgtcggatcgtatgcggacggtgtcatcgtaggctcggctctggtgcataccatgattgacgaatccggcaagcatgcagtcgacgaagccaccggtctcaaggccttggcggcgaagactgaggagcttgccgaaggcatccacaacgcccgcaactgaaccagtccaaagacaacatactggtagtccacgtaccatatcgtatacgtggactaccatcaggaaaccatgacacttgcttacattccgtcacccaccatttcgcagttttccatcgggccggtgaccatccatttctacgcgctgtgcattctgctcggcatcgtgctggcggtatggatgacaaccgttcattggaaacgatatggcggtaatttcgatcagattctcgacatcacgcttgtcgcggtgccgagcggcatcatcggtgcgcgtatataccacatcatcaccactccggaacgtttcttcggaccgaccggcgattgggtggagatgttccgcatctggaatggcggactgggcatctggggcggcgtcctgcttggagcgcttgccgcttgggcatggtgtcgtcacaagcattatccaatggctctgctcggtgacgccgtcgcgccaggattgctcgtggcgcaggccgtgggacgtctgggcaactggttcaaccaagagctctacggcgcgccgacgaccttgccttggggtttgaagttgaatatggagggaagcgccatcggtcacagcgaacaatgctatgacggagcgacctgcccgacaggcacgctgttccaccccaccttcctgtatgagatgatttggaatctcatcggtgctgcgctcatcgttttccttggttccaaaatcatgaaaaaactcaaggccgggtccttgttcgccatatacatcatgtggtacacggtgggacgcacttggatcgaggctctgcgcattgatttcgcgcacgagttccttggcgtgcgcatcaacgtatgggtgtccatggcggtgttcgtgcttggcgtggtggctttcatcgttattcagcagatgggaaagtccaccgagctgcttgccgagaagttgcgcaccgtcaccgagattgagctaagcctcgtcgaggatggagaaaccggtctcccgaccgcgaaggccaaccttacgaaaaccaaggatgaaatcacggcaaacgatggctcatccgtctcatatgccgatgaccagtccgacaacaagtaacatcaagtcgattaccttccatagaatgagaaccatgactattcaaatcgcacctagcatcctgtccgctgacttctgcaatctggaacgtgaccttaaggccatttccaacgccgatctcgttcacgtggacgtgatggaccatcatttcgttccgaatctgacgttgggtgagccgattgtagctcgcatctgccaagtcactgaccttccggtcgacgtgcatctgatgatcgaggatccggaccgttgggctccggaatacgccaagcttggtgcggcttccgtcagcttccatatgggagcgacgcatgctccggttcgtcttgcgcgtcagctgcgcgacatgggctgcaaggcttgcttcgcggtccgtccggccgaaccggtcgagccgatcttcgacatccttgacgaattcgacatggtgcttatcatgacggtcgaaccgggcttcggcggtcagaagttccttgacaaccagatgaccaaggttcgtcgtctgcgtgacgaaatcacccgccgtggcctgaagacgaagatccaggtcgatggtggcgtgagccccaagaccgcccatatcgttgccgaagccggtgccgatgtgctggtcgccggttccgccgtgtacggtgccgagaatccggccgaggctatcgactccatccgcgagaaggccgaagcagccttcaaggcgtgaacgcccaccatacaaggaagcatacgaatatgaagacttttgaatcgctgttcgcggaattgagcgagaaagccgccaccaagcaggccggttccctgaccgtcgacgagcttgccaaaggcacgcacttcatcggcaagaagatcgtcgaagaggctggagagacttggatcgccgccgaatatgagggtgctgatcgcacggccgaagaaatgagccagctcatctaccatctgcaggtcatgatgatcgatcgtggcatcacactcgaggacatctacaagaacctgtgagaaacccggggccatgccagttgaaggtgtggccttttttagaggagaaacatgctaagaatcgctgtgcctaataagggcatgctgtccgaacccgcctggaacatgctggcggaagccggctaccgtttgaggagcaaccctcgccagttggtcgtggaggatcccgacaatgatgttgagttgttctacctgcgtcccctcgacattgcggtctatgtcggtcgcggcaccatcgacgttggaatcaccgggcatgatttgctcgtgaactccggcaccgatgcggaggagcatatgcagcttggcttcggagcctccacgttccgtttcgcagccccgaacgattcgccgattaccaagcttgaggatattgaaggcaagcgagtcgccaccacattcgacaagctcgtacacgactatctggtcgagcatggcatcaacgcggaaaccgtgcaccttgacggcgccgtcgaatcgtccgtccagcttggcgtcgccgatctgatcgccgatgtggtttccacagggaccactctgcgtaatgcgggactgcgcattttcgctgaaccgctgatgcactctgaagccgtattgattcgttcccctcgtcttgaggcggatgacgagcgtctgacgattctgagcaggcgtctgcaaggcgtgctcactgcccagcgtaatgtgcttatggactacgacattccggtcgagaaggtgtccgccgcagtggatatcactccgggtttcgaaagcccgacgatttcgcctctgcatgataagcagtgggcggccgtgcgtgtggtggttccgaaggcgaaggtgaaccagcttatggaccagttgtatgaagttggtgcccgtggcataatagtcaccgcgttgcaggcttcgagaatgtagtgttgctcgtaatatgagcaaactgattattaagaagcaatacagtccggaaccgcgagacatctatttcacggttccgaacttcatcagcctgttgagaatcatttcgattccttttatcgcgatgctggtctctcatcacaggatggtgaccgccttggtcgtgcttgcgctatcggcgatatccgatggtttggacggactgatcgccagatcattcaatcaggtgagcaaaatcgggcaaattctcgatccgattgccgatcgtctgctgatcttctgcagcattcttgctttgggtgtggcgaacatcattccatggtggatgctgatcgtcgtcggcctgcgagatttgatcatggctgttctgatactggttttggcgcagcacgattatggcccattgcctgttcatttcgtaggcaaggccggtaccgcgatgctgcttatcgccatcgtcgcgttgatcttcgccgacatctggtccaactccgctgcggatacactgcatctatgcggtcttgccaccggaatctggggcgttggactgtattggcttgcagggtacatctacatgcgccaaggcatccaactgttgaagaacgatacaaacagcaaggattgacgcatatatgaagtccgatgctccacgtttcgcgtcgttccccgtttccccggagaacgtacccacaaagcatcgtgccattttttcgtcatccttcgccggcctgtcatcccatcatgtgcaaccggcctccatgcccgccatgccgcaacgccatagacatgtcgatgacgattcgcttcggcttattgacgatttgaccaatcgtccgatggacgtcctgtattcggactcccgcctggccactaaaaaacgttcggcggtttcgatttgggccaccaggattctggtgttcctcatctgcatcgctgtgggtgccgcgggaagcgttttcgtgcgccagctgagcactgacccacgcaaagaagtacgcaagcagttggcaagccagctgaccgaacaaacgaagcgggtcggcgacctcaccaaggacgtcaacgacttgcggtcgcaaatcgaatctgaatcggaatccttggcaagctggtccctaaaccagacgatgcaggatgatgaaatggtcaatggaacgcttccggtgcaaggggaaggcattgtcctgaccgtagccaacccgctttccgtcagcggcgacaatgccgactcctcactgccaagagaaaatggcagccaggttcgagtcgtcaccgattccgatttgcagctgcttgtctccttgctatggcaatccggagcggaggcgatcgcgatcaacggcaaccgccttggcgtgcaaacctcgattcgaactgccggatcgacgattctcatcggagtcaattcggtgcaaagcccatatcgaatcgaggcgataggcaatcaggcgaccttggcgaaatcggtaagcaagacaacgcagaaacaactgtatgacgatttcaaaaaggccggcatctatccgcagataagcaaaagcaaatcgattacacttgatgctgcagtggctggcgacacgacgcatgtgaggaaggacaagtaatggcagctgtcttgggacttatcatcggcgtggtaatcggtgtattcgttcgtccggacatccccatcgagctccaaccgtatctgccgattatggtattggccgcgttggatgcgttgctaggcgccgcacgcgcgtatttccaacgcagcttttccgataaagtgttcgtgatctccttcttctcgaatgtcatcaccgcgacgctgctggtgttcctcggcaaccagttgggagtcggctcccagctgcagaccgcagtgatcgtagtgctcggcatacgaatctttaccaatgtgtcctccattcgacgcttcatctttaaaggttgatgcggtatgagcggacaagacgcgaacagcaaggacatgctgtccagaatccatgagcagagggtcaaggaccagaacaatgacagcacccaaaccggtgcgttccccatggtcaaggccaagaagcgaatctcacttgatgcgaaggtcacacgaacccgactgtattccagcattctggtcacgatattgtgcgccttgcttggcttcggctatgtgatccagataaacaacacgacatccacctatgagacgatgagcgaagatgaattaaccaagctcatcagcgagaccaatgctcaggtccaaaagctcgaacagcgtaagaacgaactctccagccagctgaacgctttgaaagacaccgcggacaaaaatgagaaagccgcggaaatcgccaagcagaacgcgcagaccaacggcatcctatccggccgtctcgcggctacgggagaaggcgtggtcatccgcatatcgcagggttccaaacagaagattgactccgcgatattgttcacgttgcttgaggaattgcgcaacagtggtgccgaggtcattgagatcaacaatgtccgcgtggtaaccagcacttacatcagtggcacggccggcagtctcgtctgcgatggcaccaaactgaaatccccattcaccattcgcgcgatcggcgacagcgacaatctgcagaacgcggtcaatctggccggtggcgtcgggtcgcggctcaaagtgaagtatggcgctacggtatcggtcagcccctctgacaaagtgatgatcaagtccacacgtcaggctccgcagtatacatatgcgcacgtcatcggacagtaaacagtaaaggacctttcctttcgcgacattcaatcagcgttgttcttccgttcaccgaaatggcgtgccgttgtctgcgcttgaccctatcttgttcatcgttgatatatagtccaggcctgcacattggtaacgcggaccccgatagcaaaggacaactcatggctgaacagaccatctccatcacactcaacggcgaaaagaaggaggtggcggcagaccagaccggcgtccagctcttctccgacgacaagaacatcatcgcggtgcgtttgaacggcgaaccccgcgatctctataccgagctgcacgacggcgacgttgtggaacccatcgcgctcgatagcgaggacggtgtggccatcatgcgccattccgcaacccatgtcatggcccaggccgtgcaggagattcgccctgacgccaagcttggtgttggaccggtcatcaaagacggcttctactacgatttcgatgtcgagactcctttcactccggaggacctcaaggaaatcgaaaagcgcatgcagcgcattatcaagttctcccagtccttccgccgccgcgtggtgaccgaggaagaggctcttgccgaggaagccgaccagccctacaagcttgaacttatcaaggataaggaagcgcatcttgacccggaagccgccaccgaaatcagcggcaaggaactgagcttctacgataacgtcgaccgtgaaggcaatgtggtttggaaggacctgtgccgtggtccgcacctgccgaacacccgttacatcaaggcgttcaagatcgagcgttccgccgccgcatactggcgcggcagcgaggccaatccgatgctgcagcgcatttacggcgccgccttcgccaccaaggaggacctgaaggcataccagacccgtctggaggaggccgccaagcgcgaccaccgcaagctcggcgcggaaatggacctgttctccttcccggatgagatcggtccgggccttgccgtcttccatccgaagggcgcggccgtcatcaacgccatggaggactattcccgtgagatgcaccgcaagcaccactacagcttcgtgcagaccccgcacatcaccaagggcggcctgtatgagacctccggccacctgcagtggtacaaggacagcatgtatccgccgatgcgtctggacgaggagaaggacgagaacggcaacgtcatcaagcaaggcttcgattactacctgaaaccgatgaactgcccgatgcacaacctgatcttcaagtcccgccagcgttcctaccgtgagctgccgctgcgcctgttcgaattcggcaccgtgtaccgttatgagaagtccggtgaagtgcatggcctgacccgcgtgcgcggcttgactcaggatgattcccacatctactgcacccgcgagcagatgaaggacgagcttaagagcctgcttaccttcgtgctcggcctgttgaaggacttcggtctggatgacttctatctggagctgtccaccaaggatccgcacaagtacgtcggttccgacgagatttgggaggaagccaccaacacgctggccgaggtcgccaaggaatccggtttggacttggtcgacgatccgtgcggcgcagccttctacggtccgaagatctccgtgcaggcccgtgacgccatcggacgtacctggcaggtgtccaccatccagctcgacttcaaccttccggaacgtttcaagctcgaatacatcgccgccgatggcacgcaccagcgtccggtgatgatccaccgcgcgctgttcggctccatcgaacgcttcttcgcggtgctgcttgagcattacgcgggcgccttcccggcgtggctcgccccggtccaggtgcttggcgtgccggtcgcggacgagttcgccccgcacctgcagaagttcatcgccagcttggaagaggagaccgtccgttgcgagatcgacctgtccgacgatcgcttcggcaagaagatccgcaacgcatccaagtccaaggcgccgttcatcctcatcgtcggcgaagaggatatgaacaacaacgcggtcagcttccgcttccgcgacggcagccagttgaacggcgtgccggtcgatgaggcgaaggcgaacattctgaccgtaatcaagaagcgcgtccaggtcaacaccgcagacgacttcaaggccgccctcgccgactgagcgagaccggtggcaacaagtcgcacgcgaccatgaaccgtgaaacggcgcacgaatctcgacaagaggtttgtgcgccgtttctcattttctcatcgagaaggaagtaacacatgcttgagcatcttcgtgcgccgttcaaaaaactcatcgagccaatagccaaagcgttgatcgccataggactgaccgccaatgcggtgacggtgattggtgctgtcggcaccatcgtcgtggccatcgccaccggtgtgaccggatggctatttgggggagcggttgttctgactctgcttgtgcttgccgattcgttggatggctcgatcgccgcgcttaccacgggtgggaccgaattcggggcttttctcgactccacgctcgatcgcatcgctgattgggcgatgctcgtaggcgtgatcatcttctttcttatgcatcgtgactggtggcatacggccatcgacaacacgcctgactatacgagcatgatcggtatcgccgccgccgcggtggccgtgatgacatcgttcgtcacttcatatgcccgtgctcgtgccgaatcagtcggctatgaggtgaaaaacggcatcgccactcgtgccgatcgcttgaccatcattctggtgggcatggccatcaccggattgacgcgtcagggattgtggctcgccatcgccatgatactgttggccggattgggattagtcaccgtattccaacgcatcttcgaagccaagcgccaaatggtcataggggagaaaacatatcggcggtagtcacagccgggggcagaccccatccaaaagttcgaaaagcgaaatgccacaggttcgtattcggcattttgtcggcgaaccgctttagaatcatttcgtttgaaacatccgcaacctgcctaggagcattatgtcaggtcattccaagtgggcgaccaccaagcacaagaaggccgccatcgacgcgaagcgcggcaagctgttcgccaagctgatcaagaacatcgagatcgcagcacgtatgggtggcggcgatcccgacggcaacccgtccctgtatgacgccatctacaaggccaagaaggcctccatgccggccgacaacatcaagcgcgccgtcaagcgtggttccggtgaggaagccggcggcgccaactatgaagacatcgtgtacgagggttacgccccggcaggtgttggcctgatcatcgaatgcctcaccgacaaccgcaaccgtgcggccgccgacgtgcgttccaccctgaccaagggcaatggctccctggccaccactggttccgtgagcttcaacttcgaacgcaagggacagatcgttgttccggccgaaggcgttgacttcgacaacctgttcgagaaggccgccgaagccggtgccgaagacgtgaccgacgatggtgaggtattcaccgtcatcaccgatccgtccgacatgatcgacgtgcgcaaggctctccaggacgccggtttcgattacgattccgctgatctggtcatgatgccgaagaacgaggtcgagctgagccttgaggatgcccagaaggtctccaagctcatcgacaacctcgatgatctggacgatgtccagaacatctactccaactggaccgcctccgacgaggtcatggcccagcttgacgaggagtaatccagcgtgattattcttggcgtcgaccccgggctgactcgctgcggggtcggcgtgattgaagccggcgcataccgccggctttcttttatccacgtggatgtggtgcgttccgatccaaaaacctcccaggatctgcgtctgctggccatctacaacggcttggtggaaaaaatcgaacgatttgctcccgatgcggtgtccatcgaacgagtgttcgcgcaagaaaaccgtaacacggtgctgggaaccgcacaggcggcagggttggcgatgctcgctgcggcgcaacgcggcattcctgtggcgttgcatacgccgacggaatcaaagcttgcaatcaccggcaacggcaaagcagagaaaatccagatggaacgtatggtggcgcggatattgggattgaacacgctgccaaagccggctgatgcggctgacgcgctggctattgcgatctgtcacgcgttgcgtccggctggtgcgctgcaaggcggcgaacgcgaacagcatctcacggcggcgcaacgacagtgggcgcaggcttcgcaaaaagcagcgcgcagacaaggcgtccgcagaggcatgtaagctgtatcgaacagatgttctagacctgtgcgaaggagacgtccataatgattggcatgctacgtggccatgtggagtcggtagacgccgtatcggccattatcgaggtcgggggagtcggctatgaggtcaggatgccatccgccgacttggcttccatgcacgccggccaggaaatcaaggtctacacttcgttgaatgtgtcccaggacgccatcactttattcggcttcggcacgctggcctcgaaacgcatgttcctgcaattgcagaaggtcagtggcatcggaccgaaagtcgcgctatcgttgctgtccactttgcctcccgatcgacttgcgagggctgtggcggatggtgatgccactgcgttggccaaggctccgggattaggcaagaaaggcgcgcagaaaatcatcctcgaactgaaaggttccattgatctgagccagattgagggttcttccgcaaccgcttcgactcctgaagacactggggccgaacaggtcgtcgaaggtctgatgtctttgggatggcaccagcaggacgctgcccatgcggtgcagacggtctgcgccgataatcaaatcgagacgccgttgaacgccaaggatgttccacgcgtgctgaagctcgcgctgacatcgttggatagaggtagatgaaacggaccattatgacgaacactgatacattcgaacagccgaacaccggggcgaacgaggaatccctccgtatggtttccgccgcacccgtcggcaacgaaccggtcagcgacgaggagcttcgtcctcatatcctcgagggattcatcggacagccaaggctcaaagcgcagttgcagcttttcctcgatgctgctcgaaaacgtgacgttcctccggaccatatcctgcttgcggggcctccgggacttggcaaaaccactttggccatgattgtggccaatgaattggaagttccaatccgcgtcacttccggtcccgccatccaacatgctggtgatttggcttcgattctgagttcgctggacgccggcgaggtgctctttatcgatgagatccaccgtctgccccgtgccgccgaggaactgctgtacatcgccatggaggatttccgtgttgatgtgatggtcggcaaaggccctggagcttcatccattccgctgacattgcctcggtttacggttatcggtgctaccacgcgagagggcatgcttccctcgccgctgcgtgcgcggttcggtttcacggcgcatctggatttctacccgcatgaggagcttgaaaagctgattgagcgttcctccgcagtgttgggaatccagttggaggacggggccgctcgccaactggccatgcgttcccgcggcacgccgagaattgccaaccgcctgcttcgtcgtgttagggattgggccatcgtgcacgatctcgaatcggtgcgtcccgatgatgtcaaggaggcgttggcgctttatcagatcgataccgaaggtcttgaccgtctggatatagcagtgcttaaggccatcgtcaccaatttcaacggaggccccgtcggcttgaacaatctggcggccatggtgggcgaggagtcggaaacggtggaaacggtatgcgaaccgtatctggtacgtgagggcttcctcatccgcacgccgaaaggccgcgtggccacgcgcaaggcatgggagcatcttggtatcactcccgacgaatccgcatatgatgtcaatgagatgtcatagacttcacatcctgagtaatgtgttccggttgagaccctgactccgaggagtttattttggatatcctttttctcgttgttcttatcgttgtaatgttcggcatgatgttctggcagtccaagaaagccaagcagcagcaagctgaacgtcagaatttccgttctagtctgcagcccggcactgaagtgatcaccatcggtggcatcatcggcaaggtcgtttccgtcgatacggaatacgaggagatcgtcgttgattccgaaggatcgcaactgcgtttcggcttcaacgccatcagccgtgaatatgtccgtccggcatacgtgcatgatgatgaggtcgatgagaacggcaatccgctatccaaggaagacgagcccgaccagaagcctgtcgtcgacgcgactgaagagcccgcacaggatgccgatgttattcagcagcccattgacgagcagaagaacgattgatttctttgatttttagacggcgaaaatctcatttttgaggttttcgccgttctttttcgcacgggaaacctataattcaaagtgccgtaaaccaaggtagaaggaaaccactgtcatggcagcatcggatatcaccgtttcgggcttgaacaaagttggagccgaagacgcagcatatcttgtatcgaaaatacgtactattccgggctttccgaaggagggcatcctattccgcgatttcatgccggtgttggctgatgcgcgcgcgttcggtattttgatgggggcccttgaagcggcattgccagtagacgtcgatgatttcgacatggtcgtcggccttgaagcccgtggattcctgttcggtccagcgttggccgcccgtctcggaaaggggtttatcgcggtccgtaaagccggcaaattgcctccagaaaccatgtcgcaaagctatgacctcgaatatggtcaggcgtcaatggaaatcgaaaccaacgttgtccatgagggagtgcgcgtattgatcgtcgacgatctgatcgccaccggtggaaccgccaatgcggcgcgtagcctcatcgagaagtgcggaggcgtcgttgctggattcagcttcgtcatggaacttaccggtattgacggcatgaaatcgctaggcgattatccgacaagctcgctggtgtgcatgcctgcctgataactccgttttcgtcaaccattcagaacaaacaaccaaagggaatgatccatggatctctatgagtatcaagccagggaattgctcgaagaacagggtatcccgactcctaaggcaatattcgcccagaactcccatgaagtcgccgaagcggccgaccagattggatatcccaatgtgattaaggcgcaggtgaagattggacaccgtggccaggccggcggagtcaagctcgccaagacccgtgacgagtccattctcgcgtcggaagacattctgccgatgaccattcacaagcacaaggttagcggcgtgctggtggccgaggcgaagaacatccttcacgagtattacgtctccatctcagtggaccgatcctctcgtgatttcgacgtgctcgccactgcgaatggcggtactgaggttgaggaaatcgccaaagagcatccggaatccgtgaagcgtctgcatatcgatgctcttgacgatttcgatttggaagcggccaccaagatggctgaaagcatcggcttctatcatgccgatgttgatcaggccgcgcagattctgctgaaaatgtggcgttgcttcaaggagaacgacgccacgcttgtggaaatcaacccgcttgcaaaaatcggcgatccggatgacgaatcttccaagtcgttgtgcgcgctggacgccaagatctcccttgatgacaatgcatcgttccgccatgatggttggaaacgtttcaccgatccgatttatgtcgatccatatgagcaaaaagcccgcgaacatggactgcattatgtgcatctcaagggttccgtcggtgtgatcggcaatggtgcgggactcgtcatgagctctcttgacgcggtgtcaggcgcaggcgaggatcagggcacgaatgtcaagcccgcaaacttcctcgacatcggcggaggcgcttccgccgaagtgatgtcgaatagtcttggaatcgtgctgtccgacccgcaggtcgaatccgtgctcatcaatgtgtacggtggcatcacctcgtgtgaacaggtcgcgaagggcattctcgaggcgcttgacgaacttggcagcagcaagcctatcgtcgtgcgattcgatggcaatgcggcggcggaaggtctgaacattttggcccaagccggccgcgccaacctgcacgtcgctcagaccatggaggaagccgcacagcaggccgcacgtttcgcggccaaggaggttcgctgaaatgacgcttttcattgaagatggcgctccggtcatcgtccagggcatgaccgggcatcagggcatgacccacacggcccgcatgctcaaggccggcaccaacatcgtcggtggcgtgaacgcccgcaaggctgggctggacgtcaccttccctgaagccaaaaatggcgaggacgccaccattcacgtgttcgccaactgctctgaagccatcgaagccactggagccaaagcaagcgtcgtgttcgtgccgccgcgcttcgccaaggacgccgtcgttgaggccattgaagccggcatcgaactgattgtcgtcatcaccgaaggcattccggtggcggacagcgcgtatttcgtcgagttggccttgcgtaagggcgtgcgcatcgttgggccgaattgtcctggtctgttgacgctgccatcttctaaggacgccaagggctgcaacctcggcattattccagatggcatcgtgtcccgcggcccgttgggtttggtgtccaagtccggaacgttgacctatcagctgatgggggagctgtctgacatcggtttcaccgcatgccttggcgcgggcggcgatccgatcgtcggcacgaccttgcaggaggctttggaagcctttgagaacgatgaagccaccaaagccgttgtcatgatcggcgaaatcggtggcagcgccgaacaggacgctgccaagtgggcttccgaacatatgaccaagcccgtcgtggcctacatcgcgggattcaccgcgccggaaggcaagcagatgggccatgccggcgccatcgtttccggcggcaagggcaccgcgcaggataagaaagaagcccttgaggccgttggcatccgtgtcggtcgtactcccggacagaccgctgaaatcatgcgagaggtgctcgcttcccaatcgctatgatgacgaacctgaagtattggctgaaagggcttgccgtcgcggcagtgtccatgattatttacgccgttgccttgggctgctatatggccctaatgcttctggtcatatccatggaagaaggcggggacaatctctccgccttctcggtgcctcttaccgaggcgttggtgctgctcagccaaggtatcgggttcaagactgatgccatcacgttgacgattgtgccgttgctcttgacggtactgcttatcgcccttatcgcgcagctcgccagaagattcggcacgagtctgcgtggattcgcggccggtctggtcttttgggaagccgtaaacatcttcttcgccagaagcataaatatcgaaatcgttgattcgatgacgatgatcgccatcaaaacggcgcttgttttcatcctcggatatgcggtcgcggcgattccgaatgcgtcatggccccaagcctgtaccgaatggattcgatctcatgtgtcatcgccggtgcgaaagaccatggtcatcggttccgtcctagggctgctgctggaggcggcgtatctgctggtcggtctgatcgtcgttgttttttgggcaataagcaatcaatcatcgatagcgaagctatatgaactttcgggcatgcagaacgggtctcgtattcttaccacgatcagtatgctcgcatggcttccgaatctgatgatttgggctgtctcatggactttcggcgccggcttctcaatcggcgatttagccgaattcacattatggaccggacagggtgacgggctccccgccttgcctcttttcggtatgatgccacaggcggttgagacggattgggtgagaatcgcgctgatgtgcataccattggcatccgcttttgctaccggcatggtcgtcatgttgtttaataagggattccatatcagagtaggtgaatcaggacggaacatcgacgtcaaacgcgttgtgctgagttttgcctatccgattgctgctttttcgattaccagcgccgtcgtgtccgtggcttccagcttgctgttcgccttgggaaacggaggcttgggatcgaaacatcttgcgcacgtcggcgtagacgtgatcgcatcaacccgtaaggtgggacaacccaccgccatgggtttgttctccgcatggctgctgactttggtggccgtgagcatatttttcgccatacgctggatgatgaagcgtatacgcgaacgtggaaagagggagaccgcccccgaatccacggaaaacagccgtgaggaaacacgtgcgcttcgcacggtcgcctcgaacaacaataacaaggaggatcagggtgacaacaacgaatcgaccgatacgacgggctctggtatcagtcttccataaggaaggcatcgaggtacttgccgaagcgttcatcaaggcgggcaccgaggtggtttccaccggttccaccgcgaagcgtctggctgagctgggtgtcaaagtgaccgaggtctccgaagtcactggtttcccggaatgccttgatggccgcgtcaagacccttgacccgcatatccatgccggtatcctcgccgacatgaccaaccccgaccatgcctcccagctcgagaagtttggcatcaagccgttcgatctggtggtcgtcaatctgtatccgttcgccgacacggtccgctccggagctgacgaagccgccaccatcgaaaagatcgatatcggcggtccgtccatggtgcgtggcgcagccaagaacagcgccaccgtcgccatcatcaccgatccgaacgattatgcactcgtcgcctcccgcatcgagaacggcgagggcttctcccttgatgagcgtcgctggctcgcaggaaaggcgttcgcccatacggccgcctacgacgccaccatcaacgagtggaccgcgaagcattggccgaagccggcgtccatcgaacagccggtttccgaaggcgagaccgaagtgaatgaggccaagttcccggccacgttcacccgtacgtgggaccgcgcgcacgtgctgcgttacggcgagaaccctcaccagcaggcttcgctgtatctggatccgctcaaccagaacggcttcgcacacgctgaacagcttggcggcaagccgatgagctacaacaattacgtcgatgccgacgccgcatggcgtgccgtgtgggatttcgcgcctcagatcgccgtcgcagtggtcaagcacaacaatccatgcggtctggccatcggcgctaccgtggcagaggcgcacaagaaggcgcacgcatgcgatccgatgagcgcctatggcggtgtgattgctgcgaacagcaaggtcaccatggaaatggccgaaagtgttcgtccaatcttcaccgaagtcatcgtcgcgcccgattacgacgccgatgcgcttgaactgctccagaccaagaagaagaacctgcgtatcctgaaggtgtctgagcctccgaagaccaagacccagttccgtcagattgacggcggtctgctcgtgcagtccaccgatctgattgacgctccaggcgacgatccgaacgcgtggaagctggtttccggcgagccggccgacgctgaaaccgtcagggatctggtgttcgcatggcgtgccatccggtgcgtcaaatccaacgccatacttatcgctcacgatcaggcaaccgtaggcatcggcatgggccaggtcaatcgtgtggattccgccaatctgtccgtcgagcgtgccaacacgctggctgacggagccaaccgcaccaagggagcggtggccgcgtccgacgcgttcttcccgttcgccgacggtgccgagattctgatcaacgccggtgtcaaggccatcgtccagcctggtgggtccattcgtgatgaggaagtgttcgaggcggcccgcaaggccggcgtcaccatgtatgtgaccggtacccgacacttcttccactgagttcagtggaagcgtcgaccggcaagctgggagcgtcgcggcgcgataaatgacgtggcgtccgaaaccattcgctggtttcggacgccacgttttattattatgattgcgttccgtgcgcggacgcgcgttgacatataacgaaaggcctgcgatatgagtcatccctacgtttccgaagaccatgaaggcaagccgtggtttgaatggatcgttgcggcaatggtggttatagccacagtgcttgcggtcttaggccatgtaaaagccgccaccacggtaatcgcggtgacggccatcataacaggactaatcagactcgtaatgcgcgagcgtagtccttggaaagtccgttcagttggcttcgacgctttcatcggcatcggtctgggcgtcggactgttcatcctgctcgccctcgtgcccgtcggcatcgtctgacgcgtcgtcggctatggtctccagcgtttcggaatcctgctcggcttccgaaacgtttttcttggtgccgatcatggacgcgactatggccacaagcgagacgatggcggctgcgagaatcgggcagatccagaacacccacagctgctgcagaggctcttgggaaaggccctgattctgggcgaagatggcgatgccagtggcacgagccggattcagagcggcgcctgttaccggataggagattgcggcgccgacaccgtaggcgagacccatggcgatggcatggctggtattggtctttccggattcactggtggtgttgagcgcggtggcgacgatgatgatgcccgcgacgagttcaacggcgatggccagagtgatgctgaaggacacgccgtaattgccgagcgtggcataggagacggaattcttgtcaaaaccgttaatgaccggcgtcagccagattttcagcgttacctgctcggatgtcggcagcaggaagcggatggcggcgcctgcgccgataccacccagcacctgagcgataatatagagcactccgtcaagcacatgggttttgccggacagcatcgccgcaacggagaccgccggattgaactgggcgccggaaatcgtgccgaatatcagggtggcggcggcgtacaccaaacctgtcagcaaggcgatgaacgccatattcacgccgtagatcgcggaaccaagcgtgcaaatcgagtagatggcgaagcagatgatgaagcttcccaccagctccgcgcctgcgcgaagggccagtggcttgctctgttcttcctctgttacggacgttgcttcaacagcagtcatagtctttcctctgtcatatagtggacaagttgcggtttttatgaaagccgccaaacgactgccatactaccagcagtccctgtaagtattatccggccacgttgggagaacgatgccaaacgcatattctcgcgccgccaaggcgcacaatcatgacaatgaaggcattcgcctgcagaaacttctcgctcaggcgggcttcggctcgcgccgtaaatgcgaggaaatcatcaccgatggtcgcgttgagatcgatggcgagctgattaccgaacttggcacccgagtcgatccgaaacgtcaggaggtccgtgtcgacggttctcgcgtgcgtgtgaaccctaaccatgtcacgcttgcgttgaacaagccgaaacgcgtgctgagcgccatggaggatcccaagggacgctacactttgcgcgacatcgtcggagacaagtacgagcgtattttccacatgggccgtctggattatgattcggaaggcctaatcctcatgacgaacgacggcgaactgagccagcacgtcatgcaccccaaatatgaggtcgaaaagacctacatcgccacgctggaaggacgcatcagcggtcaggtgtgccgcaggctcgtcaccacgggcgtgaagctcgacgatgggtggatcaaactcgaccgctgcgctattctcgactccagccgcgaaagcacgttggtcaaggtcgtgctgcattcgggcaagaaccgcatcgtgcgccgtattttcggctcgatcggttttcccgtcaagcgtctggtacgcacgcagatcggtccgatcaaactcggcgacctgaaaagcggcacgtatcgcgtgttgtcgcaggctgaggtccgttctctatccaaggcggtgggactgtgatccgtgtagctattgatgggcctgcgggcgtcggcaaatcatccacgtccaaggcactggccaaatattatggtttcgcatacctcgacacaggcgcgatgtaccgtgcctgcgcctggtggtgcatgcacaaaggcatcgatttggatgccgaaaccatcgatgagcagctcgtcaccgaaaccgtcggcgaattcttcaccgacggccatttcgacatcagcgtcgatccggacgatccgaaggtgtacgccgatgacgaggacatcagcgaggccatccgttcttccgaggtctcttcgcacgtgtccaaggtgtccaacatcatccctgtgcgtcacgtgttgatcgccgcgcaacgtgcctacatcgcacgagaggcttcggtcgattccttctccgaaggcgccggtattgttgctgagggccgtgatatcaccaccgtcgtcgctcccgacgccgaagtgcgcatcctgcttaccgcgcgtgaagaggtccgtcaggcccgacgtagcggacaggccgtctcgggtgtgggtgcggaaaatgtcgcggcacgcgacaaggccgattcgaaagtcaccaacttcacatccgccgcggaaggcgtgttgaccgtcgacaactccgatctcaacttcggcgagacccttgacgtgctcgtccgtatcgttgacgacgccatcgaggaacaggaataccgccagtacgtttccaacctcgaaggctatgagctggatgaaggcgatgaggagctgatcgatggaacggcgttctctggtggcgaaagcaagaatggtccgaaaccggtcggcgtacttgccgtggtcggacgtccgaacgtcggcaaatccactctggtgaaccgtattctcggccgtcgcgcagccgtggtggaggacacccccggcgtgactcgcgaccgtgtgagctacgacgccgaatggtgcggcaccgatttcaaactggtcgacacgggcggctgggaaaccgacgtggaaggcatcgaatccgccatcgcatcccaagcgcaaatcgccgtgcagcttgccgatgccgtgattctcgtggtggacggtctggtcggtctcaccgacacggacgaacgcatcgtcaaaatgctccgtgccgccggcaagccggtgacgcttgcggtgaacaaggtcgatgatcgcgaaagcgaatacctgaccgccgaattctggaagatgggtctgggggagccgtatggcatttccgccatgcacggtcgtggcatcggcgaactgcttgacgccgcactcgactcgttgaagaaagcggaaaggacatccggcttccttacgccgtcgcatctgcgccgcgtggctctggtcggacgcccgaacgtcggcaaatcctccctgctcaatcagctggcccacgaggaacgcaccgtcgtcaacgatcttgcgggcaccacgcgagatccggtcgatgaggtcgtcaccgtcgatggcgaggattggctgttcatcgataccgcaggtatcaaacgtcgtctgcacaagctgtccggcgcggaatacttctcctcgttgcgtacgcaggccgcgatcgaacgttccgagcttgccttggtgctgttcgatgcctcccagccgatttccgaccaagacctgaaggtcatgagccaggccgtggacgcgggccgttgcatcgtgcttgtgttcaacaagtgggacctgatggacgagttcgaccgtcagcgtatggaacgcctgtggaagaccgagttcaatcgcgtcacttgggctcagcgcgtcaatctgtcggcaaagaccggatggcacaccaatcgtttggccaatgccatgcgtggcgccttggcatcatgggacaagcgcatccccaccggcaaactcaacgcgttccttggcaagatccaagctgcccacccgcatccgctgcgtggcggcaagcagccgcgaatcctgttcgcgacgcaggcgtccaccagaccgccgcgcttcgtgatcttcgccaccggcttcttggagcatggctatcgccgctacatcgaacggtgtctgcgcgaggaattcggcttcgaaggatcgccgattcagatttcggtgaatgtccgtgagaagaagaaacgcaagtaaccaccggaactgttagaagaggggcgtgcgcctggttcagaccatggcgcacgcccctctgccttattgaatctgggtcgttgccggcttttgctttcctttacgcacagcttaggccgacagcgtcagaacagaggatgttcatcctggttgcgtgttctgagataccccgttatggctctgcgcgcgagcgagcttaatgaaatgccgtcctgcttggccttggcccgcgccttatggcctacggcgtaggggagtttgatcttccattcgtcgccaagctgtttgcgcccgtcgctgttctttggcatgcgcccgatgccgaccgcgtctgaacagccatcggaatcgtcggacaagagtgccctgcgggtcaattcggtaagcgtgatgccatcatgccgagcgcgttcgcgggcttccaagccaagctcgcggggcaatcgaatcttccattcatcttcgggaagcgttgaatcgaacacatgggcgaattcgtcgacgtcgtcgaactgtggctgcgtgtcgttctgctgcaaaccgaatcacctctctgaacccatgcgttaatcgcattaaacggcaagaaacatgaaaaatatcgcaggctacatatttgcatgcgctcaagaccgtcctgacgtccagcttccggctccgatagatgccattctgaggggctgtatgccgcagttcactgcccaaacataacgaaaaacccgccgtttcaatactgtggaaacggcggggcgacgggctttcttggtcggaccagcgggatttgaacccgcgaccccttgacccccagtcaagtgcgctaccaaactgcgctatggtccgaacggtgcgaaaagcaccgaatatgaagtatagcataatctctacggtttttcaaacacatcgtgtcggaaagcgagtcgcatccattccggagagtttggcttcggatatttgagggttttccggcaattgctccaccggaagttcatgttggttctgtgtctaaatgcccccgattttggcggaatgtcgtattatggcataagcgcatcgaataacaacgcccgttcgaaagggagagacattgactgaggacgtattcgaatactctgccgcgaagatgcggaagcacggaatgaccgacatggccatcgcccagttccgtcgtctgtacgaggtctggcgcaatgaggaggccagcagttggattcgtgaggacgaggtcgaaccgctcgtcagcgttcccagcttccatgacgtgtatgagaccatcaatcacgacaaggccgttgacgcgttcgccaaaacggcgttcctgaagcttaacggcggtcttggcacttcgatgggactcgattgcgccaagtcgctgctgccggtacgtcgccacaaggcacggcagatgcgtttcatcgacatcatcatcggacaggtgttgaccgcgcggaccagacttggcgtcgatctgccattgactctgatgaactccttccgtacctccaaagacaccatgaaggtgctgcagaccaataagaaattccatcaggaagacatcccgatggaaatcatccagcatcaggagccgaagatcagcgcggaaacgggaatgcccgtcagcttcccggccaatccggaactcgaatggtgcccgccgggccacggcgacctgttctccaccatttgggaatccggtctgcttgacgcgcttgaggcgcaggggttcaaataccttttcatctccaattccgacaacctgggcgcgcgtccctcccgtacgcttgcgcagcatttcgagaatacgggcgcaccgttcatgatcgaggtcgccaaacgcaccccagccgatcgtaagggcggccacatcgtgcgagacaaggccacgggccgtctgatgctgcgtgagatgagccaggtccatccagacgacaaggacgacgcgcagaacatcgacaagcatccgtacttcaacacgaacagcatttgggtgcgtatcgatgcgctgaaagcgaaactcgcatcctatgacggcgtgcttccccttccggtaatccgcaataagaagacggtcgacccgaccgatccgaccagcgagccggtcattcagctggagaccgccatgggagccgcggtgtcgcttttcgatggcgcgacctgcgtatgcgtcgaccgtatgcgtttcctgccggtgaagaccactgacgatttgttcatcatgcggtccgaccgattccatctgacggaccagtacgagatggaagacggcaactacatcttccccgacgtccatttggacgcgcgctattacaagaacatccacgatttcgatgcccgtttcccatacggtgtgccttcgctcgccgcggcgaaatccgttgatatcgatggcgattggaccttcggcagggatgtgatgctgtttagcgacgcgcgactggaggatcaaggcgaaccaagctatgtgccgaatggcgaatatgtcggcccgcagggcgtggaaccggacgattgggtctgactttggacggccatgcaacacgaaaacgatgttttttcgtgaaataggcacaaatcgcttaaaaaacctctatcatagaatgttgtgtgcggcttacgaggccaagcacttaaaaagaaacgttaacgagacgtgaggactaatggctgagggaagtaacggtaggcgacgtttttccgacaaatggggcaagcatgagcttgatgtgttggctgtgctctcctcagcctttccgcaatggcttacctcacgtcagatcgcgcaacgtgtgaaggcgtatgccgattcgtacggagagctcgccgatcaagcggcgaaggccgccttcgccaagcaatttcagcgtgaccgcgccaagctcgccgccatgggcatcgccatcgaatcaaggcagccggaatattcctccaagtcagaagggcaggatttcgcttcctaccgtctgcagcttggcgatgagccgcgcgtgcgtctgctgttcggcgacgaggatctgccgattcttgccgctgcgaattaccttgcgcgctccatgtcgatttcctcggctcctgcgcacgaaccccagcacgcttcccgtaccgcgccgcgcgtgccgcagacgccgattccaggacttggcttggattccatcgcgccgggtcttggcacgcaatccattcccgacgagctggtcaaagtggtcgatcagcgacgtttcgccgccactgtggatgttgatggcgagcatctcaatgtcgcctacgccgactccgatgatctggccatgttcgtgctgtctcatccgggtgcgtccatagtgagccctcaggaggctgtcgacgcgttcaaccgccggctgcatgcggccacgcagttcgtgccggccgatgaatccaccggcaccgacagctccaccgtggtgtctccggaaatcaaccgcaacagcactgatgaggatgataccgaggaaggcaagggccgtccgaagaagaactccgcgttccagaccggtagtgaggtcgatcggcgtcttcgcctgatgctgttcctgtccgcccacatgggtgaggaatactctcttgaagaacttgcggaacgattcatcggcaggccgaagtccgatgacgaattgaagaagttcgtcaacatcattcataaggacatcaacacgttgaccacggtgtccgatgatggcgagatggccggaagccagttcttcgatatcgattggtccttgcttgacgcggaaggcatcgtctccgccacgaattcgctggggcttgaacgccttgccggcatttcccagcagtacctgagcatgctgacagcatcggtgagctatctcgcccactcctctttgcttccggacaagctgcgtgagcaggcggaatcgctgtacagccgactgcgccagcacgtcaagcctggcgacatgccgtggctgagcctgaccggatacgagatggaaccaaggaacttctccatcgtcaagagcgccatctccaaaggcatgctgctcgacatggaatatacggacggtgcgggccgtatacagcgcaagctagtggcgccagacaagatttttgtcgacgaaggcgtttactacgtggcggtatggaccgacgtgtccaacgcggcgcccgcggacaagatgaagttcgtcaagacggatacgaccatcaacaaggctactggcaagcctcgtatctggcaggtgcttcgcatctcccgcatcgagcatgcggagctggtcgaacccactgaaaaagtggaccttccggacgtgcccgcatccgaactgcgcaagtggagtttcgacaatggcacacctgccgtgttcataaccaatcaggacgacctgtcgttcatcgacagcctgtcgggagccaccgtcgagaaatgcggcgaaggcgagaaggtgcatctgattgtgtcttccgattcctggtatgtcgcgttctgcatcgcgcacgcccgtcatattactgccgtcgcgccggagacgttgcgtacgatgatcatcgcccgagcacagcatgagctgagcgtcggcgaccgagagaacgaagactgacgggggaggcgctatgccttggtggatttggctggtactcgtcctgttcatgctgacgatgctggtcggcggcggcgcatacgcatgcatccgcggatatcatgcgttcaaagatgccatcaaagtaggcggacgcatgtccaaacgtttcgaggccatgtccgagccgttgccgcaaccaaaggagaacacgtccccgttcttcacacgtccacttgaggacgcggccaatcgttatatcgacgctcatgccgaagtcatcagccgccgtgaggaaaagcgcgtccgtcatgcccggcagtgggcgcagtggaaacattccaacgactgattcgaaaaggaaccatgactcatcatcgtcgacatggcaataacgacaccggcacatacgatgccgagatgaccacagccctatctcccgcgcaacgctatgcggcgttcaaacagacgcaggccaaacgccaatcggtctcgtctcgtttcgcacggtccatgccattcgaattggacgatttccaagtcaaagccaatgatgcgttggaagccggcgacaatgtgctcgtcgccgcgcccaccggagccggcaagacggtcgtggctgatttcgcgatctatctggcccaagagcgtaacgtcaaagcgttctacaccacgccaatcaaagcgttgagcaatcagaaataccatgatctggtcgaaacgtacgggccggacagagtcggcctgcttaccggcgacacgtccatcaactccgaagccgacatcgtggtcatgaccaccgaggtcctgcgcaacatgctctacgagcattccatgacgcttgacgccttgcgttacgtgattcttgacgaggtgcactatctcgccgaccgtttccgcgggccggtgtgggaggaagtgatcatccacctgccccaaagcgtgagaatcatcggcctgtccgcaaccgtgtcgaatgtcgaggacttctccaaatggattgaatcggtccgtggcgacaccacgctggtggtgtccgaaaaacggcccgtgccgttggaacagcatgtgcttgttcaggcggacgaccacaccgaaccggaactcatcgacctgtatcgacgtgataaagacggcaatcagacagacaagctcaacgcccagctggtgagcaggctcgatcagctcgaccgcaaggccgcgaaacgtaggggagagcagcgccccgacagacgaaagggcggcaagggcggcaaatggaacgaccattcccgcagacccgaacgccatacgccacgtcgttgggccgtgattgatgaattgaatttcctcggcatcctgccgggcatctatttcatcttctcccgcaacggatgcgatcaggccgtcgaacaatgcatcaacgccggactcgaactcaccaccgatgacgaggtgcgtcgcatccgccgtatcgtcgatgagatggtcgaaggccaactcagtcaagaggatttgaaggctttgcatttctcgcagttccgcttcgccttggaggaaggattcgcgccgcatcatgctggcatggtggcgctcttccgccaaattgtcgaacgactgttcgaagaggggctggtgaaggtcgtcttcgccacggaaacacttgccttgggcatcaacatgccggcacggtgcgtggtggtggaaaaacttgagaaattcgatgggaccgggcatgtcggattgacgccaggggagttcacccagcttaccggacgcgctggccgacgtggcatcgacaccatcggccatgcggtggttgtggaccatcatggcttcattcccgccactgccgccgcgctgtccagcaagcgcgtgtacccgctgcactccagtttcaaaccgacgttcaacatggccgtcaacctgcttaattccagcgattacgagaccgctcgcatcacgcttgaccattccttcgcgcaatgggaggccaacgaatccgcctggcagcttgaagcgcagatggatacgttgcgcaaagcgttggacggatacgaacgggcgttcgattgtgagttcggcgacttcaaggagttcatgcggctgcgcatgcgcttgagcgacttggaaaagaacgaacgacgcaaactcaagcacgaggtgttccgcacgcagaaggcgcgaagcgaagcgttcaaagaccttgacaggagtatcgcggagcttcgcgaaaaagacagggaccatccctgccgcaaatgccccgatattcagaagcatctcaaatgggggcatcggtgggcgcgtgaaatgcgtgaattggaacgtgtgcagcaccgctacgattcacgcaccggctccgtggcacgtcaattcgaccgcatctgcaatgtgctgaacgagctcggatacctcgatcggcttgatgaaggcgcaaaagaacatatcgattaccggcttaccgaacgtggacagctgttgcggcacttgtacagcgagcttgatttggtgcttgcccaggcgatcgatgatggcgcgttcgacggactcgatgcgacggagctggccagcgccgtcatgtcgttgatttacgagccacgcagaggcagcgggggagagccgcgccattatcccggaggaatgcaggggaacgtcgccgtctgtgcggcgcagctcaaaggcgtgcacgcgtcgattgccatgctgtgtgaggactatgccctcgacgagccgcgccaacttgatttcggcatcaccgatgtcgtctacgaatgggctcagggcgaaagcctgtcgcgtgtgctgtacggcaccgatttgaccggcggcgatttcgtacgcggatgcaaacgtctcgccgacgtgttgcagcagatcgccgtggccggaccatacctgggtaaacgcgccgaaacgctcgctccgattgcgaaacaggcgtacgagaacgtcaaccgtggcatcgtcgcctattcaggtgtcgactgagcatgtgcgcaatcgggagatcggttttcgcggacgccgggaataagtgacacgtccgaagtgttttgtagcttagagtaagcagataatcaaggaggcaaaagcaatatggcggaacgtagcctgcgaggcatgagcatcggtgcgaagtcgcttgaatccgatgacaatgtggattttgcggcgcgaaccgacgtcgcatacgtgtgtccgaaaggccatcgtacgattctgccgttcgctgagggcgcagaattcccagatgagtgggagtgccgctgcggcgccgtcgcgcaccgtgaaggagacaatgacgacgaggctgatgaaatcgccaagccgacacgcacgcactgggacatgctcatggaacgtcgtaccgaagacgaactgaaggctttgctggagaagcgtctgcaaatgcatcgtgacggatggttcccggactacgagtgacctgcagttgaacgacacttgaacgaatgcccggtcattgagaccgggcataattgtttctgtcatcaattcttatagcacacaaccaaggggagaatcagatccatgtccgaacatccgaagaaagtcgttctgcttgacctcgatggcacactgacgaaatccgatccaggaatcattggctgcgttgtcaaggcgttcgaagagatgggatatccggtgccggacgatgccgaattgcatcgtttcattggaccggccatcagcgaatcgatgcaacgcaacggcattccggatgacaagcttgacgaaggcgtgaggatttaccgcaagtattacgccgacgaggccgtgttcgacgacccgaacaatcccggacagaaagtccccggccgcctgaacaacacgatttaccaaggtattccggagcagctcgccaaactgcgtgccgacggatactatctggcgattgccagctgcaagccgcaataccaatgcattccgatttgcgagcatttccacttggacaccatggtcgacggcatctacggtgccagcgaggacaattcccgtcttgacaaggaccaagtgatccgttgggctttccagcacatcgatttcgacgagaacgcaggagacaaggcactgatggtcggtgaccgttggaccgatgccgacggcgccaaggcgtgcggtttggactgcctcggctgcggctggggctatgcggagcccggagagctcaaagcccatggcgcataccgtattctggattcggtagatgaactcgcgcaggccgtcgaggagtatttcgcctgagtccgtaaacggaaacgctgtaggccagttacgtggttgctgtcgcaatatcgtggcagcaaccacgtttttatttattgagtgacggaggccgttatgtcagaaccgcgtgtttgacgcttcctcaagcctggaaaacgtcattcctgaaaagccgataatgtacgttatgtcagatttctatttgacggcctgattgagcttccgctccatctcgctgtgcatgccgtttcgggcctgaagatacatgaaaacaagttccgctgcgatcagcatggccatcaccgcagccgacggccatccgacatgttcgtagaaacgccggaacttcgccgagaaatccgacctgaacatcgcatataccggatatggcaacgcgccaatgaccaatgaggtgaaatgcagcgcgatgatcgaccaacgcaccggatgcacatcgcggtgtttttgggaaaacagattgcctcgaatcgcagtaatcgaacaaatgttcactgcgatgacggcggctatgatccacaacagtgccggcagaatatcaagcatgcgctactcccctgcgggttatatcgttcgaatgttccgggctgaatcgtaccaattgtatgcgatcaggctgctgcgcgggatttgcgccgcgattccagcttctttctcatacgtatcgcggcaatgtcgtcgattggccttattggtgtctgtcgatgccggcgtcttcgtcaaatcgacatattcctcatgttctagagcctctttgatctgatgccatagcgatccgacggacaccccgaacacagctctgccgctttgtagcagagccaccatctgttcgctgtccgtgcactcatgcacattctgcccatcgcacatgatggtgatgccggccaactgttcgggcgtgcgctgcgcgaggaagccgatggcggtggtcacgttctgcagattgattccggcatccagcaatcttttggaaacggcaagaatcaccacatctttgaacgaatacaatctgcgtgagccggatccgtgcgacggggtgatggatggttccactatctgtttacgcgcccaatagtcaagctggcggtacgtgatacccgccacttttgacgcgaccgtaccacgatagccccgtgtgacggactgcgcgtccgcggaggggaacaactccccctgcaccgcgtgcgacacgtgcagatgcaaccgcattgttggttctgcctcgccgtccattgtcttctcctacacgccataaaacaatcgcctatgagcttccattcggagcccataggcgattgaaggaaaaccgttactcacagtttatcccgcatcgggcgtttcattaggcaatgacggccttgttggtgaaatatacgagacggaacttgcccagaatgatttcgtcgccgttcttcagttcctggctatccactcgttgacggttcacgtatgtgccgttcaggctgccggcgtcaatcaccgaataatttccgttaatcctgcggaacaccgcgtgcgtgcgggagacggtggaatcgtccagcaggatgtcggaactcgggtcgcgtcccacggtgatctcgtcctcgtcgaggagataacgcgagccggacaccgctcccctggtggaaatcaggagcgccgtgccgtcggccagacgcatgatcgtattgaggtcctccttcgtcagaggacggtctccggtggaagtaaccggtacagtgatagcaggaagaccaatgatggtcgtttcgcctgcgcttggaatcggatcagtcatagctgtcattctaccctctccccttgcaattggccggtattgtggccggcatggtcacgaatcatacactgtgaacggtatttaccgttcgttcttgtcgatgatggatacgaattcgtccttcggcagcatgtcatcgtagctgcgccagcgtcgttccagttcgcggttcgcctcatcgtgttgtttctgccccagctcggcgtacgctttcaattcgttggggcccatatccttaaccggttggttgaggttcaattgtctctcgttcacaataggcaattgtagccgcttgccggggaacaaaaagcctggaacgcttttaatcgcgttccaggctttttcaagaaggattcagtgtgtggtgtccaaatcagcggcgggtgtcgatgatctcctgcagagcgccgttgacggaagaggagccggcagccgaagacagagcgttgatgccgctgacttcgaagccacgcatgattgcggagaagatcttgttcttgttcatgatgtttccttttcttgctggcgtgctgtgacgcaccttgcgtcttgtttgttttcttttctgtttacgatactcattttagaaatgcgtttggcaaaagtcatgcttctctcgtttgattctttgtattttcatcggcaattcttgtgtaatgtggtgaatcgtttttcgtcgatcgctgtttttgccggcgcgtcgatgcttgcattcttatctgacgaagtagcgtgaaaaggaatggaaacaaaaaaccggcaaaaccgagctgtgataacggtgggtgatataggaatcgaacctatgaccccttccgtgtgaaggaagtgcgctagccgctgcgccaatcacccagtcttaatttgtacggagcaatgctccagtgggcgatacaagattcgaacttgtgaccccttccgtgtcagggaagtgcgctacctctgcgccaaccgcccgggtcatgccaacatgcgaaaactaatctcacatgatgcgaggtgggtacgagagtcgaactcgtctatacggctttgcaggccgctgcctaaccgcttggctaacccaccataaaggtcgataatcaatcggaaccttagagcggacaacgggactcgaacccgcggtctcaaccttggcaaggttgcgctttaccaactaagctatgtccgcatgtctccagcagattcactgcgtgagcacgagtatctactataaccacattcgtgtaatttgcaagtcagcgtgtcgcggtttggtttattcgtattcaccgatggctgaagcgcgtgtcacaccacccgttttcggtatacattaaaagcatgtgtgaggagagcgcaatgcccaagacgatacttatcgccgcattcgaaggatggaacgatgcaagccaagcggccacgaacgtcgtccgtcatttggtgtcccggtatgagtcgcaggaagtgcgccatattgacaacgaaggtttctacgactatcaggtggcccggcccatgatctgctccgtgcaggggcgtaagcgcatcatctggccgcaaacgactttctatgacattgccgtctcccccatgctgcacctgcttgcgcagatcgcacccgaacccaattaccggtgggaggaatactgcaggcagacgctacgtgtcgcagaagactatgacgtaagtgatgtcatcacgcttggctccatgttcgatgaatgcccgcacacacggccattgccgcttgacatctccaaaagcggctgcgaatgcgaatccgacagggaatacaacggtccggtgggcatccccaacatccttgacgccttcgccgccgaagcgggctttccgacaacatccatatgggtatccgtaccgcattactatgccaataccgaatgcatgcaaggcactttggagctgctgcgcgccttgtctttaataatcgagtatccgcttattgaaggagatttgaccagaaaggccatgcaatggcgttctgacgccgatggattggtgtcagacatgcatgccggcgactatttggctcgtctggaacatgattacgatttggacgcgagagcgaagcgaatcgcctcgaacggcatgcctgcctgcgaggaactgcttcgtgaggccgaatcacttctacgcaacggcgtctgagtcgttcccctccaggaggaggtctcagacgaaaaaaatcccggccgccttacggatggccgggattcgctttatttacgccgaatcacgcttacgcggcggcaacgacttccgtcgggtgcagcacgccgcagatcagcagcagagccacgacaacggccagcgcgatgcggtagatggcgaacgccttgtacgagaaagtggacacgaacttcaggaagccgatgatcaccacatagccgaccacgaacgccacgatggtggccgcgatggtcgcaccccagcccgggaacattcccgcattgcctgcggccacatccttgaccgcggaaacggcttcgaggatgcccgcgccgaacacggccggaatggccatcaggaagctcacgcgcactgcagcctcacgggtataacccatcgcacggccgaaggtgatggtgccgccggaacgggaaacgccaggaatcagagccagcatctgaccgatgccgaagatcagcgcatccttccaggtcatctcatccatggtcttgacctgcttggcgcgggcgtcgaccacccacagcagaataccgaagataatcagcacggtaacggtgatccacagattacgcagcgtgctttcgatggcgtccttgaacaacagaccggcaatcagaatcggcagcgtgccgatgatgatgaaccaacccatctgcgtgtcgcggttatgcgcgcccatacggctcttgaagtccttgccctccttgccgaacaaggagccgaaccacgcgccgagaatgcggatgatgtcatgacggaaatacaggatcacggcaagctcggtgccgatctggatgatggcggtgaacgcggcacccggatcggagcccagcatcaaatcgccgatgatacggatatgggcgctggaagagaccggcaagtattcggtcaacgcctgcaccaggccaaggaaaatcgcttggaagaaattcatgaaccctctttatgttcgtagaaatatggtttcgtctgcttttccgtgaccaagagtagcgagaggggtctagttttcaaggcatcccggcatagttgtctcaaaccatgcacacaatggagccaaaagtacgccggcatgtccggcatgggagaaaggctcatcggcatgggcaaataccgcaaaagcagggcattcagccccgaaggtttctttgaatgcgagggacgtggcctcaaatggctcggcgaggcgcaatcgcagggcggcccacgcgtggtcgacgtatacgactggggcaaggattatctcgacattgaacgcgtgaacgcctgcggtccgaccatccaagccgcgcgcgatttcggtgttgcgctagctcatatgcatgatgccggtgccgaacattttggctccgctccaactggatacgacggcacctgctatttcgggccgttgcaggatcccgtcccgatgaatgccggtgcctgggatgatgtggccacctatctggcggacggcagattgcgtccgatggtacgactcggcatgaaacgtcgcgaactgaccgactatgacatggaactgactgaagccgttatcgacgccttgcccgacatcctaggcaaggccgccaacgacaagcccgcacgcgtgcatggcgacctgtggagcggcaacgtcatgtggactgctgattccggtgacgtcgaagccgtgcttatcgatcctgcggctcacggtgggcaccgtgaggaagaccttgccatgctcgacctgttcggcatgtcatatcttacggacatcctcgaaggctatcagtcggcgcatccgcttaaggccggatggcaggaccgcatcacattgtggcagctctaccccattgcaggacattgcgtgttcttcggtggaggatatgtgagccggtatcgcgccatgtgcaggtcgctgctcaaataggcgggaatcacccgtcacgccagatgtgaaagaagtccgtatcccaaggttatgagttgggatacggacttcttttcatatgtcccgtattcgattggattgcgaaaactagcgcagcgcgtccttcagcttggagaagaaccccttcttcgcgccggacgacggacgggacttcacggcaacatgctgggcgtccgtgtcgtgcatctcgccgaaccgctcaatcagctcccgctcgtcatcggacagcttcttaggaatctccaccactacgtgcgccaccaaatcgccgcgctcgttcttgtcgtcgagatgcgtgacgccgaggttcttcaacgtcacggtatcgtccggctggctgccggctgggatatccagcgtctgcctgccgtcgaaggtgtcgatttcgacttcgtgccccaatacggcccaactcatcggcaccttgatccaacaatgcaaatcgtcgtcatcacgagtgaacatgtcatccggcttgatgcggatatccacatacaaatcgcccgcgacgccgccattttcgccgacctcaccctgattggcgagacgcagacgggtgttgttcgccacgccggccggcaccgcgacgccgacattgcgggtgacgcgcacgcggccatggccgaggcaggacgggcacggcttctcgatgaccgttccatggccttcgcagcgttcgcatggcgcggtggtcatcatctggccgagcatggtgcgtaccacgcgctgcgcatatccctgaccgtggcagtcgggacattgtgtgggctgtgtgccgttctggcagccggtgccgccgcattcctggcacaggccgaacgtgttgaccttgacgtgcgtggtgtcgccgaacaccgccgtcttcaaatcgatggtcgcggaaacaagcgcgtcacgccccggctgggtgcgcggagtcggtccaccgccggtgccaccgaatccgccaccggtgaacatgctgaagatgtcccccatatcgccgaatccgccaccgaatccgccgccgtgcatgccgcccgcattcggatcgttcggatcgacgccggcatcgtacatctgccgtttcttaggatccgacagcacatcgtacgcgttgttgacttccttgaacttgtcttcgaattccggacctgcgatgtcgggatggtatttgcggctcatctttcgatacgcctttttgatctcgtcgtcgcttgccgaacggtcgacgcccagcacttcgtaatagtccgtcacgattattctttctccctgttggttctgcgtgtcattgtgccataaggcggggtcagtcggccggctgaccttcatcgtgggcgaggaacgccgtcagatatctggcgaccgccctcacggcggccatggtcgccgcgtagtccatatgagtcggcccgatcgatccgacgaatgcgaccggttcgcccgcctgccgcgtatcatcaccgctttgattttccgtctgtgatgatgcggccgcatgcgtcgcgccgtccgtggcggccgcggaggtacgcccgtagccactggttaccactgaggcgtgcagcaaaccgggcgtgtgcgtttcggaaccgatcgccactccgacgccgtcggattgcgtggtttcgctcagcgagctcatcaacttcatgagcaccacctgctcctccaacgcgtcgaacagcggggccaggtcggccaccgtgcgttgatgcgcaagccgtgaagtgcccgccatgtacaattcgctcgcgcgttcgtcatccgccatgccatcaaaggcctgcgcaagcgtttccgcaagcgtgctgatcgcatggtattccttgcgcgctcccatctgtcgtacgcaatcggccgtgcgggtcagcgaaacgccggagcattgcgtattgatctcgttggtcagatgagtgagcgtcgtcacgtccggcaatttcgtgacgttgaggatatgctgcgcgacacggccggtatcggtgatcactacggcaagcagcgtattaatggacactggcacgatttcgatatgccgcaatgtcgacttcgacagtgacggcgcggccacgacggcgacctgtccggtgatctgcgccagcagccgggcggcccgctgcagcgtgtcctgcagattgaccgatccggacagaaagctgttgatgccgcggcgctgggcctccgatagcggaacgaccgtcgccaaacggtcgacgaagtaacggtaccctttttcggtcggcaccctgccggccgaagtgtgcggctgaataagatagccttcatcttccaaggccgccatgtcgttgcgcacggtggcggagctgacgccgaggtcatgatcccgggtcagtgtggtggaacccaccggttcctgagaacggatgtagtcctcgaccacggcacgcaacaccagcatgcgtcttgattgcgccatgcgcgcctccttatgcataggtgtgtgccggtacgccttatgtttgacggcgctgatgagacgtacccggaaaacttcttttaatgttttagcactccggcgcccggagtgctaatcggttcgcttccagagtagtttccttcatgcggcaaagccttgcggcgactggcattgggagatatatcgacaaacgaacatctgaagttcacgcgaatgttaattgtgagcgctaacagcacacaaactaccaaaacacgccaaaatttcaccacaacgtcacctcacatcgctactatgggaaacgcaatgtgagggcgtcgagcgctcggcacaagccggatacgcggcccgaccaattggaaggaaagtaatccatgaccgaattcaaggagaccgagctggacgaacgcgccatcaagatggccaaggtcctgtcggccgacgcggttgagcgtgcgggacacggccacccgggttcccccgtctccctggcgcctatcgcctacaccctgtaccagcacttcatcaagcatgatccgaacgaccccaactgggaaggccgcgatcgcttcattctttccggtggccacgcctccctcacccagtacgtccagctgtacttctccggctacggcctgaccctggacgatctgaagaacttccgtggcggcgctgacacccgtaccccgggtcatccggaatacggcctgaccccgggcatcgaaatgaccaccggtccgctgggccagggcttcgcctccgccatcggcttcgcctatggccagcgtttccagcgtggcctgctcgatccggaagctccggaaggcgagtccccgttcgaccacaacatctgggtcatctgcggtgaaggcgatatcgaagagggcatctccggcgaagccgcctccctcgccgccaaccagcagctcggcaacctgaccgtgatctttgatgccaaccgcatccagatcgaaggcgacaccaacctggtgctggccgaggacgtgctcaagcgcttccaggcatacggctggtacaccgacgagttcagcttcatccagcctgacggctcctacaaggaggacgtcgaaggcctagccgacaccatcgccaaggcccgcgccgccgccccgaaccagccgaagctcatcaaggtcgacaccctgatcgcatggccgaccccgggcaagaccaacgacccgtcctcccatggctccaagctgggcgccgaggccgtcgccggcctcaagaagctcctcggctacgacccggaggagtccttccacgttgacgaagaggccctcgcccacgcccgcaaggtcgccgagcgcggtctcgaagcccacaaggaatgggacgagaagtacaacgcatggcgcaaggccaacccggacaaggctgccctgtacgaccgcatcaaggccggcgagcttccggaaggcttcgacaaggccatcgacgacctcgaggccaccttcgaagtcggcaagaacgtcgccacccgtggcgcttccggctccactctgaacgccatcgcagccgtcatgccggaactctggggcggctccgccgacctcggcggctccaacaagaccgacctcaagggcgctgagaccttcgccccggctgagtgcgccaccaagcagtggccgaactgcagcaagtacggccgtcagctccacttcggcgtgcgcgagttcaccatgggcaccatcaccaacggcatcctgctgggctcccacacccgtccgtacggcggcaccttcttcatgttctccgattacgagcgttccgccgtgcgtctggccgccctcatgcagattccgaacctgtacgtgtggtcccacgactccgtcgcagtcggcgaagatggcccgacccaccagccggtggagcatctggcttccttccgcgccatcccgcagctcgaggtcgctcgtccggccgacgcttacgagaccgctgaagcctaccgttacttcttcgagaagaagaacaccctgccgaccgctatggttctgacccgtcagggcgtcccggttctcgccgagaccgctgagaaggccaaggacggcgtgaagaagggcgcttacgtgctcgtcgacaccgagggcaccccggacgtcatcatcatggccaccggttccgaggtccagtgggctgtgtccgctgccaagaccctggccggcgagggcatcaaggcccgcgtcgtgtccgtgccgtgcgtggaatggttcgaggagcaggacgccgaatacaaggaggccgtgcttccggccgccgtcaaggcccgcgtctccgtcgaggccggcgttgccatgccgtggtacaagtacctcggctcctacggcaagccggtgtccatcgagcagttcggcctgcagggtgatggcgctcagaacatgatcgatctgggcatcaccgccgagcacgttgtggaagccgccaaggcctccatcgcggaagtcgaagccgccaagtgatgatacggggagggacacgacagcatgtgcccctcccctttcaccgataaacaagatttgatccaaaaaggtatcaaggagaaaaaacaatgactgaagcaactcagcgcacctctgactccggtgtctcgatctggctggacgacctgtcccgctcccgcatcgagtccggctctctgcaggatctcatcgccaacaagaacgttgtcggcgtgaccaccaacccgtccatcttccagaaggctctgcacgaggtcggcccgtacgatccgcagctgaaggaactgggcaaggtcgacgttgagaccgccgtgcgcgagctcaccaccaccgacgtgcgcaacgccaccgacatcttccgtgaggttgccgagaagtccgatttcgttgacggccgcgtctccatcgaagtggatccgcgtctggctcacgagaccgaggccaccgagaagcaggccgaggaactctgggccaaggtgaaccgtccgaacgccatgatcaagattccggccaccctcgaaggcctgccggcaatcaccgccaccctggccaagggcatctccgtgaacgtcaccctgatcttctccctggagcgttacgagcaggtcatcgacgcctacatcgagggcatcgcccaggctgacgccaacggccacgacctgaagcacatcggctccgtcgcttccttcttcgtctcccgcgtggacaccgctgtggacaagctgctggaagccaacggctccgacgaagccaaggctctcgagggcaaggccgctgtggccaacgctcgcctggcttacgagctgttcgagaacaagttcgccaacgatccgcgttgggctgctctcgaagccaagggcgccaagaagcagcgtccgctgtgggcctccaccggcaccaagaacgccgcatactccgactgcaagtacgtcgacgagctcgttgctccgttcgtcgtcaacaccatgccggagaagaccctgaacgctctcgccgatcacggcaatggcgctccgtccatcaagggcacctacgaagagtcccacgccatcatgaacaagctcgccgatctgggcatcaacatcaaggatgtcaccgacaagctggaagctgacggcgtcgcagccttcatcaagtcctgggacaccgtcctcgccgacgtccaggctggcatcgaccgcgtcaacggctgaatcattcgctgatacagcaccgttaaacggataaaagccgagaggtctccatcttttgatggagacctcttttacgtatgccggaataatacgcgcagaagacatacggaaagacaaaaaggccgcgatatcaaatcgcggccataatcgaaagaaaagcgaaccggaaatcaagcctgccaatacgtgctgaagaagtcgccgatctcgccgatggtctccttcaacatgctgatacgaggcagatagaccacacggaagtggtccggctcctgccagttgaacgcaccgccgtggctgatgaggatatgcttgtcatgcagcaggtcaagcgcgaactgctcatcggaatggatgttgaacttcttcacatcgatcttcgggaagatgtagaacgccgctttcggtttgaccgcggtgatgcctggaatatcgttgagcatgttgtacaccaactcgcgctgatcgtagatgcggccgccgggcaccagataatccttgacgctttgatggccgcccaatgcggtctgcaccaccgactgcgcaggcacgttcgagcacatacgcatgttggccagcatgttcagaccctcgatgtaatccttggcgagacgcttgttgccgctcagcaccatccagccgacacgccagccggcgatcatatgggacttcgacaatccggagaacgtcacgcagaacaggtcaggcgcaagggacgcgatggagatgtgctccaacccatccatgaccagacggtcgtagatctcatccgagaagatcatgagctggtgctctcgcgcaagatcgacaatctgctgaagcacttccttcggatacagcgcgccggtcggattgttcggattgatgatgacgatcgccttggtcttgtcggtaatcttggaacgcatgtcgtcgatgtccggataccattcggaatcctcatcgcagacgtaatgcaccgcggttccgccggccagattcacgcaagctgtccacagcggataatccggcgacggcacgagtacctcgtcgccgttgtccagcaacgcggataaggacaggttgataagttcgctgacgccgttgccggtgtagatgtcgtcgatggacacgttggggatgttcttcagctgcgcatactgcatgatggctttgcgcgcggagaacaggcccttcgacggcgaatagccttccgtgtcgggcagctgctgcgacatgtcgtagaccacttcatccggcgtgcggaagccgaacggtgccggattgccgatattgagtttcaggatgtgcgtgccggcggcctccatgcgcgcggcctcgtcggcgaccggtccacggacgtcgtacagcacattgtcgagcttgtgggatttcgtaaaagtgcgcatggttcttccttctgtcggttgctcggatgcatcgtcaacatggtcgggctgttcaccggcaaaatccggcaaaatcgcggcatgctcttccatgggaacatccttgcccatcagccaatcctcgttgacccgcagatacgcggcaaggaaatgcgcgatatcggcacggggaacggttttgccactgacgtattggctcatatggcttttgccgagcttgatattgaacttttccgcagcatgaacgaaatcaatctgtttaagctcgcgtaatgccatggcatcattcaatctggtcgagaatgattccgtcatgcctatccttccagttcaatttaaacaaaagctagttcaaagaatagcacgacagggcaccaagaaagacaaagagttcaattttggtggatgtgtttcatgccgctgcatgaatgagttcaattccgtgaaaagactccatgtgggggggcggtcaaagcagattgttctcaacccattgggccacgccgtcatcgttgttcgaagggcagatctcatcggcgattttcaacacgtcaggattcgcgttggccacggccactcccctgccggattcacgaagcatggcgatgtccaccaaatcgtcgccgaatgagacggtccgtgacaacggcgtcgacatgcgatcggcgaggatgctcaatgcatgctccttattggcctgcggattcatcagcatccacagcgagccttcggagatatgcacgtcgaaatcgtcggggatgagccgtcccacacgcttccactgctcctcgttcgggaacaggatcagcttgtccgcggtgccgtccggaacgtcatcgaaatccgtgtatcgccaggtctgcgtcttccagtatttcgtgacgtcgaaattcgtgtacctgacatcatccatgacgatgcccacttccatgtcaggcagttcctccagcaggtacttgcagacctcgcaggcccttttcgaagagaatccgatcttctgcagatgtccgtccttcggcagtgtcggtgaggtgagcatatcgtaatcggacgagacggggttgaaatccaacagcgccccgttgagataggcgacggcgtcaaccggaagcttctgcacgaacgagtagccggtgctgaccggtcgcgcggtctccaccacgaatttgatgccggcgtcgtgcatgcggttgatgctgtcaatggatcgttgcgtcaggaaacggtcctcgaaagtctctccgtcgtgcagcagtgtgccgtccagatcggcgacgaccatggtcacgtcatcataggtgttgtttgtcgaagtcatttgaatcctttgcgggagcaatctagccggagacaagtttggcccatgaccgtgaagccggtcatgggccaaaccaaattacgtcaatcagatgaggttgaatttcgtcatcagaccgagggcgatgatgatggccacccacagcaatgcgatgatgacggtccaacggttcaggttcttttccgcgacaccggaggaacccgcattctgggtgagtccgccgccgaacatgtcggacaaaccgccgcccttacccttgtgcataaggataagcaaggtgagcaagaggctgaggatgacaagaagaatctgcagcacaagcttgacagtagccatagcggacacgggtgaacctccagttcgtaaacactgtttctgataatagcgcatggtgttgaaaaaatcgagcgtccaaccatgctttttaaaagttttcaggcggttgtttccaatgtcagcttgcagatgcgtgtgagttcatcgaccttcaacgcggagccgccgatcaggaagccgtccacatccggctcgttgatcagttccaccgcgtttttcgaggacaccgaaccgccgtacaggattcgcaccgtttcgccgacccgtgttccgaacgtatcggacaggtcgtttcggatcgccctggccgcgtcctgtgccgactgaggcgtagccaccatgccggtgccgatcgcccataccggctcgtacgccacaatcagcttcgcggcctcctcatcggacaggtcccgcgtcacgtcgtgcacctggccgaccgcgaaatcgagctctatgcctttgcgccgttcctcgtagctttctccgacgcaaagtatcggctgcatgccggcagcaagcacggccctcacctggtcgacgatgttcgcgtcgtcttcgggatggtatttgcgtcgttccgaatggccgacgatcacgtacgagcagccgagatgggcgatcatatcggcggagacgtcgccggtgaacgctccctgcgaggtgactgagacggcttgggccccgtagcggattttcagattgtccgattcgacggcgacctgcacgctgcggagtgaggtgaatgacggcatcaatgcgatttcgcaacgtttgtagtcgaaatggatggcccgaagattccatgcaagctgctgtacgaaatacgtcgcttcaagatgatcgaaattcatcttccagtttccggccaccaaaggaatccgtttcggccccataatattcgtcgtctcccgtccgtgctcgtcaaagcgaaaggtcgttcttgtgacattgtatgcgaaatacgcaaaaggtgctcccccacccactgatgaggaagcaccccttcatgattctgagatcagtcgagcaccttcaggcccggcagttccttgccctcgaggaactcgagggaggcgccgccaccggtggagatgtgcgagaagccatcctccgggaagccgaggttgcgcactgcggaagcggaatcgccaccaccgacgatggtgaatgcgccggcagcagtggcatcgacgagagcctgggccacggccttggtgccttcagcgaaggtcgggacctcgaacacgcccatcgggccgttccacacgacggtcttggaatcgacgatcttgtcgtggaagagcttctgggattccggaccgatgtccagacccatcttgtcggccggaatggcgtcggcggccacgacttccggagcgatgtcctcatcggatttcgggaagaccgggttgatgacgacatcggtcggcagcacgagttcgacgccgttcttctcggcgcgctccatgtagcccttgacggtttcgatctggtcctcttccagcagggaggtgccgacctcgtagcccttggccttgaggaaggtgtacgccatgccaccgccgatgaccagacggttggccttgtccagcaggttgtcgatcacgccgagcttgtcggagaccttggagccgccgagcacgacggtcagcggacgctccgggttcacggtggcgcgggacagtgccttgacttccttctcgaccagcaggccagcggcggccggcagatcggcggcgacgtcgtagttggagccctgtgcgcggtgcacgacaccgaagccgtcggacacgaagacttcgccgagggcggcgatcttcttggcgtatgcggcacgctcctccggatccttgctggtctcttccggattgaaacggacgttctgcagcagcacgacatcaccatcgctcatcgcggcgaccttggcctgcgcgtcctcaccgtaggtatctgcggccagcggaacggtgatgccgagcagctcgccgagacgggcggcgaccggagccagggacagttccggaacgaccttgcccttcggacggccgagatgagccatcagaatgaccttcgcaccctgttcgcgcagagccttgatggtaggcagggcggccttgatgcgaccatcatcggtgatcgtggtgccgtccagcggaacgttgaaatcggcgcgaaccagaacgcgcttgcccttgagatctccaagatccttgagtgtcttcatgtatatcctttcctagccgcttgtaagcgtggaatggccatattgccacttacgcataatacaagcccaaacgaacaaaaaacaccatacgacggaaaagtcgcatggtgttttgtttccggaaacgaaaatcaggccgcttgacggcgtgccttctccgttttctcagccaattgcagcagtcgacggatacgtccggcgatcgcgtccttggtgattggcgggtcggcgagacggcccagctgctcaagggacgcgtcggcatggtcgagtcggagctggccggcggatttaagattgtccggaacgtcatcgccgaggatttcaaaggcctggcggaccttatcgcaggcttccgcggcggccttggcgctacggcgcatgttggcgtcatcgaagttcgccagacggttcgccttgcctcgggcctctccgtcggaacgctttccggtccattcgcgggcggaatgaggggcgcccatgaggatgagcatgcgttcgatggcatcggggtcgcgcaacgtcacacgttcggagctgcgcagcttacgcggcttggcggtgatgccgagacgacgcgcggtggagaccagcgccagcgcggcctcatgattcggacatacgatttcgagatagctggccttgcccgggtcggacaggtgtccgcctgcgaggaacgcgccacgccaggcggccttgatctgggcgatcttgccgttgatgatgtcgcccggcagacccagcaccatgtttttggtgtaacggctgtacaggccggtctgcagcaccagagccgcgctgcccttggggacgcggactatgaagcgctgcaccacgccggtcggcgtctgcctggaaacgggggtaagcgtggcttcgtggccgtacagatttctgatggtgtcctgcagccatatggccgcgtcttgggaatcaagctgcgcctgcacgagaatgtggtgatccaccgagtgcaaaccattgccgaatcgaatcatcgcagtcgcctgtgcctttttggcgatgggcaactcgttgtcgattgcggccagctcgcttttgacgtcatccagaagagccaagagccaacctcctactttcctgttcttccctataatttcaggcgagtcgcggactcgacccgcactgctaccggcttactgtgataccgaataacttggacaaagccggcagcttttctttgtatttggatactgtcttctcacaatgcggtcatcaatcggccgaacgcttgtccagctcgcgggccgatacggagaccgtgagaccacgcgcacgcaggcgcttggccaaggcctcgctcatggccacggaacggtgctggccgccggtgcatccgaacgcgatggtcacatagtgcttgtcttcctgcgcataaccttcgatggcgatggcgatggctttctcgtaggcgtcaaggaactcctccgcgccctcgctggagagcacgtagtcgctgaccggtttgtccttgcccgtcagcgaacgaagctccggcacccagaacgggttgggaaggaaccggacgtccgccacgaaatcggcgtctatcggaatgccgtatttgaatccgaaactgaagatatgcacggaaaccgtggtcggtccggaaccaagcagaccctcgtacagtttcgtggacagctgatggatgctcaatgccgaggtgtcgatgacgatgtcggcgtgctctttgaggttcttcagcaggtcgcgttcctcaaggatgccgtcgatcagacgattgccctgctgcagcggatggggcctgcgcacggattcgtagcgcttgatgagcacctcgttgctggcgtcgaggaacaggatgcgggtcttcaccccaagatcgtccagatggctcagcacggcggacaggtcgtcgaaatagtcacgtgacctcacgtcgatgaccgcggcgagtttgtggatgttcgaaccggagctggtcatcatgtccaccagcgggacaagcagtttcggcggcatgttgtcgaccacataccagcccatgtcctcgatgctgttggccgcgtgggaccggcccgcgccgctcatgccggtgatgagcagcacttcgaagcctgcggccggagaaggcgcgctcgtatgcctgcctgcctggttgacggcgttgttcttttcgttcatcacagggcctccttaagcgcggagcgcatggcatgctccaatgcttcgactttctgatggctggtgggctcggtcggcggatcgttgtcccatatgccggtcatcagccagacttgaatcatggcttggtacagcagcatctcctcgccgccgatggcggtgccgccgcatgacctccaggcctgcatgagcttggtcgggcggggatcatagaccacgtcgagtagcgtgccgttcgtgactatgccggctgaggcaaacgcctcggcgatcggatcggcggcaaggccggggatggtgttgatgacgacgtccgcatgggacagcagattcaccgcatggtccatggcgacgatgcttatggagccgacgcccatatggctttccgccaatggttcaagcgcctcgttcttatcgggatggcgtgccacgacggtgacatgtccaatgtggggcatctcggtgcaggccgccaaagccgaggtggcggtgttgccattgccgatgatcaccgcctcgccgtcttgtccagaatccatccgcatgccacgtgcccgatacgagtgctcgaaggcgagctcaattcccttcacatccgtgttgtagagcctgatcgcagggatggcggcgttcttatcgttcgcgccagaccagtcgaagacggcggtgttggccaccttcagctctttcgcccacgcgttgcatggcacgccatatggctggatggtcttcttcaacggcatggtcaggctcagtcccgcccagatggaatcaagcgactccaaaaaatcctcaagctccgtctcgccgacctcgtgcctgccatacgaccagctgtcaagtcctagagctcgataggccgcattatgcaatacaggggaaagcgaatgcgcgatgggtttgccaaggaccgcgcaccgatggtccacctcggtcatgttccctcccttactctcaccattcatcatgctagcaacgcagaagcgattgctcgttacagattctatttcttttcatctttcggactgtttccatccgatttcactgttcggagggcatcctccgccttcgaagcaatgtcaacggacgaatgcaatgcctggtaaatgttctcggccttggcatggccgatgcctttgacctgttcgaaatcctccacgctcgcctcacgcatggcgcgtacggagccgaaatggttgagaagccgtttctgataggcttcgccgatgccgggaatgtcgtccaaagcggaacgcaaagctcctttgcgtctggtctgacgatggtaggtgatggcgaaacgatgcgattcgtcacgcacccgctgcagcagatacatgccttcggactgacgtttgaggatgatcggatagtcgtcatccggcacccaaacctcctcaagacgcttcgccaatccgcagacggccacatcgtccacgccgcagtcggcaagcgccttggccgccgccatcacctgcggtttgccgccatcgaccacgaccagattcggcttataggcgaaatggcgacggttggtgttctgctgcacggcatccgtttcaggaccattcgtgccatccgacctatcattttgcgtggccatccgacgctcgttgtccatgctttccccggaatcgccggcgatgttgccatggcggaaacgacgggtcaacgtctcatacaatgcgctcaaatcatccaacgcgccctgcccgtccgcacctcggatggcgaaacggcggtactccgactttttcgcgatcgcgtcttcgaacaccaccatggacgctacctggaatgcgccgccgactgtgttggaaatgtcgtagcattcaatgcgcaacggcgcctgttcaagcccaagagccttcgtcacatcgttcatcgcatcggaacgtgcgcccatatcgctgatacggctcatcttgctgcgtgccaacgcctgcttggcattgtcgttggcacggtccataagctgtttcttgtcgcctctgctggctacacggatggtgacggccgctccacgcaatccgcttagccattgctcaagccctgcgctgcgcgacggttcgattggaacgatcacctcacggggaacaggcgcgattggagccagcaggtcggcacgtcccgtctgctcctgacgttcgttgcgttccttcgtggcctgcgcacgggcgatagcatccgttgcggtcacggtctgtgtcgaaccgatcgcattgcgctgctcggtcacgacggtcgaatcggagacggccgcgctctcccccgtggtttccgaatatacctgagtgatcagatcggcgatcaactccgcgtcgctcacatcttcgactcgctccacactccagttacgttcgccgcgaattaatccggaccgcacgaagaacgcgtgcacgctggcttcaagctcgtcggacgcgatgccgaacacgtcggcgtcgacatccgaatcgaacacgacggcgttctgctggaccacggtcccgagcatttggatctgatcgcgcagccgggccgccttctcgaattccagttcggcgctcgcctgcttcatgtcgcgggtcagttgggcgatatacgatttgccgattcggccggtcatcacgccgacaagctgctcgcacatcctgcgatgctcgtcagcgccgatacggttcacgcatggagcggagcatttgccgatcgatgccaacaggcatggacggcccgtcaactgcgccttgtggaacacgttcttcgagcatgtgcgcacgggaaacgtcttcagcaacgcgtcgaggctgtgccgaagatcccataccttggcgtacgggccgaaatatctggtatcgcgacgtttgcggctgcgagtcacccatacgcgtgggatgcgttcgcctgatgagatggccagatacgggtaggtcttgtcatcgcggaacaccacgttgaatcgtgggtcgaactccttgatccacgtgtattcgagtgtgagcgactccagttccgtacccactaccgtccattcgaggctgcgagccgtcaacaccatggtctgggtgcgtggatgcagctggtagagcggctggaagtagttcgtcagccggttgcgcaggttcttggccttgccaacgtagatgacgcgcccctcgccgtcacgccacttgtatacgcccggctgcgcgggaatgtcggaggttttcggacggaacaggtcgcgagtatcccccaacaggggcgcgccgttcttgttcactcccctgccgtcggattgggtgccggcgtccgatactgcggtttcccgtaacgcatccgccgttttgcgccacacgtccggactgtgtcgttcgaaatcagtcacagcatatccctaaggaacttgcccgtccacgactgttcgcattgcgcgacctgctccggcgtgccttcggtgacgatggtgccgccgccgtcaccgccttccggccccagatcgatgatccaatccgcggatttgaccacgtcgagattgtgctcgatgacgatgacggtgttgcccttgtccaccaatccctgcaatacgagcagcagtttgcgtacgtcctcgaaatgcaggccggtggtcggctcgtcgaggatgtacacggttttgccggtggaacgccgttggagttccgtcgcgagtttcacgcgctgcgattcgccgccggacagcgtcggcgccggctggccgagccggatatagccgagaccgacctgcaccagggtgtccaggtaacgcgagatggacgggtacgccttgaagaactgcgcggcctcctcgatgggcatgttcagcacgtcggcgaccgatttgccgttgtacttcacttcgagagtctcgcggttgtagcgctggccgtggcattcctcgcagtccacgtacacgtccggcaggaagttcatttcgattttcaacgtgccgtcgccgtggcatgcctcgcagcggcctcccttgacgttgaacgagaaccgtccgggaccatagccgcgcacctgcgcttcgggcgtcttggcgaacagcgtgcggattttgtcccatactcccgtataggtggcgggattggaacgcggagtgcggccgatcggattctggtcgacgtggatcaccttgtcgcactggtccacgccttccacgcgcgtgtgcttgccgggcacgatgcgcgcgccgttcagcttgtccgcaagcaccggataaaggatctggttgaccagcgtggatttgccggaaccggacacgcccgtcacgcaggtgaacacgcccagcgggaaattgacgttcaggttcttgaggttgttctcgcgggctccgaccacgcgcagctgcttggtcttatgcgtcttgcggcgtgcggcgggcacttcgatcttccgtcggccggcgatgtagtcgccggtgatggagcgtggcgcttcggtgatttttctggcggggccggaatacacgacctcgccgccatgttcgccggcgcccggaccgatgtcgatgacccagtccgcgtttctgatggtgtcctcgtcatgttcgacgacgatcagcgtgttgccgaggtcgcgcaaatgatgcaatgtaccgatcagccgttcgttgtcacgctgatgcaggccgatggatggttcgtccagcacatacatgacgcccaccaggccggagccgatctgggtggccagtcggatgcgctgcgcctcgccgcccgacagggtcttcgccgcacgcgacaacgtcagatagttcaggccgacatcgttgaggaagccgaggcgtgcgcggatctccttgacgacttcgccggctatctgcgcggccgagccttcgagttctaggccgttgatccatgcgaggctccgttcggcggacatgtcgcacacgtccgcgatggactcgtcgtccacggtgacggcaagcacttccggacgcagacgccgcccatggcacgcctggcatggcacctcgcgcatgtacgactcgtaatactgcttcatctggtcggaatcggtttcgtcatgccggcgcatcaacgtgcgcaccacgccttcgaaaccggtggaatactcgcgcatgcgaccccaacggttgcggtacgagacctgcaccttgaaatcgcggccatacatgatggcgtcgcgcgcgtccttgggcagatccttccaaggcgtgtccaggtcgaagcccatctcatcgccgagtccctcaagcacatggcggtagtattcgccggtgcctttggtcatgccccacggttcgatggcgttctcgttcagcgtcttgtccggatcgggaatgaccagttcggggtcgatttccagcttgtatccgatacccgtgcattcagggcaggcgccatacggcgcgttgaaggagaaggtgcgcggttcgatctcgtcgagttccagctgatggccgttcgggcaggcgcgtttctcggagaacggcttgcgacggtccggatccttctcgtccaaatcgacgaaatcggcgacgaccacgcctttggaaagcttcaacgccgtttcgatggaatcggtcagacgctggcggataccgtccttgaccaccagacgatccaccaccacttcgatggtgtgcttcttctgcttggcgagcttgatgtcatcggacaattgccgcatctcaccgtcgatcagcgcacgcgcgtaaccatcgccacgcagcagttcgagcagatcctcgaattcgcccttgcggccgcgcacgaccggcgcgagaatctggaaacgcgtgcgttccggatacttcagcaacgtgtccaccatctgctgcggtgtttgcgcgcttaccagggcgccgcattccggacaatgcggaatgccggtgcgggcgaacagcagtcgcagataatcatagatctcggtgattgtgccgaccgtcgaacgcggattgcggttcgtggtcttctggtcgatcgaaaccgcggggctcagcccctcgatgaagtcgacgtccggcttgtccatctgccccagaaactggcgcgcgtacgccgacagcgattcgacatacctgcgctggccctcggcgaacagcgtatcgaacgccaacgaggatttgcccgaacccgacaggccggtgaacaccaccatgcggttgcgaggaaactccaagtccacgttcttgagattgtgctcgcgagcgccttggatggtgattttgaggtcgttgggtaggtgtgtgaggtctgctatgagtgagtcgcctgttgttttcatgggggcttttttgatttcgcgtgtgaggaatgcgtcgctggtgagtacgtgttcgaccacgacttcgttgtgtgtcgtgttgttgcgtttggttgtcatggtgttcttccgcttggtgttgcctgttctgttgtataggatagcgtatttttgttgtggtttcgaacaggtgttctatttggtgttgttgtttggtatgtcgttgccgggtatgtcgattggccagtggtgttggtcgtgcaggatggttgtggcgtcgcgtatggggatgcgttcctgttcgatgcgtaggtattggatgtctgttcctgtgcagagtgtttcgtagagtttgcgttcttcggtggtgagtccgggtgtgggttgtggggtttgtgtggtgaggggtttgtttttggcgtcgagttgggtgccgtattgttcgtatgtccggtatgcggtggtgtccatcagtatggatgtgcatgggatgccggtggcgcgtagtttggagaggatgtcgagtccgttggcgtccatgtcgccccagtagatgatgttggggatggtggtgagccatggcaggagtgttgtgatgtgtgatgttgcggcgtatccgttgccgaggatgcagatggcgtgttcgacggtgggcatggcctggtaggtgtctttgttttcgatgatgatggcgtgttcgatgtcggttggctggctgcggacccatggttgggtgacgatgaggtcgggttggtcgtggtgttcggcgtccatgaggcgtagtcggagttcgttcgggcgttcctggaaggtgaggttgtcttgtccggtgagctggcatatcgctttgcggcgttgggagttgggtgtgccgagccatttggcgctgaatcctgggatgggcgccatgcgtggggtcatggtgtggcagtcgtggtttgcgaagtagtgggcggcttggatgacgaggtggaagtcggtgtcgtcgtggtctttgagggttttggcgacgttcatggcgttctccggttcgaggccgaattctttggcgagcgcgctcatgcggtcgtgttcgcgtaggtagcgttcgcgggtttgtttggtggcgatgcggagggcggtgtcgaggtcgggtatggtcacggagtcgatgagcgggctttttgttggatgagtccgctggagacgattttggttttttcgctggtttcgcagtggtgttgccgcgcccagtcgcggatggtttcgttttgggcgcggatttggttgtagtgctgctctagttcggcttgtttgggcagtcggatggttttgcgcagcggccaagattcgtcggtgtcgtacatgtgcctggtgaggtgggcgtcgacgtattcgtcgagtttccggcggatgtccgtttcgcttgtggtgtttctggccgctgccatattatgcctccgtcgcgggttgcgtctgttcgacggtggcgtcttgtgtttcggcttgcgttgccggctcgcggtcgagctcctgcaggtacgagttgccggttgcgggatccttgtatgccacgtacgctttgtctgcgatgctgaggatttcggcggttttgctttccggcgcggatacgatgatctggaagccgaggcgcggcagcacggtcagcgcgcgtttcgtgtagcgtccgtcggctttgatgagggcttcgtccaggaacagtgtggtgtaggtgggcttgccggtcaggtcgccgccgagcaggtagatcagggccgcgccgtagacgaacgaggtgagttcctgcaacgcgccgccggacttgccgccggtggagctgatgcgttcgtcgggcagatcgttatggtgcacgatcgcgtagaacgagctgcgcacgcgtggatcgaggttgcgcgcaccgtattccttgatgccgttcgtgtcgcggatctggccgagttccgcctggagcctgccgatgaacgtttcgcagcctgcgaacgccttgcgcgtctccatgggattgctgcgcgcgttgcgtgtccaatcgtcgagcttcgacatgatgcggcccaacgaggatttgaactgccggtcgatcgggtggaagtccacgtggagcgagagcctgccgccgcgggggccgaactgttggcctttgagcatgccgttgatgcggtcgagctgctccctgacgttctcctcgtcggtgttgaacgcgcggttgagctgttggaagctcatatacagcttttcgacgctgttcgcatactcctcgtcggtcgcggcgcgggtgacgagcatgttgaggttcttgagctcgtcaaggaaatacggatagtcctccacgctcgccatgacggtgtcgccctccgtggaatggtgcttcagatagtcgcccatggcgcgttccgtgtcggcgcgcaattggacggcacgctcgtcgatctgctggagtctcgcacgcacggtgttgccgattctgcgcagcacgcgcacgtcgaacggcgccgtcccctcacggtcgaaaccgccggcgatgcgctgcggccgttcctgcggacgcgacgtgtcgaaacaggtctcatacgtgtcggccagcagattcgacaccatgtcggacaatgcggcatcgtcgaaatcggagtcgccatgcatgtcgagccatgcctgttcggcctggacggcatgctgcgcgttttccaattccgcttcggcacggtacctggtcttgccctcgtcgtccttctgccgtagcagctgtttcaactcgtcctgcaattgtgccagttccggatcgctttcgatccgttcgatctgcagacggatccgttccgccttcgtctcgagcccgtccacgtcgatcttgccccatggcagatccgcgacggtcaatgcgagctcatgctcgtcctgcagcagagtcatggcgttggccatctgcctgccgcggcggtcggcgtcctccaacgcccgttccgccccgtcaagctggcgttccaattcggccagataccgttcgttcacgaagccgatgacctgacgcaggcctttgacgccatggaatccatggtcgccggatttgatctgcccgtcgacctgcacctgccgttcggcccggtccatgtcgtcgatcgcctccacgcaacgcgcgtcgaaccgttgcgacgcggtctgctccttcaaccatccgacgaacggcgaatcctccttgtaccgcagcttcgacgacatccacccctcgttgcaggccgaatcgtattgcgcgtcggtatcgacgaaacgccaggcacgccgcgtcatacgcgtcggatcgatcgcgctgaccttcgcggcgaacccctgctcatgccgcttgtccacgagaatggtctgcgcgatgggcgcgtacgtgacgtccatcgccagacgccattgctcgtccccctcgtccacgtccatcagttcggccacgtacggcagttccgtctcgtccaagcccgtcgcccgtgcgatgagcgtgcgcgcatggtccatgtcgtcgctgatgcgcgtcctgtgttcgatcttgcgccggtaatcctgcctcaacaggtcgcgttcgccctgccgggcgtgacgttccaccaccatccgctggtattcggatcgcgcgtcttccaaacgcttgtcgtacgtgtcgagcgacaaggcgagcgcggcgcgtttggcgttccatgtctgctcgtcggcggggagtctgccttcgacgcgttcgaaccgttcggcgatggcgtgccgttgtctgcgcgcctcgtcggcgtcctggcgtgcgcgttcgaagtccttgccgagttgctgcaggctgccgccgtcgatgccgttcatgcgttctttgacggcttcgatttgcgtgtcgagttcgtcgatgcgctgctgagaccggtcgatggcgtcctgggattccttggctttgcgttgcgccgatggcagtccggcgcgtacttcgctggccatgcgcgaccatgtccatgcggcgagcgtcgtctcgccttgctcgcggtcggggtcgatgggcgtgtattcgcggcgttcgctggcttgtttggcgtattcgccgtagcgggcttgtatgtcctgcaggatggcgacgcgttccattttgtcttccatgctgtggaagttctcactgaaccggttgtagtcgtcgacggtttcgcgggcgagccggatggattcgggcacgtcgagcacaccctgtttgaagatgtcgtcgagtttggagggcgcgtcggcggattggatcttgtgcaggagcctgcatgcttcggcgcttaggcccatgtcctgccagatggaggcgtggaacgcctgcgcgttgacgtgcgtcgtgcatcctgggtaggtctgttccatcagtcctcgcgtgaatgacgtgtcgcggtgccggtccatgaggcgcgggtcgatggtctggttccaggtgacgtattggcggcgcagtccgtccggcccgtcgcctgcggtcaggtagaggaattttgcgcaggacaacagtcctccgtcgctgcggttcgcgtatgtgtcgacgatcgcgccccagatgttctgcggggtgccgtccgcgtccctgccgcgcaggaagatcggggtctcaccgttttcgccgtcgctgatgccgatcatgccgcgcaggtacgtgtagtcgttgcgttccgaacgtcccgaattcgacgccttattgtagggggtgccggatgggtagagcagcgagatctgcgcgtcgacgagcgtggatttgcccgattcgctcgcgccggcgagcagggtcaccggcatcgcatcgtccatggacgggcggaacacgtggtagccgccgtaggagccccagttgacgatctgccggctttgcagcatccaacggtcggaaacgattttcatgccgtcttccatcagtgtttccccccatcaaaagcgtcatcggccgaatcgaaatcgaacgcgtcctgctcgacgccggacgaaaccgtcccggtcgaatcggaagtatcgccaccatccgcgccgatggacgaatcgtcataaccatcgccatccgcgtctttcataccatcgccgtccgtatcatcggagccgagccaccggtcggcgagcttctggtcgagcaccatcggcaccaatggcgtgagcacgtacatgttctcgtcccccgtttccgcgagatacccgtaggtgcgcatgcgcgagatgacggacgtgatcttcttcgccgtgccctcctcgtcgttgctggccgtgaggaagcccgctcccgtggcgagcagcgcgcggatgtcgtcgaagctgatgagccagtcgcccggcttcgtcttctggttctcgtactccagcaccttgatgcgcagggccgcgagcgtggcggcctcctcgcgggtgaggctcacacgcgtcttcaacgagcggatgttcgtctccgcgtccgtgaccggcgacgcgtacatgatccggtatttcgtgttgtcgaccagtctgagcatgtcgttgttcaacgaccgttccacggcctcacggtactggcacgccctgtcgtacaggctgccgtcgatgtagcgttcgcgtttcagcgcgatcgcggccatacgcgcctcaagaggcatgtctcccgtatccccgtcgaacaatgccggcctgtccctcgtcatatccggcccttcggacggcatgccggattccgggcctgtctcctcttcgatgccgatgccagtgtcgaatccgtcggtgttgtccgtcatgctcatccctcctcgatgatctcgtcaagcgccgcctcggtggtgaggatcggcctggtgcgccacacgcgctcgcctccgtcgatggatacgcaatgccatgccacggttgccggtccgtcctgcgtgcgtagggcgcttaggaagccgatcagctcgctttcgcgccgttcctcccggggcagccggttgaagctcgccgcgaaatccacgaacctgccgtccgccgttttgaccggatcgcgcctgatgagtccgatcatgtgcgtcagccgcgggccgcacatctcgaccatggccttcaggtccggcgcgtcgacgttcgtcgaaggcgcgtcgtccaatccggccgtggccgcgcgcgccatcgatttcgccggcctggacggcaatgcctggaactgcgccgtaccggtgtccgtacggtatgggcgttcgtccgagccggggtgcgtcttcgcatcgtcgctggcccgcacgaacagtctgtggagcttgtcgagcatggtgcggtaatgcgtgtcggtctgctggcgcaccagacggctcaccgcctcgtcggatatgcggatctgccggcgcacgtcctcgatgccctcgtagatgcgtttgagttcggcgcgtacctgggcgagcaggatgccaggctcgccctcgagatacgggttctgggcgatgtctcgcaccgcctcgtcgatttcgcggcgtccctcgtcggtgacgatcacctggaacgcgtcctcgaaacgccggccgctgtcggattcgtggaacgacctgtggtattcgtcatggtaggtgccgagcgcctgctccacgctgatggagcccgactgcatgcttcggcgcagattgtcgccgttgtcgcgttcctcgagcgccagttcgcgcaggtcgatcggcacgccgcgcagcgtgttgtggatgacgccgatgatgtcgcccacctgctgggaggtgagcctgtccaacgtgtcgctgtgcttcaattcgtcgatctgcttttgccgctcctcgatgtcgcgttcaagcaggcggatgcgttcgcggggatcgacggtcagctgcatgcgcgcatgctcgatctccatgatgatgctgttggcctgcgctccggacagcgctttcgtggtgtcctcgagccggtcgagcgcctcgatcgcacggtgggcgcgcgccgtgagacggtacgggtagcggtgggctgcgacgtcgagcgaattggcgagccaggcgtagtcgccttcgccttccttcgtcagctgctgcaggatcgtgtgcgcggcttccgcggacgtctgcccttccttgggcgtgtaatcgcccgtttccgcaagtcgggtcagactgcgggagaaccgttcctcgacgatctcgcgtggcagctcgccggtgagcgggtcgaacgtggagcgcagcagcgcgacgtacagcatggaattgccgcgcagcagcaatcgcagcaccccggtctcatacacgggccggagccgttccatttcccgtcttacatccgccaacggcgtcccgtccttcccttagccacaagtttcccgatgcgcatccattgtaagatagcatgtccgttttcccgtgatcgcggcgggaaaaccgtccggcgcgaacgtcatttgaagatgacgtagcggcacagcaggaagccccagaccgcctgcatgcccatggtgacgatcttgaccgccatggtgggccagccgagcagtccggggatccaggccatcatcaggttggagaacagcaggttccagcagtacatggccacgaacatggctatcgaacgcgcgtagttcgacgaggatttgaatgtgacgttgcggttcatgacgtagttgaatgagccggagcagaagacggccacggcattcgccagacggaacggcaggccggccagctgaagcacggcgaacacgccgaattccacgaaggtctgcatggccgaaacgccgccatagctgaacaattgtctgacgatgccgtttttcggttttccgtccgtcggcatgcggtctcctcccggtcgtctcaaacgctacggctggaaagcatagtcacacatgtggctacggacgcgccggaggcgtttcggcccggcggaatgaaaaaacggaaggacgccccttccggagtttccggaagaggcgtcccccacgttttcggatcgtgtccgctcagatgctcatcgccatgagctgggccgcatactcctccacaagctcgctgtcgcgctccgtccaggaatggctggcggaatcgtccggcacgaaagtggtgtcgatgtcgatgttctcgttcatttccttaatacctccgttcgtcccacttgcccccggcgacattgccgactttcatggaacaggcaaaagtctggaccataaacgcgttcgatgcaagagtgtgttcacatcgtgatcaaacgtttttcctccacgcgtacatgccgtgtctccggcgtgaagacgatacgatggaggcatccctgccaccaaccaaagaaggacgatgatgagcgacgaacgcaatgaggccgaaccgatcgaactgggatacatcgaggacctcggggacatgatttccgttcaggaggggtccaccgtgtcccgcaccgtcatgcagaaggccggaggcaacgtggtgctgttctccttcgacacgggcgaggagctcagcgagcatacggccgcgatgccggtgttcgtgcagacgctgaagggacggcttaaggtgacgggcaacggcaggaccgtggagcttgttccgggaggcctggcctactttcccacccgcatcccgcacgcgatatacgccgaggagccgtccgtcatgatgctgacgatggtcacgccggcacgcgacaacatcggcgactgaaaaaacaagaccgccggcatcggattccattggattcgccggtgccggcgactgccggaaatacaagaaaagctccctcccaggagctttcgttttgtggagcggacaacgggactcggacccgcggtctcaaccttggcaaggttgcgctttaccaactaagctatgtccgcatgttttccaccttggtgggcaacgagttgaaaatatacaggagcgtccgccatcgcgcaagcccggcgtgtcgcgtttttgcggcgccggactcgcggcagctccgcacgacggtcagacatagtcgtacggcatgcgctttttaacgcgccagaacacgataagcgcgatgtcgaagagcagcgcgtagaagccacggtccgtccacaatccgtagaccgcgcaatacaacaccaacgcgcgtaacgtatagaacacgatcctgcgcatgccggaacgttccctggtctccaccgtcatgcgcgtgaaaccgccgcccaacgtgcggccggcgcgcctccacggaatgatcccttcgaacaggacgaacatgacgatggtggccacggcggagacggccgcattgacgttgttcgcgcggttcacatcgaacagcacgccaaccagatagataagcgccgtgacggacagcgacgccgtttcgacaaggaacaggtcgatcgcgagcgccacgcagcggcgcacgaagcctggctcggtggtgatggcgtcttcgtcgatgcgctgttggggtaggaagtgggtgacaatgcttcccatggcgtagccgagtatgccgccgagggtgttggtgatgaggtcgtcgacgtcgaataggcggtaggcgcatggatagatgccccagatgccggtcagctgggtggtttcgatgagcagcgaggtgaggaacatggccggcaacgccgtggcgaatttccagcggaagacgcgtttcatgaagtagccgagcggtaggaagaacacgacgttcatggccagttgcatgacgcctgtgatgccgtcggttcggatgtcgtggatgaattcgaatgggttgagttgtggcctgagatggtgggcggcgcagtaggtggccgggttttctggcattgggtacatggtgaagcatgcgagcgcgatgaggtagagcaccacgagatatgcggtcagtgcggaggtgaagcgtagccggttgtcgcggtggtagagcagtgcgagcacgggcagggtgagtaggagtgagaggaatggccagattgcgatggcgagcgcgaatggcttgctgaagtagaggacgtatgacatggccggtttcctttgctgggcgtgtgggatacgcgtggtgtgtgtgcgtgggtttcgtttccgttgttggtttcaacggtagtacggctggtcgtgtccgtggcatcgtccgtcgtattcattccttggcgtaaatgttggggtgactcatcctctggtatgagatggcccggcgtgtttcttcgtgtctttttcctcttgctttttccgttggattgcttggcgtctgatccgcgcggaaccgatttcggacatcgtcttcgccgtcaccgcgggaatcctgttcatggcgttcacgccgaaactgctcagcgaataacggaagctcccgccttccacgcggaaggcgggaaaggcgggagctcttatgggaagactaaggcggattttaaatccgaggaatagtcacctttttggcaccggtcatgtaatgccagaaatcttccgtccccggaataaggtcatgcagaacgcctgatgttttttcgaccgctacgctcggtgtgcccggcaccggatggtcatctgttgaagacgcgaaatcgagtccgatgattcacgcatcggcactctccgcggcaccaatcgccttcattccaggatattcggcgagaacgagattgatggcatcggccaatatcatctgaccctccttgcagcattccagtactgattcgtcggattcggctttatacgctttatacgcgtcaaaacgtcaccgtccatattcaaataccatgagtcgtttgccgatctcgtttgcggagcgggggaatcattccgcctgtttgacgcgttccatcgtagtatccgttgaagggcgttcttgttggtcttggtatccattcctcttatcacgtttccgctgtatgctttagggaaagctgttatgtgggaggatcatgcggaccacgaaaagcaagaaacccatcaccgtcgtatcggtatgcgtcgccgccgtggcatgcgctgtcggcgcgtaccggttcgtctacctgccactccggcctgccgatgtcagtcatgctcggatcagcatcaacgcgacgggcaagttcgacgaatcccagatcgacggcgcggtgaaggcggatcttgccaggctgaaatcctggaacggttgccgcgtggatgccgtccgatatgacgcaaagcgttcggccacgctgcttgcagccgaacacgacgtcacggcttccggtggcagttcttcgatttccacggccattgacgaatacgggatggacaatgtgatttacctgtccaatgacatctcttgccgtgcgggctcgcagaactcgtcccaagatggctggggaagctggtacgcgtggaatcccggttccgcgcgggcggaacacggatggatcttcatcgacgagggatattaaagttcaacggaataccgtgcaccatgccatgatgtcgaaaccatacgatgacgattggctttagtacagcattgataaaaagcgggcctacgcgtcctgatcacgcggaacgcaaacccgctttcgatggcatagtcatcgcttggcttatctgactacttggtggtggccactcatcatgactggccaccaccaatgctcccggatagtcggcaagacatcttgccagagccaccttggactctaagtcaagatagttcgccggctcgtccatgacaatcaactgaggccggtcaagaatgcccaagcacaacatgagcttgcgcagttcgcccggagacggcgcttcgttagaaagcagcttatccggatcggcgttgagctgggcgaaggcggccagcacctgcgagcgttccttaccctgcaatgcggcgagtcgtctcatggtttgagaaagcgcggcttctcccgtttgctgctggacgatcagatgcggcaagtcttccggcatgctgtccagcaatgcgttcatcacggttgttttgccgagtccgttggcaccggtcagtccgatatggtcttgctgtccgatgctgagttttggtatggcgacgcctggcatccgtggtttttcaccactcatccctggattatgcgcgaccttccattgatgtccgtcggcatgcagtatggattgtgttggcgttctcgcggcatcgttcgagctggtcatcctgccgctgccgaatatgataataccttccgtgagatgcaggagctcctttctgttgcttggccgtatgtcgatccagatgtcgccgtcgtagcgtttggccgctacggttagtgaatctagtgtgcgctgtgctcgttcaagacgcttgttcatttgtcggtatgcggcgcccgaagcggtatcggtctgtttttcgatccatttgtggtgatcgagggcgctgtgatctttgcggtcgattttccactcccgtttgcacgagatgtcgcatggcgaaggttttctggagattctcctgtcccacacgggaaagggtctctatcttatggacgaacccgaatccgcgctctcgacacagcggcaattgactctgctggagcacatgtaccgaatggcaaacgacggatcgcaattcatcatcgcaacccattcgccgattctgctcggtctgccggatgcggaaatcctgtcattcgacgaaaacggcgtccatccctgcgattatgaggatacggacagctatcaaatcaccagggtcttcatcaaccaccgcgaatcactgctccggcatctgcttggaaatgaaacgtgagatgaggtgaaacggttgcgggtgttcgctatgatgttcgattggcgtttgaaggaacacgaaagactagaggtatcacggcatggcgattgaggcgcagggacttgagattcagatcggtgcgcgcacgttgctgcatcccaccaacttccacgttgccaagggggacaagatcggtctggtcggacgcaatggagcaggcaagaccacgctgacccgtgtgatcaccggcgatatgctgccgaccgccggcaaggtacgtgtctccggcaaactcggctatttgccacaggacacgcatgccgccgacccggagcagaccgcactggaccgcatgatgagcgcgcgagacatcgccagcatcatcaaacgcatacgcaaggccgaaaaggacatgaccgatccggatccggatgtcatgaccaaggcgatgaaccgctacgacaaggccatgcaggatttcgaaaaggccggaggctatgccgcacagtccgaagcgaccgcgatggcggccagtctcggcctgccgcaggacgtgatgggccagcagttgggtacgctttccggcggtcaacgccgccgtatcgaactggcgcgcatcctgttctccgatgcggatacgctgatccttgacgagccgaccaaccatttggacgcggattccatcgaatggctgcgcggctatctgaaaaaatacgagggcggtttcctggtcatctcccactccaccgaactgcttgacgaagtggtgaacaaggtgtggcatctggacgcacagctcggccagatcgacatgtactcgctcggctggaaggcctacctgcaccaacgcgtggtcgacgaggaacgtcgccgccgcgaacgtgaagtcgcagagaagaaggccgaacgtctgatgcagcagggcatccgcctgcacgcgaaagccaccaaggccgtggccgcgcagaacatgatgcgccgcgcggagaaactgctggagaacacgtccgaagcacagaagaaggagaaggtggcggacatccgcttccccgagccggcaccttgcggacgtacgccgatcatggcgaaggacatctccaaagcgtatggttcgaacatcgtgttcgcaggcgtgaatctggcgatcgacaaaggttcacgtgtggtgattctgggctataacggcgcgggcaagaccaccacgctgcgtctgctcgcccatctggaggatcccgacaccggatccgtggaatatggacatggctgcaaaatcggctatttcgcacaggaacacgacacattggaccttgacgccaccgtgttgcagaatctgattcacgtggcaccggaacttgacgacacacaggcacgttccatccttgggtcgttcctgttctccggcgatgacgcgctgaaaccggcacgagtgctttccggcggcgagaagacccgtctggcgttggccacgctggtgacgagccgcgcgaacgtgctactgcttgatgaaccgaccaacaatctggatccggcgtcccgcgacgagattctgaaggccatcgccaaatacgagggcgcgattgtgctggtcacccacgacgagggcgcggtcgaggcgttgaatccggaacgcgtgctgctcatgcccgacggcgacgaggacctgtggaacgactcctacctggatctggtggccgaggaataatcccacttccaccatttccgacacgcatatgggaaagcccggacgaatcagatcgtccgggctttcccatattgaacggttcctgttacgcgggaaccggttacgcgtgcacgtgtttggcgctgtagatgtccggctcgacgtagatctcgaaattgtaccagggcaacgcggtgcgcacggccttctcgatcttgtcgacggtttccacgtcatagtcgcggtcgagcttgctggtctgcactttgacgcacaggaggatgtcgtcctccgacatgtgcacggtctgcatgttcagcaatcgttcgacgcccggcgtggtggtaaccgcctcgacgatcttcccgcgcgtatcggaatccacggcttcgccgatcagcagcgaaccggatttgaacgccagtagaagcgaaccgacgatcaggaccagaccgaccataagaccgcccaacgcgtcgaacacctcgtcgtcgagcgcgatagcaagaccgatgccgaggcctgcgaacgccaggccgatcaaagcgagcgtgtcctccatgatcaccgaagccaattcggcggacttggtgcgcctccagaaacggaacacgcccatacgcggcgtgttcgtgcgttccatacgctcgttggcctccttgatgctctggtgcaggccgaatccttccaggcatgcgctgatgacgaccacgatgaacgcgacaagcagttccatcctgttcacgtcacgcaatgccggatcggcgctgatcgcgacaagcttcttcaccgcttcggacgtcgagaagaaaccgccgacgaagaacagcagcgtggccacgacgaacgaggcgagatacttcgcacggtacaggccgaacggatggtcgccgtccgtcttgcgcttggagaaacgtccacccaccatcaatacgatttcgttggagcaatccgcgatggaatgtaccgactcggaaagcatggcggacgatccggtgaagaacgccgcgagcagcttcgcgatggcgacaccaatgttcgcacccaacgccgccttgacggccgcgccctgatgttcggcttcccgcacctcccccatgttgttcgtggtcgtactgtcgcctgcgggatcgcgcgattcgctcattgccttccattctcgaatgtgtaacggataacatcatccattcaagcacgaatactggccgagaagccgtgtgcgcccgtgtttcgggacgtgcgtgtaaccttcactaggtatttgtcgctttcccaaaaaaaggggtattcaatggtatactcgcataacgcgccgttccgcgccgacgtggtcggctcctatctccgcccggccgagctcaaggccgcgcgtgaggatttcgccgccggcaaaatcgatgccgcagcgctcaaggcggtcgaggacaaggccatcaccgaactcgtcgccaagcagaaggccgccggcctgcatgtgatcaccgacggcgaattccgccgcggctggtggcatttcgacttcatgtggggcttcaacggcgtggaccatgccgccgcagcccaccgcgtcgccttccacgacgaggtgaccccggccgacaccgccaccgtgaccggaagaatctccggcgagaaccatccgttcgtcgaacatttcaagttcgtcaagcagttcgaggacgagaacaccgtggcccgccagaccatgccctcccccgcgcagacccgcttcgtgctcaccggcaacgcggccgcctacccgtatgacgagttctacaagaacgacgacgagctgaccgccgacatcgtcgccgcctaccgccaagtcatcgccgacctgtatgccgccggctgccgcaacgtgcagttcgacgactgcacctggacccgcctgtgcgatgcgagcgtacgcgaacgtctcggctggagcgacgaggacgcgctacgcctgcagcaggagaacctcgacgtcatcaacgccgtgatctccgaccagccggacgacctggtcatcaacacccacgtgtgccgcggcaacttccactccacctggctttcctccggaggttacgcgccggtcgcggccaaactgttcggcgaggagaacgtggacgcctactacctcgagttcgacgacgaccgttccggcgatttcgcgccgctcgccgaagtctccggcgacaagaaggtcgtgctcggcctgatcacctccaagaagcccgaccttgaggatccggacaccatcaaggcccgcatccaggaagccgcccagtacattccgctcgaccgcctgtgcctgtccacccagtgcggcttcgcctccacccaggaaggcaacaagctcaccgaagaccagcagtgggccaagatcgcactcgtccaatccatcgccaaggacgtgtggggcgagtaaacacagcacgccatccacaatcagctataaggaagggctatccgtcttgttcggcggatagccctttgtttgtttgccggcgtttttaacgggcaggtcagcccttcacagcctcatcgatgcaacgaatcgcgttcaacgtacgcggatagccgatatacggcatgcactgcgagaccaccgcgattagaaacgccttctcattgccaacgaccatattcgccttggcatgcgccgtaagctgcggttcgcaaccaccctgcgcggccaggaaacacaacgtgaccatttcgcgctcgcgggtgtcgagtccgccgcgagtgtagtagtcgccgaagcagttgtcggccagccacttgttgatgtgccgggtctcctccggtccggattgcgcgaatccgcgcatgttctcgccgaagatctcgacctgcttgtcctctccggcctgcgcgcgggtctccgacgtggtcgtgccctgcggctccagcggcagatgcacgttcgcggctccaaggaaaacgttgagcttcttcaggaacggcagggttctcccgaatccgcagtatgcggtggcttggtagatcatctccttgatggccacggacgtcagtcctgtctcgtaggcgaccggcagcatcatttcgaacgcgtcgagaccctggcagccgaccagagccgcgaggatcgccagggagcgggtctggtcgtccagatcgggatggttcgcgcccggctcgttcaccacttccccgtaagcgaagtcggaaaacagcttgacatattccggatcggtctgcgacagcgtcctgtcgttgttccagaacgcgttcatcttcctatgcagttcctcgaacatggcttcctttccattcgatgtcttcgcgccgcatgccgcgttcattctatcgtcggaaatgttgcgtgcggatagcggccatcgtcgtctgaatgttcagcgtgcgatcgcgcccttgccgggctgtttcttgacgttttcgatgacgtctttgttttcctcgagaattcggttggcctcatcctcgtgtccttcggcgatggcgcgccaatagagcgatttgagcgacacgtacgcctgctggatgcgcagggcctcggcgttcgcggccagacgcagcgattgcgcgtcgagcagttcgatctgccgtcgggcgccttccggaccgtcgaaacggttcttcaggtattcgcgcatcgattcaagcggcatgcccgtcgccgccaggcatgcgatggtggtcagcgattcgatgtccttgtccgaatagactcggtggcctgaactcggatcgcgggcgatcggatcgatgatgccgatctgctcgtaataacgcaacgtcgattcgggcagtccggaaatcatggacgcctcacggatcgagtgccaggtggtcgtcgtattgctcataccccgcactctaaaaacttaaagtgctcgaagtccatattccggcgtgtcgtattggtccgacgtcaaacggcattgagcgggcaatggaagagccggtatccgaaaagtggatctgtcgcacgactccatttttatgtccgtttcggcaatcgtgcggctttttcgtccgtctgtatgggaaccgacggacgaaaaagcccacgcatgctcaggcggcggtgatcagctccgaggaatccatgtcgaaatcggccatcgcgtaggagcggatggcgggatcatcatacgtgttcatgtagtacgtgttggtcttggacgaatatccgctggtgaacagcgtgcgttcgaactggccgttgctcatcttcgccatgccgtcaaccatctgcacggaaccaagggtgtggaacaggcgagacacgttggccgcctcgccttcctgctgcggataatgcgtgttggcataagccacacgcacgaaacgcgacggggagctcacatcgcccggaatgccatgcatgctcacacccgcgccccaagcggacagggacgccttgccccacgtggccggctcggccatctcgttgccgacgcacatgtagttgcgcagattctccatatggaagccaaacgtcggctggttggtcagcacgtctacgtcgtcatggtgcacatgcatgccgtccgccatctgttcgacgacgatgctgcgctcgctgtcgccgatgatccaatgcagcagcgactcctgctggccgggcacgatctgggagacgagggtcacgttcttcaacgcctcctcgacttcgtcgacggaatcgaaattgcgtgccacccacagcgggaattcgaaggtcgcgacgttgtcggtgccttcgaccggctcatgcacgaactccgcgtagccggggaaattcaatcccgcgatggccagaccatgctcgttggcgcagtcgaaatacatcggacggtcggccatgaccacgcccacgccgatcaccgcgttcggcgtggctttgccgctcgcgccgaacacgttgtcgtagtggtagccgcgtggagtggccaggatgctttcgccgtatgagaagctccagtcgaggttgcggccgaaatacatgtttccctcttcgtcggagaaacgaacgccagtgcacatgatggacttccttcctttgtttgattgacccgatgcgttcatcatacgcatggacggctggacgaaccacggcttccgccgacggataaacatgaagggtggccaaaaatgccaagagtcgttgaaaatgaaaaaatccccttgtttccaaggggattttttgaatggctcctgcgactgggcttgaaccagtgaccgtccgattaacagtcggatgctctgccaactgagctacgcaggaatgcgctgtgcacaagacatgaatcatacgcggtaaaacgcaaaatgcaaatcccgcgcgtgtctcccctgctgcggcgggactaccgtcacatgctgatcttcgtcaacggcatggcggaatcgattgcgaaatccggttcggacggtttcacgccgctctccaccaggttcacgcccagcatggccaccatagcgccattatcggtgcacagtttgatttgcgggatacgcacttcgacgccatgcttggctccgacctccaacagtttggcgcgcagttgggagttcgcggagaagccgccgccaacgatcagggtcttcgaaccgtactgctcgcaaccgcgcatcgccttcctggcgagcaccgtcgcgacggaatcggccagcgacgcgcacacgtcgtcgatgggaatctcattgccttccgcctgctgctgttcgatccaacgcgccacggccgtcttcacgccggagaaactgaaatcgtacggatgctgctgccccgccttgccttgtgtaaggccctgaggcactttgatggcatgtgggttgcccagctgcgcgtgacggtcgatgtgcgggccgccgggatacgggaaaccaagcagacgcgccaccttgtcgaagcattcgccggcagcgtcgtcgagcgtggtgccgaccacgtcgatatgccgcgccacgtcttcgacatgcagcagcgaagtgtgcccgcccgacacaatcaacgcaagcgtgtccttggggaacggtccgaactgcagctgcgtcaccgcgatatgtccgatgacgtggttgatgccgtagatcggcttgttcgcggcccatgccaacgatttcgcgccggacacgccgaccgcgagacagccggcgaggccgggtcccgcggatacggcgatcgcgtcgacgtcggacagcgtcatgttcgcgtcggccagagctttggagacgcatggcacgaacgcttcggcgtgcgcgcgagaggcgatttcgggaatcacgccgccgtagcgggcgtgctcgtccatggaggacgcgaccacgttggaaatgagggtgcgtccctgtaccacggccgccgccgtttcgtcacaggtcgattcgatgccgagtacgattggttcgctcattgctgctccgttgtgtgtgttgctgaagtgtgctctgtatccgctgttgcgctgaagccgacgacgcgcggctccaagtcgaggctcatggtgtacgcgtcgatgccttctggctggtagtagcgtttgcgcaatcccatccgcgtgaagccgaacctttcgtacaacgccaatgccggcacgttgtcgacgcggacttccagaagcatgcgtttggcgccctgccgacgcgccgagacgatcagtgtttcgagaagcgccgccgctatcccctgccgttggtatggtctgccgacgccgatcgtcatgatttccgcgtcgtcgccgtcgtaccagtagcctgcgtagcctcggacgacgggatccgccgtctgtacggcatcgccttcaatgtcgagcagatacgtgcgtgccggagcgtggaattcctgccgtacggactgttcgctccacgcgccgcggccgaacaggtccttttccaatgcggcgatctgtccgacggcggtgtcttccggaatctgggaatggtcgacaatcatgggcgtgccgtcactccgttcgttcggcgccggcatggttgagcacatgcttgagcgggttgggcactgacacgtccggacgacgcagatataacggttcgacgggggtcggttctgccaacgcctgttcgctggtggtgaaggccgcgaatcgcgccaatccttccgcgccttcgtcgagcagagcatggtcgtcgacttcgccgagggaggcaatcgcattccacgactgcgcgtatttgaccgcaccatggccgatgacgtcgacgacgtacggcttgcccgtgtcggcgagcttcgtaagaacgtcattgacgcgcatcgtgatggaatccggatagtcgatgtccatgtcgatcaacgttatgggcgattgtccgacgccgtccgcaacggtgccgccgtcatacagcgcgaaatacagttgccggcgacgcgcgtcgttgacggcaagcgtcagatggcggcgatcgtccgtagcttgagtatgtgccaggcattgcggcgcgagcacgtcctgtccgaccagttgcgcgcctgtggcgaaggccaatgccttggccgcgacgatgccggcgcgcaggccggtgaatggcgccggtccgacgccgacgacgatgcgggtgatgtccgacgcctgcagtccagcctgttcgacggcttgcgcgatgttcacctgcagtttctcgacatgggtgcgcgaatccgtttcgacgatgggttcatgtccgaccacgcctacggtcgaaccatatgaggtgtcaatcaccagtgtctgcatatgcttgaaaactccttgtgccaaactgccaaccactgtacaaccggcgctggaagccacggcatgcggtgcggtcggccacgtcggatgcgtcttagacagggtcagcgttttcccgcggtgaaatcgaacgaatcccaggcagcgcccaccggcaccaacgtcaccgtgcgtgcgcccgcgctggtcagctcgccgtccgcggtcacggcgggcgcgtcaagcggacggtcgatgtggatttcaagccgttccggagccaatgcggcggccatctgctcgccccattccatcaggatgacggtatgctcgcccggatcctccaattcctcgtccaagccgagcgattccaattcgtccaatagccgtccgaccgtgtcctgtccgggcgcgtaggcgttgccgccgagcctgtaggcgtcgacgtgcaccagatgcgccggcgaaccgtccgcgaaccgtccctcaagctcgcgtgcgatggtgaaggtcggcgagacgatgggctctccgatgccaagtcccgcgccgaacccttgcgcgaacgtggtcttgccggcgccaagcggaccggacagcaacagcacgtcgcctccacgggcaagcttcgccaaacgctcccccaacgcctgcatgtcctcgccggtggcggctgtgatggtaatggtgttgctcatgcggcacgtcctttgcggctgatcagttcgatggaccgttccaaagcatagaccgggtccgagccattggttttgctttgctcgtcggcccatgcgagcatctggatgcatgcgctcatgccgcttgacgtccatccggatagttgccgggtcgcgttcttcaacacccaggggttcgttttcgcctcggccgtggaaatggtgcccgcacgcaccgccgacgccttcgccatcgtccgcagcttcatggccagcgcgccgataagcgcgatcggagcggtgccctgttccacggacgatcgcatggcgatgatcgcgtccgccgtacgtcccgacaacgcgaggtcggcgacacggaagccatccacctgcggattggaggtgagatattggttgacgcggtcgagcgtcatgggattgtcgtcgaaatcgaagcataactggccgaccatggccgcaagctcgccggtcctatcccccaacacggccacgagttgctgcgcggccatcggctcgacgcggcgtttgcgccgttcgaagcattgcatgacgaagttgagtttggcctcgggcttcttcaggtcggcgacagcgtccttgtacgctccggccttggtgagctgctccaccagacgtttgcccttcacaccgccctcatgctggcagatgacgatgcacgcgtccgccggctccttgcacgcctgtctgcagtaagagaccatggcgtcgcccagtttttcgtccgcgttctgcaggttggtgacgatgacgatggcgcgatccgcaagcaatgatgggcttaccgcttcgtcgaaggtgtaatggtcggcgtttgccgcgtcgagttcgatggtttccgcgtcgggataccggcgttgcgcctcgtgtttgaggtcgcgcaccgtctggtcgttcaggtacgagtcgcctccgtacacgaggtggaagggcgtggtggctgcggatggtttcggcataccattcaatctcgctgtatcggtggacaaaaccggcatggcctattcctcccattgcagttcgcgcaatgccttccgagtacgttccatccacatgcgcagccgttccacagggttggctatcagacgttttccgggcagatcgggttcctggaccatcatttgtccaaacagccggtgcgtcatgatcgcggcggccgcgcaggcggcttccaccacgcagacgaggaccgctcccccgacgcctccggcccacggtatcgtggcctggttgccggaacccagttcaagggcggtcagttccatgaccgcggtgccccaggaggccgcacgggccagttgcaggccgagccacggaatcagccatgagacggcaagactggccaggccggccaatgtggcgaaacccacgaacggcgccaccatcagattcgccggtatggagaacaccggcagttccggttcgatgagcacctggatcggcagggtgaacacttgcgccgctatggtcatggacagagcctcggccacgaaccgtggcaggaccggttccatccatgcgttgagggtgtcggcgaacagcacgatgccgagcaccgcggcgcaggacagggcgaatccgaagctttgcgacatgtgcgggcatgccatcagcatagccaatgtggtccagctcaacgacgccatcgcctggcctcgtctgccgatgaacaggcatgccgcgccggacaatcccatcaaaagcgcgcgggataccgaatccgacggaaacacgcatgccgacagcatgatgtacgacatggcgaccagcagtgcggtgaatcgtcgcggcagaaggaagaacgagcagacggaacgcaccaatgcggcggtcacggccagatggccgccgctgaccgccatgagatgcacgattccggacctttggaacgcgtcctccacctgtgcggcgtatgtggaatcgatgtcggtgccatcgccttcggccggcacatagtcctgtccgagaacacccaatgtcagtccggggacgagcactttcccttggtcggaaagacgtgcggtttggacgaagaacgcctcctgcatcatgccgatggcgcgcatcggcaggtttggcggcctgacgtgttcgactgtcgtgacgtcggtcagccacaacggcatggcaccgtatcgcgctttggagatgcggcccgcgatcttgtaggtgccgtcctgtttgagtttgccgcattcaggccggtccgcgtatatacgcgctcgtgccgaactggtttgccgtacgccgtcgatggtgaccgatgtgatgcgcgcgtcggcacggcagtcgttcgaccgtctgtcggagatgacggtcggcgaggtggcgcgcgccgtgacgacgacggaagcgtcgccttccgcggccgcccgagaagccgggtcgcgccattgcagcaaatcataggtcaacgcgcttgccgcgcaaaccatcgcagcgatcgcgcagaccgtgacgctcgcatgccagagcgttatccgtcgtcgaacggacgccggcaatcgtgggaagggcagtcccgccaggaccgccagcggtatcatgcaggtgagaacggccggcaaagcgccgagcatgccgtcatgcgacatgcaatatgcgaagccggcgtgcgcggccagactggccgcccaaccgcatattgcggccggcagcagtctccagtctcggctcccgcgctccctggtcagccaatcgcgtgtgcccgtcatctcacgcacacttggtcacggaacttcgccagagtcttcgaaccgatgcccttgacttccagaagctggtcgacgttgtcgaaccgtcctatctgcgttcgatagtcgaggatgcgctgcgcggtgaccggtccgacgcctttgagggtctgcaattcgcctaggtctgcggtgttgaggtcaagctggttcgattgctgcgctccgtcttgcccgtcatggctgtccggtgtggacgcgtcctgcgtcggcccgttttcttgcggtgccggcgtttgttccgtttgcggggcctgttgcggctgctgttgggcctgtgagcgtatctgcgaccgtgaatgctgcagttcgctgtagtggatcgtctgttggacgagcatggtcaggctcgcgcacagcgcgcacgacaaagtgaggatcgccatgagcgcgtggaacgggcggaacgccaatcgtggcctgtcgcgtttcggccgctccccctcgtcgggtttgtccgtcggccggacgccggcgagctccgccaatgtcggtttcgcgtcatgcgtcttccgctgcggcatcggtcgtgcgggttcgtgtgatgcggacggttcgtccgattgcgcctccatggccgtaaggctgttgggtcgggacggtttttcgggcatgcccaatccccgcagccgcttcgtggcggccggcatgccagtgccgccgtccgccgtgtggatggcacagatggggtgagtgccgcaaaatgcaaatatgcccatgcatccaacattggaggatgcatgggcatactgtccagccgaaacggctcctgtggtcggagaacgcgggttatccacattcctggcgtgtcgccatggtgcggaagaacccgcgtcctcttatgcgggccgtctcgtcagaagatcattccgcgggaacgatggagacgatcttcggagccttgacgatgaccttgcgtggctccttgccgcccagtcggtcggcgacggcttcgagcgccatcttctccagctccttcggatcgatgtccggggagacctcgagcttggcgcgcaccttgcccttgatctgcacgaccgcggtgacggaatcctgtccgacgtaacgttcgtcggccttcggccagtcggcgtgcgccagggattcggtgtggccgagcttgctccacagttcctcgcagatgtgcggggcgatcggagagagcatcaggatcagcggttcgacggcggcgcgcggcacggcgtcgaggctggtcagatggttgttgagcacgatgagcttggcgatggccgtgttcggacgcatggcctccatctcgacggtcacgtcggcgatcgtgttgttaagcagcttcagcgtcttcgtgtcaagctcgccgtcggtgacgcgcacctcgccggtggtctcgtcgatgacgttacgccacaggcgctgcaggaaacgcatggagccgaccacgttgcgggtgttccatggacgggattcggccagcgggcccatgcccatctcgtacaggcggaaggtgtccgcgccgtagttctcatacatgtcgtcaggcgtgatgatgttcttcaggctcttgcccatcttgccgaactcgcggttggcatgctggccgttccatgtgaacgtcggctcgccgttggcgtcggcgggaccttccaccacttcggcggccggcacgtactggccgcggtcgtcggtgtaggcgtatgcctggatcatgccctggttgaacagcttgtggaacggttccatggagtcgacgtagccgaggtcgaacagcaccttgtgccagaagcgggagtacagcaggtgcagcacggcgtgttcgacgccgccgatgtacaagtccacgccgccggacttgccggcggtcttgttgtggtccggacccatccagtagtcgaactcgtccttctccaccatgtgcttggtgtcggtcgggtcgaggtaacgcatgtagtaccagcaggagccggcccagttcggcatggtgttggtgtcgcggtagtaggtcttcttgccgtcgcccaggtcgagctcgaccttgacccagtcctcgttgcggctcagcggagcctccgggtcggattcggcgtcctccgggtcgaaggtcttcggactgtagtccggcacgtccggcaggttgatcggcagctgctcgtcgggaagcaggtgcggagtgccgtcctcgccgtagacgatcgggaacggctcgccccagtagcgctggcggctgaacagccagtcgcgtagacggtagctgacggtgcccttgccgacgccggcggattcgagccaggcgttgaccttgtcgatggcctcgtccacgcgcaggccgtcgaggcttagggaatcgcccttggccttggtcgcgtcgatggaggagttgatgacgatgccgtcatgggagacgaacggcgccttgccctcatagttggcgaggtcgtcgccggattccggcagcggcttgacggtgtagatgaccggcaggccgaacttgacggcgaaatcgtaatcgcgctgatcgccgcccggcactgccatgatcgcgccggtgccgtagtccatgagcacatagtcggcggtgaacagcggcagcttagcgccggtgatcgggttgatggcgtacaggccggtgaacaggccggtcttctcgcccgcctcgtccacgcggtccttggcggtcttggcttcggcggccagacggtacgccttcacggcctcgaccggggtggcgtagccgcccttccaatcctcgggggtttccgccggccattcggcaggcacgtcctcaagcaggtggtgttccggggagacgactgcgaaggtggtgccgaagagggtgtcgggacgggtggtgtagatctccatgtccttgacgccgttcggggtctcgacgtcgaaatgcacggaagcgccgtgggattcgccgatccagttgcgctgcatgagcttgaccttctcaggccagtcgatggtgtcgaggtcttcgatcagacggtggccgtatgcggtgatgcgcatggaccactgacgcagttcgcgctggaacaccgggaagttgccgcgttcggacttgccttcggcggtgacctcctcgttggcgagcacggtgcccaggcctgggcaccagttgaccggggacttggaaatgtaggccagacggaagtcgttgagcacgtcggcctgctcggcttcgctcaggtcggcccaggccttgccttcgaagcccgggatggcgcgcttgccggattcgaactgttcgacgagcgtgctgatcgggcgggcgcagcccctggagccggacgggttggtggcgtcctcgtcgtaccaggcgtcgtagatgcgggagaagatccactgggtccaacgcacgtagccggggtcgatggtggcgaaggaacgacggttgtcgaagctcaggcccatgcggtgcagctggcggcgcatgttggcgatgttctgttcggtggtgatgcgcggatgctggccggtctgcacggcatactgctcggccggcaggccgaaggcgtcgtagcccatggcgtgcagcacgttctcacccttcatgcggtggtagcggctgaccacgtcggtggcgaggtagcccagcgggtggccgacgtgcaggcccttgccggacgggtacgggaacatgtccatcgcgaagtaggacgggcggccttctgcgttatggcccttgccgtccttcaggtcgccgttgacgttggcggcccagaaggtgccttcgtcatcccagatcttctgccatttctcttcgatgccctgcgccagcttcgcgttgtagcggaacgacggttcggcggattcgttcggttgcgcctgcgcgcttttctcagtgtcactcatagtgcatgaaattagccgcgcaactggacacttcgcaaggaatcaaccactattcaggcacgtgcgccgccgttatttttccgatgccgcggacgcgccggaggacggggccttggccgttgccttcggcggattcatggacgcgtcgggcgtgtatccgatcgacttgcccatgtcggccgcggccttctgccacgagccgtccttgaccatggcgcgcaatgcggcgtcgatttgcccgaccagctcgtcctgtcctgatttgacggcgatgccgtaggaccaggtggtgtcgggaacgtcgacgatcttcagatggtcgcctgtgttgttcgacgccagtccggccgagatcgcgtcgtcggcggcgacggcgtcggcctcgccgatcatcagcgccgtcatgcattgcggatacgtgtcgcgttccgccaccgtcgtgcgggtgtttttcgtgcggttgcggatgttgtcgtccgccgcgcttccagcgaccgcgcatacggttttatcggacaggctgtcggtcccggtgatttcggatgcgctgtcggagcggacgagcagcgcctcccggaccgtcagatatggtccggcgacgtcggcctcaccatcgtgggtcccgtccatggagaaggaatccacgaccatgtccaccgtgccgtcggtgagcgcggaggctcgcatggccggggacagctgtttgaacacgatctgcttttccgcgtatccgagggttttcgccacgtatttggccacgtcgatgtcgaaaccggagtattcgcctccatgcaggtatccaagccccggctggtcggcggccactcctatcgcgattgtcggcccctgcgccgcgccttcggtcaccacggaaaccgatgtgccgcacgcgccggcgccggccgcaagtaatgccgcgcatgccgccgcggccacgtatcgcgcttttcccatcatggacgtcacttgaacatgcgcgaccgggtgaggaaccaggtgacgatcgccgaaaggaccagtgagatgccgatgatcaccgcgaagccccatggcttgtccgtgaggggcatgccgagcatgccttcctggaagttcatgccgtacatggagaagatcagggtcggaatcgacagggtgatggagatgatggtgaagatgcgcatcacgttgttcaggttgttcgacacgatcgatgcgaacgcgtcggtcatgttggcgagaacgccgctgtagatgttggccatctcgattgcctgcttgttttccgtgatgacgtcgtcgagcaggtcctcatcctccggatactgcttgagcctcggcagcgtggtcagcttctccatgacgatttcgttcgatttgagggatgtggtgaagtagaccaatgtcttgctcagttccagcagcatgaggatctctcggttctgcatggagtggcgcagcttcagttcgagcttgtcgctttcgcggtcgatgatgcgcaggtaacgcaggtacatggtggcgttgcggtacaggatctgcaggatgaaccgggtcttcatgtatgtgttgaagccgcggatggtgccttccatgaacgggtgcagcacgggcgtgtcctgcatgcagacggtgatgatggcggactgggtgatgatgatcgacaacgggatggtctcgtaccagtcgcggccgccgcgttcctccacggtaggaatgtccacgatgatcatcgtgtagtcgtcctcgacgtcgacgcgcgagcgttcctcgtcatccagaggggcgcgcaggtcggccaggtcgatgccggtttccatggacacgttggcgagctccacgtcggtgggcgccgagagacataaccaggagccgttctccggtttttggatttgctccacctggccgttaatcgttctgaacattctcaacatgtctctcacccgcctttcgcgctttccaacgttctatcgctgtacggaagcccgatccgcatgcggaacgatcgccggattcccggctcgccgcatggtcgggcaaacaacctcattaaggatagtcccaccgtgagaatttgccgtacggacggcggtgattccatcaagagttcactttggatgatgttttcggcgccgtgtattggatgcttattggatgatcggcttccacagcggcatgccgggcgcgcgcaacgattcgggaccgttctcccagtcggcgaatgatgcgatggcggggccttggttgaattcctcaagcttccaagtgggacggtccgcgttcctggggtcggtgtgcggggtcatgcgcgtccagaaggcgttgcgcatcgcgccgacgttgttgagatcgtcggggtccatgtcgagcagcaccgccacggtggccacgatccatgagccgtggccgacgagaagcaatgtggtaggcattgtctcgtcatggtgtttggcgacgatgtcgcgcacggcttccgcgccgcgtcggcccgtatggatgcggctttccacgccatgcttggtttcgcctcccgtgtgggcgcgccaggaatggtagtcgtcggcgtaatgctcgcagatctcctcgcgggtcatgccctcccattcgccgaagctgcgttcgcgcagacgcgggtcgagttccacgtccagccccatgaggtcggcgaaggcgtgcgcggtctgctgcgcgcggaacagatccgatgagacgacgagcatgcggcgggccgtggcgggcgcgttgttgatttcgctgatgtctgcgagatgcgcgccttcatacgtgggttgcgcgagctggtcgttatgttcggcgagatgcgcgactttcgcccaatagtaggttttggcgagttcgtacgcgctttggtccgcctgccaccgtccgacgatgtcgaggggaatgtcgatttgtccttgcagccgtctggcgagattgtatgcggtgcgtccgtggcgcaggaacagtacttcgtcgatcatggttctcgctttcttggttttcgcatccgatcagcggattgcccggaagccgacgggaaacggtaaagaaaaaggcttccgaatctctccggaagccttccaatcgtggagctaaggggattcgaacccctgaccctctccatgccatggagatgcgctaccagctgcgccatagccccaatatctgctctgcaaaccttgtataagatacaacacagagcagaatcatgcaattcgcggcgtgtcgggcacgtggtcgaggaaagccccggacacatgcctcataggctatttcgaagtgtccgtcccattgcctgacgtgccggatgacgtgccattgggattcgaaccgttcggcgtcggattctggttcgtggatgccgaaccattcggcgtggtggtcgtccccgtacccgactgtcccgaattgttggtgcctgacgtcgatccgtcggatggcgtagtggagtccgtggacgaatccgtcttgttcgaatcgtctccggtgtcggtggacgagtccgagccgtcggtggacgttccggtgccgccggttgtggaatccgtcttcttcccggtgtccttgccgttgttcctgtcggagttcgtggtggaatccttatcggtgtccgtcgtgccggactggttctgcatattgtcctgcgtgccgttgtttccgctgccgtaggtggaatcgccggcattgtcatccgacggcgtctgcttgctgttgaccatgtcacgcaccacggtatcggttccatgtccgcccgtgaacgcgaggatcagtccggcgctcacggccacgccgataagcgcgctgacgatcgcgatgacgatcggcgcacgcttgccatgcagccaagcgtcaaacgacgcccggcgtccagcatgctggatacttccgccggcattgtccggaagcatgttcgattcgcgtcctccggcctgcgtggaggaaatgacacggcctgacgttgcgggcatcgccgcggtcgtatccccgtccacggacgtcatgaccgtggtctcatcggattcctccgcggacagcgtcttggtctgctcgccctcggattcggcgggagcgatcaccgtggtggcgtcatcgccgctcttgccggcaccgtccgtaccgtccttgtcgttggtcacgaacggtacggcgttttgcagcttctcccccgacgccttgagcacgttcttgtacacctgcgtcgcaacggccgagacgatggaaccggcggcgacgccaatcaccgatcccgcgatgccgatttttgcggacagcaggaacgaggtcaccgcggcaagcgcgcccgcgaaaatcgatgaaaacgatatgcccttgaaaaaattcttcacagagcatgacggtagccgattacgctttgaaaaaacttgcgattctgtgaaaagcttggaaaaaacttgggaacgggacgcgcgtcatcccccgttttcgtcggcggctatagctgcggatgctcccactgctcggtgtcggcgatcgccggaccatggttgtagtcgaccagacgccaccgcagcgcgccctgtagttccaacggcgccagccgcacccaatgcgcgttgcgcatcgacagaatgtcggcgaaatcgccatgcacttcgctcaatcccagcagcgtctgcaacgtctgcgagatccaggcaccatgcgagaacacgtacaggtcggtatcggagccggccttcgacgcccaatcgttcaacgcctcgacgccacgcctgccgacgttctgcttcggttctgcgccatacttgagctcgccgccgcggaactgggcccatgacagataatcctcggggaaccgtttggcgagctcttcgacggcgatgccttcccaatcgccgaagctgcgttctcgcacacggacgtcgggatgcacgtcgagtccgagcgggtcggcgaacgcgtgggcggtggcggccgcgcgtttgagatcggagcagacgaccagctggcatgccgcttcgggatgacggtccacgtacagttcacgcaatgcggacgcggtctggcgaacctgccacatacccacttcgtcgagcggaatgtcgatctgtccctgcagcctgtgctgcgcgttgtatgcggtgcgtccgtggcgcaccagtgtgatggaacgcacgtgtggcgtcatggtctcatcatggtcgagttcgacgtttctgggcatgcctctcccctatctgccggttgtctttccgatttattgcctgtctgccgtcgtattcggattgctgggacggcgcataccaaaacgtgccttccgcaggattttcgggaaggcacgtttcgatgatggatgaaaaatcacgcttcgctggaagccgtcggctcctgctcgccctcggcgtgttcgagctgcagatcgatgctcgggcagtccttccacaaccgttcgagacggtagtattcgcgggattcctggtgcatgacgtggatgacgaaatcaccgtagtcgagcagcacccactggccttcggtcaggccttcgcgggagcgcggctggcgtttgccggccttgaggtacaggtccttctcgatttcctcggcgacggcgagcacctggcgttcgttcgaggcgctggcgatgagcatcgcgtcggtgatggccaatggttcggtaacgtcgaacgccacgatgtcggtggccttcatgcggtcggccgcggctgcggcgatgcggatggcgtcgatggaatcttgcaatgcaggcatgttcagcgctcccattcgggcttccagccctctactacgtgttgcgtgttttcggaatagaccatggagtcggacgggacgtcgtggcggaccacggagccggctccggtggtgacgccgtcgccgacggtgacgggggcgacgaacaggttgcccgcgccgacgtgcacgttcgatccgatggtggtgtggtgcttgtgcacgccgtcatagttggcggtgatggtgccgccgccgatgttggtgtgctcgcccaggtcggcgtcgccgacatagctcaggtgcggcaccttcgtgccgttgccgatgtgcgccttcttcatttccacgaacgcgccggccttgcttccctcgccgagctcgttgcccggacgcagatacgtccacgggccgatgttggccgcgcggccgatgtgcgtctcctgcacgcgggagcgttccacatgcgcttcggcgtcgatggtggcgccgatcagcgtggtgtacgggccgacttcggcggcttcgccgatcaccgtatggccttggaggaagcagccgggcaggatcaccgcgtcgcgtgcgatctgcacgtcgtcctcgatccacgtggtgtccgggtcgaggatggtgacgccttcgcgcatccaatgctcgcacacgcgcttgttgtgcgccttggcgagcgcggcgagctgcacgcggtcgttgacgccttccacgcttagcgggtcgggggcggcgaaagcgccgacggctccattggctttggcggcttcgagcgcgtcggtcaggtagaattcgccctgcgcgttgttggatttgaggttggcgatggcttcggcgagcagtttggcgtcgaacacgtatacggaggtgttcacttcgcgtacggcgagttcgctgctgttggcgtccttttgttcgacgatgcgcagcacgttgccttcgctgtcgcggatgatgcggccgtagccggtcggatcgtcgaggatggtggtgagcacggtcgcgccgttgccgcttttctcgtggaaggcgagcagctggtcgagcgtgtcggtgtcgagcagcggcatgtcggatgcggcgatcagcacggcgccgtccagatcgtccttctgcgtgagctgcgccatcgcgcattgcacggcgcggccggttccggggatgtcgtcctgttcgacgatggtgacgtgctcgttgtaggagcgtgcggcttcggcgacgcgttcggcctggtagtggaccaccacggcgagcgtatcggggtcaagggccgccacggagtccatgacacggttcaggaacgttttgccggccaaggtgtgcagcaccttcggtttgttggaacgcatgcgggtgccttcgcccgcggcaaggatgattgcggcgctcagtgccatctttcgccttccgttttgctggttttcgcgggaaacgtccattccagacggattagtggaggacgcttcggatttcaacgcaaccgtgattgtataaatagggttcggacaatgccgcagccgtcggaaacgccttacgacgcctgcgaaacggagcgtgcgacgcatccgtacgcttcgacgagtccgggcaggtcggctttggcgttcgccggactggtggatggcagctgcgtcatcggcatgccgtccaatccatgcgcccgaagcagcggaacgcagagcttacggtacagttgcgcggctttcgcgccagtggtgaagacatgggcgattttcgatcgcatgattatcggggaaagatcattgggcaccgcattacggatactggcatcgctcgctccatcgatgtcgcacgactcaatcacatcccataacgccatatggtgacgcaaagcgaaatccctacgcaaccccacaatctggtccgggtcccggcactcgcgcagacaaccgtcatcatggaaaacagccgccatgaccggccagaaacgattgcgcggatgaccataataaaaccgcatctcacgcgacttcggacttggcacggaacccaacaccaacacgcgcgatccggcatcccaaaccggaccgaatccatgttccacacgcatgggccactctcctaccaccgcatcgaataccgcgatgcgccttattgtattgcgcaatgttgcggcacgacaaacggacgtgtatgttgattgcggatacgacatgagcagcatattcaaaggagaaaacatgctcgaaccgaccaccgtctatacgccatcgccaaaccgatacgacagcatgacctacaaccatgccggcgaaagcggcctcaaactgccggccatatccctcggcttctggcacaacttcggcgacaccaccccatacgacaccatgcgccgcatcgtgttcaccgcattcgacaacggcatcacccacttcgacctggccaacaactacggccccgaacccggatcggccgaaaaaaactgcggacgactcctgcacgaatacttccaccaccaccgcgacgaactcatcatcagcaccaaagccggctacgaaatgtggaccggcccctacggcgacctcggcagccgcaaatacctgctcgcctcactcgaccaaagcctcaaacgcctcaacctcgactacgtggacatcttctaccaccaccacatggatccatccacaccactcgaagagaccatgggcgcgctcgccacggccgtgaacagcggcaaggcgctgtatgtgggcctgtccaattatgatggccccacactcgagaaggccaccgccattttggatgagatgcatgtgccgttcatcatcaaccagaaccgttacaacatcttcgaccgcaccgtggaacgcaatgggctcaaggagaccgcgcaccgtcttggcaagggactcatcactttctccccgctcgcccagggactgttgaccaaccggtatctgaacggcgttccggcggacagcagaatcgcacatgacggacgattcctgcagcagagcgcgttgacgccggaacggcttcagcagattcgcgacctgaacgatctggccgccgagcgtggacagacgctcgccgaaatgtcgctggcttggctgctgcacgacggcatggtggcttcggtgctggtcggagcgtcccgtccacagcagctgatcgacaacatcggtgcgcttagaaacacttcgttcagcgacgaggagctccggcgtatcgacaagatttcactgtagccgggccgcccccgcgcggcagccgcgcacgaggaagccgggctccggacggaaccgcaacaaatgagccgggcgcgtacgacatcgatcgtacgcgcccggctcatggcttatgcggtcgtggatcgcaggctcactcctgcgggtaggagtcgtcgaagaagcggcgctccagatgcacgatggtgcggaacacttcggcttccggaccatcgatggagcagtattcgttgaccagggagatgaggtcgccgacccacttgcggaagtgcgcgccttcatgcaggtcgacccagcccttgtgcgccggcacctgctggatgacgtcggcgtcgacggtgcgcttggcccatgcgaggtacagccattccatgcagcagatcgcggtgatcagttccggccagctcttgtcggacaggctgtcgaggtatgcgccgtactccttgttggccggggtcggttcggtcgcgtcgtattcctcctggctgacgtgataggcctcgaggaagtgctcgaagtaggtggcctcgttgtcggcgaaccactgcgattgcgccgcgagcatgtccttggtctcctgacgtggggcgagtttgatgagacgcgccatcatgccgttgttatagaacttgaaatcctggatcaggtacgccttgaggatggattccggcaaggtgtcgtcaagcagctcgctgacgaaacgcgagttgatggcgtcgtaccagtcctcggtgttgagcatgtacatgaggtcggcgacggagccggcttccgcgcccagccaggcgtagtctccactggcgggtttcgttgcttctggaacgtggttggtcatgattttctcttttcttggatacgccggcggacggccggcatgttttctgtgtttgttgttggattgtgagttgcgtggttcaggccacgacgtcggccttgcctgattcgaagcggtcgagcacaccggttttggcgagcgccttctgtacgaaccacatgagcgctccgccgaatacggctccggagatgacgcagcagacggtgaacacaacgccttgcagtgtcgaccagccggcggtgacgacccactcgtacaggccattggataggccggtcaacgcgccggccagggtcacggtgagcaggttccacttgcggtatgcgaagaccgcgaagccgatttcggcgccgagtccttgggccatgccgatcagcagtgcgtgcgtcacgccgaatggattgcccagcagcgtttcgatgaccgcggcgatggtttcgccgaagaaggccgcgccgggcttgcggatgatgatggccacgagcgggccggcgaacagccacatgaaatggaagagtccgcccagtcccggggtgaggctgtcgaacagggcggtcgggacggcgtagatgaagtcccaggcccagaagatcacgccggatgcgacggcaacaatcgcggccacgacgatgtcgaccacacgccatttgacgttgggtttgcgaactgcggaagactggttttcttcagtcataaaggtatgtgcctttctcttatgcaaaggcacgggaagtagagagacgtccgtgcgccggcattatccggtatacgttcatacggttgaagcggtcgcttcctctcagccataatggcccccgtgtccgcaagcgatattacatggttcggcgcgtttccaggctggtattccacatgtcggccaaaagtctcgtgaaatggaaaaatgggttccgtgttttcccgaaagtcctgggccttcggaaaaacacggaacccatcgatatgcgggaaagccgctgtcggctatgccaggatcgacgccgtgtcggttaccgtgatcagcggttcgaacaagcgcatcgtgttgagcgccagttcctggttctccggggtgctgccggcgcaggcgtcggccggaacgcgcacggccacgccgttatcggccgcggcgagcacggtggtgagcacgcagcagtcggtggccacgccgcagaccgtgattttcttggctccgccgatcgcgtcgatcagctgttgtccccatttgccgaatgtggtgcggtccaccacctgatggccttcggcgagggcggcggtctcgtcggtcaggtcgtacatcgggtcgtccggcggtaccaggaactgcggccagtccttgaagtagtcgacccaggcgtcctttggcggaatcggcgcgacgtagcgcgtgtagaccacgcggtcgccgaacgccttggccagttttgcgaacgcttcgttggtgtcgtagtaggttccgtcggcgcaggcccaagcggaccattcgctttcggcgaatactttctgacggtcgatgacgaccagccactcatcttcagcgatcatcgtatgttccttcctgtgcgatcgcgccgttcgtcacttggcttcgatggcatccgccgtttcggatgccggcaggtcggcctcctgcttggcgatgtctccacgctggaacgccaacgcgccgaacaggccgacaagcagcgccacgatcacgccgaggttggcggatgcccagctgccgtccttgccgccgatcaggaagaggaggtagccctgccaggtcagccagttcgcggcggtgttgaccacgaggccccatacggcgtggatacccccaagagatgaaaagcgcgccatggctcgaaggcaccctgttcatcgatatgaccaccaaacgaatcgtctgggccgaagaaagcgaaggctgctaccttccccggctcatcaacgccctgatcgaactgacatggccaggatggaccgcaatctggtcccccgaagacacacgcggcacattacgcgccaccggagccgacacagacatcatctacaccgatcattcgttcaaagacctcggcgacttcgacgccgcatcggatatggccccatggaccatatccaacgaaaccgacgcattctcctgcacaacagaaaacaacaaaacaatcacttggggaaactacatcgacctcgaaaacatagccctactcggccccaacaaaatgcatacgctcgtcaacaaagtcatccaaggctgcaacgaaggcaaaccctggcaatggaacctccaaacacacaacaaacaacccgaaaaaggcatccacatcgactacataaacaaaacaataaaatggtggtccatctacgaagacgactgggccatcaacccattcaacgcactatggcccggatggacgctacattcaaaaggcgacaactacgaatggcacgaaaacatcaccggatataagatgcgcgactggaaacaaaacgtcgcacaatgcaaaaactcactcacacaaaccatcaaacaaggcataagaaccaaccccatcgaacgactgacaggagcgctcgcaaaacagggagttgacatgcggattcgtcccgccacgttccaattcgtcccttcaagaatggagcaaccgccggaacgcatcttcgcgtatctggaccgcttggagtcggacgagcctctgtcaccggcgcgtttcatcaacagagatggcgaaatcatcccggcgtgccagtagacgcgcctctatgcacggccaaatctaataaatccatcacggttttcttatttgaacaggtcaaacaggctgaaagtggtcttccggtagacggtgttgtacagcttgcgcttgggatgcagccagcccatgccctttttgccgtatcctggaatcagcgcctttttgacagcacgcgtcgcgcgacctttcgtacgtgccgacaggctcttttttcaacttggcttcctcataccgtatttcatttcgaccccatttccttcctatgctgtttcgattccgctatcgacgcgagctgtcgcatgtaaaggctttccggcgtctggtcgtacgcgaccggcagaggatcgacggacagcatcgattccaccgcgtcacacagccgtcggaaatccttctcctgctttttcgtgtagatcgcgcagtacggcgacttgcgggactcggacgcgctgcccagcatcggcgtatctccgtccaacgtgcgcacggacaggcagaacaggccgttcgcgaagaccgtcgccttgccgggtgccacgtccacgatgctgccgaccggtatctcggtccgcgcgaacccgtacatggacgcgacgattccgccgcgttcgatggtgaccacaccatcacacagcgtgaccgtgtacccatagcccctcgcgcatattggctcaaatccgacgccggctcttaccatttcctccgtcatacccccattatcgctcgggccgacgggtgaagtggtgcatggcaagtcaggcatgaccgtcacgcgttcttcgcgtatctccatgtcatgccccgtccgtttaaggctgggattgctcataggtcggatgccgtcccgcatgcggattccccttcgctttcgatgtccacgctcccctgcttgctttcattggggcttggatcgagtagtggctgccggcttttccttcccgcgtccttcaggaccttcaccagctccttgttggcgcgtttcatgtatttaaggctgcgattgagtatcttgagcatctttttgggactggccttcccgtcgccgtccccgtccgccccaccgtcgcgtatgccgcgtctgaccgcttcggttcttgcctcgagttcgattatccgcctgttgagcgcgacgttgatcccatacgcggacgcgaggtcgccataccgtttgacgagcacgtccttgcagaacgcggtcagtttcgcgcattcctccaacacgtagtcgccattcgtggccatcgccatcgacgccgccgcggacattcccgcgccgccggccgcgcccaacacggccccgccgccgacgatgagcatcgtcccgccggccattcccgcgccaccggctatgagggaaccaccgccaaggaacgcgaggctcgcgctggtgagcgccgccccgtacaatccggcggcctcgaagccgaaggcggcggcgaacaccggtgtttatggtcaaataaacgtgtacggcgtcaccaccaaatctgaacggcataagcgttcatattggacacggacggcggacggaaatggcatcggcggaagaaaagcgccggtgccgtacggttcctgatagattcccgagtgctaacaaccaacacatggtcctcgggaggaaaggaatgacgacaccggtgcgtattcaacagagtatcaggcagctcgagacgaaaggcctgacgcatacgcagatagctagggaactgggcgtttcgcggacgaccgtggtcaagtacgcgacccgcgattattcgcccgttccgccgaccgggggaactgcgagccgttccctggtcgcgggcgagtacgcgcgcaaggccgacgaatggctcgaggccgaccggcgcatgccacgcaaacagcggcacaccgcccggcgcgtacacgagcggctcgtggaggaatgcggcttcgagggcagttattcgtcggtgcagcgatgggtcaagcgctggcgccaacgccaccgcggcgaggccgaggggttcagtgagctggaatgggcgccgggcagcgcgcaggtcgatttcggccaggccctggccgtggtcgccggcgtggaacggaccgtgcatttcctggtggtctcgttcccgtactcgaacatgagatacgtggccgcgctgccgggagagaccgcggaatgcgtgtgccatggtctgaacaaggtgttctcccatgccggcatggtcccccgcgtgctagtgttcgacaacgccaccggggtcggccaccgcagggccgacgggaccgtcacccagacgaggctgttctcgctgttctgcgcgcactacggcttcgagacgaggttctgcaacccctattccggctgggagaagggaagcacggagaacgcggtcggtttcctgcgccgcaacctgatggtgccgacgccgtccgcggagggatgggaccggctcacggacgcgtggttggaacgctgcgacgagatcgcgcgcggcgtccactaccgcgaggacgtgccgatccgggacctgttcgagacggacctcgaccacatgctcccgctgccgccgtccatgttcgacgcgtgcgactggcgcggggtgaaggccgacaggaccggaacggtcacgatcgactcgaaccgctacctcgcgggcccgaaatggcattccatgcgtctcatggccggcgtgcgggccctgcgggtcgagctgcgttccatggacggcgagccgatcgtcacgttggagcgcaggtgggggcgcagccccgacaccgcgatggacccgctgtcgctgctcgccatcatcgcacgcaagccgcgttcgtggggcgagagtcccatacgctccgacttcccggaggagacgcgcgtgctgctcgaccggatggagccgcgcgaacgcggcctgctggtcgacgacatccgccacgcggccgtggtgagtggcttccgtgcggccgtcatggccgtcgtcgagatcgtcgccgcgggcagaaggcccgacagggccgcgatcgaccagacggccaggcggatcgcgcagggcgacggtcccgaatcgagggccaggctcgacacgtacagcaggttcatgagggaggacggcgatgagtgagtcgacggacgccgcggcgggcggacgcaggggcgggcggaccgtgagcaagtccaccccggacgaggtcatggagctcgcatgcgggctgccgttgaccaggagcgtgctgcgttccgtggtcgcgggcgccacgcccggccagctcggcgtgctggccgacctgttcagggccgagaacgccagccggacggaatccaggcgcgccaggctgatcaggaacgcgggattcccgtgcgtcaagggcttcgacggatacgactggggcatggcgtcgttccccgccgactgggggcgcgagcagctcatggacctcggtttcgtggaccgggccgaggacctcgtgctctacggcgacgtgggatgcggcaagacgcacatggcgatcgccacgggcatgctggcgtgcgagaggggcatgccggtgaggttcttcaccgcgtcgtcgctggtgatgcgtttgcggcgggcgagggacgagaaccggctcgacgcggaactgcgcgcgataggccgcgccaggctgctggtcatcgacgagctgggctacctgccgatcgacatcgacggggccaggctcctgttccaggtcgtcgcggattcctacgagaagcggagcgtggtgttcaccacgaacctggagttcggacggtggggcgaggtgttcggagacggcgacatggccgccgcggtcatcgaccgcatcgtgcaccacggaaggatcgtcaggttccgtggcgagtcataccgcaacagccactccctgatgaaataaacgaaaagagcggaaccaacccggccgccggtgacggtgtccattttgaacgccgatggtgttcagattaactggtgacgacacgcagatttatttgacgaaagacatttggcagaagacgtcgccgatgtagtccgaacgggctttaaggcttttatactccttgtcgttgtctccatgcagagggaaatagggtttgaacatgacaagctccaaagccacgagccagagccattcgccattgccggccccgacggtcccgttgatctcgtcatacagggattttccgtcgaggaagtacccgtccccttcaacgccgatggtctgcgtgatccgccgcgaccactcatcaagccatttccccttcctctcggcgtgcctgtcgtgtttctcccgttcgatgtcgtacaggaccttctgtcgcatgagggaatggagcacgcgcgccttttgggggtcaagttccagacaatcaaggtccgccagctcgtgttcgatggcgtccctctcgcgctccgcatcgtccttccacctttccgccatcacagctttcgcgtccacgacgcaggacaccacgaaagttgcgattccgacgtagttgacacgcagcaggaacacccgcgccttgtcttcgcccgccatcgcgtgcacggcggcgtcggcgatgtcgacacccacgaacacgccgctggacacggtcagcatgcggcgcatggccggggttccccacggaaggacatcctcgggggcgatacgtccgagatccccaacgccgccgatgccgagggcgtcgatctcgcgggagagcctgcggcagaagtagaaggcgcgcgtgacgcactggttgatgacgacgggcatcgactgcctgccgatctcgcccaggacaccgatctccatacgcaggtcgaaccggcgttccgtgcctttgatgatcctcccgtccgcgtcatgctccgccaggaacgtcccgttgaacattttggacagccacagtctgaagcccatgccgtcggttccggaatccctgaagaacggcaggacggacagttccttcatgaacgagagcaacggtccgggaattcccgtccccgcgccggcgttaccgctcgaaccggccatgtcgctcaccatgtggaagaaccattcgacggttccgaagacgagtttttcgggaacgtccctgcccagataccgcctatggtcctcgggaatccgcacgacgaccagccttccggccgtgtcggttccgatcgacagtccggtgaactgcgtgaagatcgacgcggccaaaccaccgatgccgaaatggtgggcgaaatccctcaaatggtgctgccgtccccctccgaaatccggagtgttcccgtccgccgccagcggatggaccttctcgaggtttcttatagcctccttgagggaatcgcctttgtatccctcggcacaagcgattccgacgaccaggcgttcaaccgttttggaaccccattccccggcgcggtccaaggagagctcgcctacgaacagggaatcgaccagaccggcgacgacgccgctggccgccgcgacggcatagtcgaccctgtccgccagatccaaccggggatcccattcgatatggtcggacaaccgttctggcgtgtcctgttccgtctggtccggaaatccatgcgcagaactggtgcctccggatacgggcaggagccgtcgccggtccgggaacaccaaatcgtaactgacgatcggcatgtcttcatcaccataatcaaaccgctgtgccatgcaataacatcctccacgtcgctgcgtatcaagcccagagagaaagcgttactttcaacgatactcgcagaagactgaattgatgggttctagcaagccgacatgagcactatcaggaattagttcgacctcaaccacacggaagttgacaaaatctcgtaattatgttgggaaccaaaaaggaaactgccgacgcttccaagctcattcgattcaggacaaatgcatgacaaaaaacgttgtgatggcgatgtccattgctgattcatcaccatcacaacgatttccctttatcactgcagggctttcacctcgtcgagtagggtctggtaggttgtcgcctgctcgtagcgggctccgtcggcgaggtccaggtcgttgaacgggcgcttcgtgcaggcgatcttgctgttctcgattccacgcaggtcgaacgactccaaggtgcccttggtctcggcgacgaagaacagacgcttaaggccactgtcgtcgcggaacgccaccgcccagtcgggcgcgtagttgcccacgggggtcggtatctggaatcctcgaggcagcttcgcatacaccgcgacctccgcgacgccggcgaattctaggccgaattcgccgtgcgtgcgcaggttatcgtggatgacgatgcagccgaacacggcatgatcgccttgcagtattcttcccggtgtgagaccgggatgtctttcctcgagttccgtccagatgccggctcggtctgcaaggtcgcgcagtgactggctgtcctccgtcagaagcgtcacgttgcaacctcgcccgcttctggtgtcgtagatgtcggagaatatcaggatgtttccgctgttctccatgtagccgatggtttgttctagatgcctcggcaccagtatgcccgccaatcccacgttcggcgatgacaggatgatccgctcgtgtcccagccgtttttccggagttggacatagagggaaaacggtggcactgtcgttcagaagtagattggcagcaaagctctgtttgttggcgagcgcgcattatatcgcgcactcgcaatgccaattcgcgcactgtcgcgcattggagagcgaatcgcgtcgtaatcgcgtcttcacgaaacaagccgcgtcgtaatcgcgtcgtgtttgcgtcgtaatcgcgtcttcggaaaacgcgcaatgctctgcggagaagtccgaagagcattgctgtttgccaaccgctgcggcacaatgcctgatttgtcagcgttcggtcatttcgacgaggtccagtttgaaaatgccgttgtcaggattgtatttgtccactgttgctttgatgtggacgttctgtccttcgcgcacgaaggcgggaatgccgaccgaaccgtcgtggaaatcgctccaagtgattccttcgaatctgaaacttggtccattaacgctttccgtgctgtaatcacctgcgtataccagcgtatcgtcaaacaggtaacgtggatgcttatcgttgggtataatgcttgcaatgttgccgtcgaattcaatagtgcgtcccttgtatttttcggcgaatgcggcaacggacgaatcgaaaggatctttcactccaagcagagcagcgaattccggattgttggcagcggtgatgatgccgttgctgtcggcctgctgcggtttttgctgttgtgcaggttccttttcccggacggtcagggtgacttcgccatccgtcatggactggttggcttcggtgacggtccattcctcaccattctgtacagcggttttcactgttgccgtctggtcgctgccgtctcccccgtcaaccaagaacttgtaagacagactcttcccatcaagttccgatgtcacctctttcacggaacggttcttcagcgaattcgtgttgaccttctcgaacgaaggcgtggacggcttgttgttatctgcagaatcgtcggaatcggtcgtatgcgaatatgacggggtggtcgccggtttgtcgttcttcgaatcttcggatgacaggctcatgcagaataaggcaatgagaagcagcacaaacgcggccacacagccgataaggatcgtacgtttccgcttgtcctctaatagggccgcaaagccatcggatgccgttgccgtatgcgtttcaacttcatggtgatcggaatacccgtcggactgtgcttgtttcttatcggaaggccaatgcggtgtagatgaaacggcgctttccgtcatcgcgacggttggttcggaatcggcgtcattcggggtaacgggaattgtgaccgtcgaagccggttcctccgtccgcacttccgcccgttcttttgaaacgatttccgcggcgggttccggttccgacgaaacgttttctttcgtggactccggttccgtcttctccggaacgattctcgtatcggtaatcgaatctgccttcttttccgcgatttccgtctgcttattcgattcagtatccgagccagcgttcttgcgatcgccagggaacgtcatacgcggcatatcttccggaggaatcggcatggttcgctgtgatggggaatcgtcgtacaacggtttgttccaaacctgtggcgtatgggtggcgtgcctttcagaatcctgttcctgcacccgcttcttttcctcatatgccgagcgtgcctcttcgattgagtctccgagattttgcgcggcgcgactggcttcgtttttcgctttggacagtgcttctttcgccttggatttaccggtttcgagtttgccctccaaatcgttatctttcgcgaacttctcagcgtttttcctggctttggaaagaagaccacccaacgtcgtcggctgctggactggatattgaggcattgaatactgtggtgccggctgggcttgcaacggcatgggcgccgacgattgcggcgttgccggatacggttgagacggcatcggatattgcgattgaaccggctggttttgaggaggcatggcagcagggaattgcgatgccggcggatactgttgagatgccggatattgatttggcataggctgcgcatacggttgcgccgtaggcatggcccgtctgccggacggccggtttttcaacgtccaagctatacggtcaagcagcaaatccacgtcgcctatagcatatccgcccatatacgtagaggtgaaggagtgccgctcgacctcttcggcagacaacccatatccgttacgtaaagtgtcggcgcattttccgaggaacacgtccacttccgccactttgtatccttccgcgaaatttactaccggaagtttgactgactgaagctcttcaatagtaatcgtcccagttggataaatcatatcggcaccctcgtctactctcttggaaacatgccctcatgctacaccttgacgaaaaaaataattcagttgaagtgtcgcgaatgacgcagcagcacccaccacggatccgaagacaggcacctccacatgacttctcgttacaatcagtcttctgtatatccgaaatgctctttgactttctgatatgtcgttttgtcgttgagcatgtaggcagccagcgggacggttgtcatccctttctcccaatagccatcatcaacatccgtcacacttctcttccatgcaacgcctataaacacttctttattggaatcgagcttctgctttagttcttcggattgccatgatgcatcagatacgggtgtcggaatgccatcggccatcactttgaagttcttcattggcaccgcagtggacgtgcattttcctatgccaacgaatccgcatccggcaatgtagcagtaaaccgtgtctccaacttgaacgttgtagatcgattttccgctgccgccaaggctcgcggacaagaacccgtatttcaaggcatcaggccaacttctttccgcgtagccaatcgtgaattcgcgtcctttttcgtttttgaaaaaagctttttcttcatcgtcgtcccagccgcctgcaatattcttgatgtcattcggattccaaatgtcactggccattttcaaataaatctcagctcggtcaacaatgctctgcctatcgaaatcgggaatatctcggaagccatatttggcaacgactgtcgaaagaaaactcgggtttttcgagtatgccgtactactcaatgcttgagcaagaatgttgtctcccgcatacttttgaaccttctccgagtatttcattgcctggtagcttctgttcttgtcacgagtgagcagaatcaggttcccgatcagattgcgagtggactcgaaatcctcaagatccgcaaaaccatctttgtaatcctcgtatttgtcgggaagaatatgttcgatatcgtaagtgtttccttgtcgcttacggtcgacgtattcttcaaagtgcgacggattgcccatcagcacgttcacataggaagtgaagcgtgcaagaatgtgcagcatataccgtttggagaactgattcagaccaaaacgggtgattccttcaacggacatgcccatacgacgaagcgcacgaacataaaccataccaattgttttgcaatctgcattgcgaatgtcctgcattacatggaacaactggtatttattcgtattccagttggcctttttgaaattcaaaattcggatggtagcgaagtcatctacgaatttcgccgtcatccgtatcttcttttgtattatgtcatcagtgtcatcatttttgatggcggcaatggcgagcatggtttgataggtcaagtcccggtttgcgttatagaaaacctcttcatatcccgtcgtgaatttactgccgtaatccatcattcgtaaatagacgtcggtaacacgcgtcatttcggtaagaacaaaattcttgtagtcattcggcttggcaagccccatcacggtacgggcattattgcttacccaagcatggaatttgtccccaagaagctcatagtcctcatctttggcaccgcgtttggtatcgcgcatacggttggcgtactttgcgcgaagccagatggagacaaactccacatcctgcgtgttcaccataccgctcgtatcataggaggacgcgttcttgatacggctgatattgctctgccactcctggttgaccttaatgcgatcctcttcagcaacatgctgaatgacgaaggccttcatcatttcagcactattcaagctcaatccgcggtcgttcatagtaaggaatatggtgtgcgcttcgtcttcagatggtgtgtcgatttctagaagaagcactttctctatcagccagttaataaagtaaggtagcgcttctcctttcaactcatccgggaaaagatcctcaatatcctgatatcgatcaagcatattctgcacactctcactcatgggcaagtaggtttgatctttctgtaacagagcttgcatgcaaggcttgcgatcctccacgtcgatattgaagcttttcttaccgaaagcctttgaaaaaatcatgtcatccaacggaacaataagatcctcgtcctcaactgtttccttctgcaggttgttcaagtaaatgatgagcaacgtcaacgaggtcagacgctgctgaccatcaataagcttctttatggatccaccggtgcaaatgatgcaacccatgtaataaaacccgtagtccatgacctcttctggcgtatcatgatcatccggtttatagaattcctcaaaagtgttttgaaagtcagcaagcatctgctcaatttgcttccttccccaccgatattccctttggaaataatcaatggtgtactttcggccactcagaatcgttctaagcgtgtctgttttatcgattttctccataactctttgccccatcaatttgtttttcggctttaaaatcttcggtgaattcagccgaatccatatgacctcgtcgcagacattgatacgacatctggaagtcatattcacgattgtttccggaaactattatcctccggctcagcccgataaagggaaacgacacgatggtaattccgtcgccgttagcaaacatcatacggttttgccatttgccagccaacgctgcagggttgcggattccactacaatgcagcattggtttcgttcgattgatacggaaacgcgaccaacgaccggcacactggctcagggagatggggtaaaggatgacgaagacttccaaggatgcggaaaacctatgagaccggtctctcaatcgccattcatgcaaaccggcgattcagtccgcagcaccatgcaagcggaatacatcaggcttcccttttcgcctttcccagcctccttgacagtctggtagcaggccgttccacggcaagatagaacgcctccgccaccagaaggcacaatgcaaacaaaaccaccgggcgcaatagaccctgcacgggaatgtacggcacaatccagtcgcggacgggaagatgggtcagatacaggctgaatgaaatgcgccccagccaacggacaggtggcgtggaaagcaggttggataccacgttgcaggtaagtgcgaccaccaccaatatcaggcatccgcacacggccaaaggttgggcgacaataccaggcagcaaaccgaaaccgctttggcaaaccaagacgatgccacacagggcgagcggtacggcaacgacgtcgcgcatcgtctcgcgcccgttgtccgtaagccgtttcgccaacgcgacgccaagcgcgaacatggccatgtgacgcaacggcggccactgcgtccactccgacaacagcacgcatgcgagcgcaatgggtgccacgaatcgcatgtcggtggcgatgatgacgtatacgggcagggcgaggctgaaaagcaattcccagcacatgctccatgatggcaggtcgaccattgccaatgtggaaccgtccactctggtgccggcggtggtcattgaaagcatgtcgagttgggtgagcagattgtggagccagactgatggcgaggatgtgctgaacgcgtttgcgtattcttccgctttccaccccatatgcatggcgattgtggagacgatacagcagatcccgattaccgtgcaggtggggatggcgagtctggcgatgcgacgcagctggtagcgaggccagttgtatgtgtcgattccgacgcgtagcggaacgatggaaagtacaagtccgctgagaatgaagaatagggtgacgaattgggcgcctggcaatagttggcggagggtgcctcccgtgtaatggtatgcgaccactgccagggccgcgagtcctctgagcccgtccaaagcgtatatgcgtgtgtcggagtccttctctttttcgttcacgggtgtaccctatcacgtgcgctggctgtcatacatccgcctacgtgcgtttggcgtgcgttgttcggcgtgtgttcgacaacagtgccatcgtcgaacacgacgccacataacttccattcgtctctcttccccgcccgactgtagtgtcggatcatatggagatccgcgaatacgacatgatgacggacgaggcgcgcggcatccgcacggcggtgttcgtcgtggagaaggattatcgtccggaattcgacgaatgggatgagccgggccgagccacgcatctgctggcttttggaaacggccgcgccgtggcgacatgccgtctctaccctgatctcgaccatgccgatcaacccggacgttgggtgattggtcgtttggccgtggtcgccgacgaacgtggccatggtatcggcaagacggtgctggccgaggcggaacgtctcatccggaaggccggtggacatgttgccgccgtacactccgaagataagaatttcgcgatgtatgaacatcttggctaccgcatcaccagcgagcttttcgacaacggtacgcatggttggctagtcaaggcattgaactgaatccggaggaagcggccatcacctgcgaaagcgtccgacacgcggtatcaggtgatggccgcatatggcataatagacacttggcggaaaacctcgggttttatcgccgttcccccatggtgtaatggcagcacacgggtctttggaaccctttgtcttggttcgagtccaggtgggggagcaaaaaggactatgtctagggggctattccgaccccctagacatgaccggtccgagtccacctattcgtactggcaccctctcggatacggctcgtccgaatccatcgcctacgaccgaaatcttgccgtgcggacggccttttcttcgtaatttgcttgattccacggtgcaaggcggcaataggttgtgttgagccaatggattagcgattattcacagattgtgcattgattgcgcctaccgtatgattcgcagtgttgcagatgacggggattagcctaccgtttcggacaatctccgtgcgaacagcggaaggcgcaagacgcgcaaatgctcgatttcctcgctcatggtacgcggcggatggcgtttggagctgaccagtctgcgcatggcgtccatcgcttcttctggatgtgcatcgaacacggaggtaaggaaaacatccggcgattgagcgtgcagtccgtacctggaaagttcgtctgcggggaaatccttgaggttgaatgtaacgatggtttccgcaccggcccgacgggcggccgcgaccacatgcccgtcgttggggtccgacaaattcacgtccggttcaaaccgctcccaatcctccgccatggtcatcggaaaggccctgcagatcgcgtcaagaaaaccgcgggcccggacgtcgggcacatgccgcacttccatgatggccaagcgtgcctcgtccatgaccctcgcagaccatgctggctcgcgcagaccagcctcggccaagctaagcagtgggtcgatgatccacgtaggtacgaacaggttggcgtcaagcagcgcaatcataagggcactctacttatcgaaccgggacaggtaatccgaatagtcgatgtcgtacgcgccgtcctcatcggcgatggaacgcatctcatccaacgccttggatgtggcctcgtcgcgtctgcgcttgtagtcggtcacatccgaaagccgcaagaaacggtaactgcgctcccccatgcgggtgtacggaatcatgcccgcatccagcatgcgtgtgagcgtgcgttgggagaccccaagaatacgcgccgcctcgccagtcgtgatacgctcgtcatccgccaccgcccgttccggctccgcaagcagaaactccctaacgcgcctgtagtcgtccggcgtcaacgggatacgcgtgccgtccaccccttgcaggaacgctccgggaactccgccagcagagcgccgtgccttagacctcgtcctatggactttgccacccatcatcatggtcatcgcaaccacctccatccgttttcatcatacggcaaatggacacaatggacaatatgtggatcgggataatctagactgctttcaggttcaccgcggccaccttgaccgatacttctccttcttcggcgaatcctcgtcgccgtcggcaatcgcggtttcggaggtcttgccgtttcagtagctccagttgttccaatgcaggctcgctcggtccgcgttgtagccgaacggaatcatgacgaaccgttttcgcgagcggcgagaacggcattgcgaaggtccctcgaccctgccagcccatgaatcgtccctcgcttggcatgtgcaggtatcgaagactcgccagatccgtgcagcatcattgccttgcgattccggcgaaacgtcaaatcggccatgagcggccaaaacctcttgacgcaaaaaacaacgccgccttataatcagcccatactgccgatagatcgaatcgtctgcaaccgaatcgagaggaggcgaaatcatgtatgacgagattccgagtctgctgtatgtcgccggagctttaatcaccgtgctttcatggactcttttcgcattctcgaaaaccatccgtccagaaggtcgaagagccttcatcctgtgcctctccgttatctggatattgttctttgcgagttcgacactggcactcgtgccatatccgcttttcgaggcgtactcaggattcatggatcccgatgtcctcgatttctatgaccagccggtcatacggctattgccggcggtgacctgcggagtgaacctgtgcgtgtcggcaggctgttccatggttcttgtaggcaagcgttcgaagcgataggccttcgctccggatgccgacggaaggtcaatccccactggtgcagaaaaaggccgagtccgtccacgtcgagaccgacagaaatccattggtctttccattcaaaacgacgcaaagtctgccgttcgcgttgagaccggcagacgagccgcacttcttctgcttgaaacgacgcaaaccgggctgccagcgttgaaatcaacagaaaaccgttgacttttctgctcgaaacgacgataaagctaccatttgcatcgaaaccagcagaacaatcgcacttcatctacccaaaacgacgctgcggcaggctgcgcaacagaatatatgaccgttttttattctttctttaagatgaaccgatgagtctacaatagaaatggcgattgcggcatgacgtacgcatactttcctgcctatagtgaaggcacaacagaaaaacaacagaagatacagagacaagaaaacaacgaagcgacgagccgcgcgacgcagaagaagacaaaagaagaagacaggcggccgtccgaaaggaaacaccatgaagaacgacaccttcaaccagatcatcaacgccaacctcgcctccatcgacccgggcttcggccagttcgcactcgccaaggcctcctccgacctgatgaagaaggtcctcaacaagtaaggctttcccgattccaacgaatcacatggcgggctgccgcgtctaccgcagtggtcgtgggcggccgcctgggctatcgggcatatgaggaccacaggacggccatggcgcgcggaacgtgcgtgtcggcggccgccgatctggacagggccgccaaagagtgtaggaatctgctcggcgcggacgcgacaaagtcggcaagaccctcgagcatcatacagatcgaccggaacctgctcgagaccaagctcgaccgcctggtcgccgagaaggtcaccgaaccattgaacgcgatgcccggcgcttcaggccgacgagatcgccaacgccgccagatacgagcgcgccggggagcggaaggcgtaccgcgccggccactacgaccggagcctgaccgccaaggccggcaggctcggcctgaaggtgcccaagctcaagggcgaggtcttcgaatccgcggtcatcgagcgccacagacggcgcgaggaaagcgtcgacccgccgctatctcgacaggtcccggctcgatgacaaactcgcggaagcgaactgatcatcgtgccatggacggccatggtccaaagtgcacatcttttcgggcactaccgagaaggtcccagctttacagggggtattaatgacctttatctcacgggcggcgcgctatgtgctcagaaaacgagtgcgcaccgcggtgctgttcattgtgctgaccatcataacggcgagtatgctgtccgcaaccgcggtttctcaggcagctcaacatgaggccggacagattgaaaaacaggcggtcggcggattcgtgctggccagtaacctgcaaggcagcatgctgacgcctcgcggaggcggaatggttcgtcccgctgatgtgcaacgaatctcgaagctgtccggggttggctcgtgcatggtcaggcagaacgccaccgccgatctcgtgggagccagcgtggtgaaggtccccggcggcgatgattacgatgcggagaaagaacagcagttcggcaatacggccaacgtcataggcacaaacgattcgtcaaaactcaatgtgttcacgtcccacacgctcggcatggtcgaaggacgtcatctaaaggcgtccgataagcatatgtcgatggtccatgaggatctcgccaaaaccaatgggcttaaagtcggcgataccctcacgctcaaggccaatccatatgatgccgacaatgagtcgcattcgacggcaactgtcaaaaccaccatcgtcggaatattcaaaggggacagcgacagaaaggtatccagccgcgcggaactcacctccaacactgtgtacaccgatttggacactacaagtactctgtaccagtacaaggccggcaaggaaatataccaggatgccactttcgttctggacaggggtgtcgacgtggagaaaaccatggaagcggcgaagaagcttccggtggattggaacaactaccagatcacgcgcaatgaccaatatacgtcgagcatgctgaatgccgcccgaagtgtgcgctccatgatgcgcggcgctttgatcggcgtgaccatctcggcagtgatagtcctcagcctcatgctcttgctgtggatgaacgaccgacgtcaggagatgggcgtattggtgtccctcggcatcggcaagccatccctgatcgcccaatatctaaccgagatgattctgatcggcctgccgtccctggtcctcggatggctgtgcgcacggggagcggcccaatggcttggcacctcggccctccgttccgtgaacgcctccgcggcgaaggaactgagcagcatgggacaggtcggcggcgatcttgagtccaatatgtcggttcgtaccttggattcgctcacggtatcgatcgacacaaccgccgtactgtatgtatcgctcggcctgctggcggtgatgctggtatgcgtcgccatatcgtgcataccgatgctgcgcaagtcgccacgaagcctgtcggagctccgatgacgggcatgaacgtgtggaagcgtgccacgctggcaatcgtacgtaaaccggtacgcagcggaatcatcggactgttgatgctgatggttttcaccagtctcgtggctcaggtcggagcgtcaacggcgcttcagaaaatgtccgacgatatcggcggaagcctgggaataggttttaccgtcgacaccggcgagaatcccgtcagcccaaaggaagcgagccggttctcacgcatccccggcgtagggaaaaccgtttacgaacgtaagaccctggcgcaggtggatggcgcgcatccggttgtccccgaacatggtcctcgactggattccggcctatccacgcaggtcagcgtgctgggcaccactgactcctcgttgtccgaagagttccaaagcggcctgtaccggttggaacaaggacaccacatttcaggtaatggccggaacgtactgattcaccgggatttcgcacgtgagaatggactatcggtggaatcgaccttccgactcagtcaggaaggccgcgattccaccgttcgcgtggccggaatcttctctggcaatgtacaggcacagagccctataccatcggacgcatcggagaatctcatctattcgggcgctcaagtggtttccgcgctgactggagaggaacgggtcggcacgatccggtgcctctcggataatccgcgggatctttccgcagcaatggcccaagcaaaaaaaatcgccggaagcgagtatggcgtcaccgatgactcggcgcagctttccggcgtgctgcagtcggtggaaacggtacgcgatctggtccgcatggtgctgttgtccgtctgcctggccgatgtgctggtattgggcatggcgcttgtcttctggattcgctcacgcatccatgagataggcacccttctggccctcggcatcggcaagatgcagattatcgcccagttcgcgatcgaaaccggtctcatggctgtggtcgccgccctgtgctcgctgggaacgggctccctattgtccggttacgtgtcctcgctcctgctgcacgattcgggagtcgcacctcttgaatcattgcaggtggaggctctgccgccagaacagacgctgctcatcctgctgctcggatgcgcggtcatcgcaatcgcgcttgccgtgtcgtgcgccgcagtgctggccaaatccccgaaatccattctttcctctatgcgttaggagatactaatcatgactatctgtctgcaattggaccatgtcaattactcatatggcgcggcgaagattcgcgttctttcggacgtgaacgcagatttcgaatccggaaagatgtatgcgataaccggtccatcgggagcgggaaagagcactttgctgtctctgttggccggtctggatgccccctctgatggagtggttcgttttgagggcgaggatatagctacgacgggttattcaaagcaccgtcgcgagcacgtgtccttggtgttccaggaccataatctgatcgactatctcacccccgaagagaatctgcgcctggtcaatcccaaggccgatatgaagatcctcgaggatctgggtctgagccgtgaggaatcgaagcgcaacatcatgcacttgtcgggtggccaacgtcagcgggtggcggtcggccgcgccctagtggcgcccggccgcgcgattctggcggatgaaccgactggcagcctggatccggaaatgactgatgaggtgattgatcttttgcggcatgccgctcatcaactcggtaaatgtgtcattgtggtgacgcattccaaacgtgtcgccgattccgccgatgccgtttacaccctcagacataagaagctagccaaggcatagcactctcgcacagaccacgtcttccgtcgtggccggcaagaaccgcgccaatgccccttccgccatcgtcctcggctgcgaaacgggttcgggattgcgtcgtggatcggtgacgtttttgggactcgtcgccgatccatgacgcccatgccgacccccgtcctgattcgcactcgccctgatcggaccacacgcccgtccggcatcgacagaagtaagaacggccgggacatgccccggaaagaaacgaacccgcctcatcgaaaaggaaccaaaaatgaccgcacgacacatcgacgccacggacaagacggacggaagccatgtcgtcaagatcctatggaacgaaaacgacggcgaacgggaactgaccgtccgcatgccggcagccggaacggacgccacggaccgcgtggacgtggacctcctgcccgtcccgggagaggatcccgccacgacgatggacgatgccgtcgcggcgttggagggattcctcggcaacaacaagtacatccacatcgatggggacgacgtcagaagcgtctgcgtcggcgccctgaccacggtcatccgcgtggaaagcgggtcgtcgacgggcatcgtggaggcgctcgacggacggttccatgattcgagcgtcgcatccgacgaggtcacgggagcgataatcgccatcgaaggtccgaagagcctccaactgtccgacgccacggcgatcgtcggcggtgtgcagaagcgcctcaccgacaaggtcgagatcatatggggcctgaatttcaccgacgaggacgtcctgcgcgccaccgtactgctcgcaatacaacagaaataaagaacacgacgggtttgcatgcaggaaaatcaaacatcatcggaatgcctgttgcacttacaagtacgagtccccatgctaaccgctggtttccatgtcaccggggcgtcttttatccgtttatccgcgtcaacacgacccgcacggtcaggcaattcgggtcggactcccctgtggtttcgctgaagaaaaccgggggtgctacccaatcagctgttgtgggatttgcgccagatgagatacgagtaaacatacatggctgcgaccgagccaatcgcaagcaccataatcactgccagaatccaggtttcgggcaatatacctcctaaaaatcccagcacaatcaggctaacgcccaccaccatgaaacaggctccgccgaaacggtgggtgcggcgccagttgtcggggtcgtcgaacgcccatggcgttttgatgccgagcgtgtagttttgccgcacacgaggtagataattacccatgccgatgaagaacgcgccgatcgccccggacacgatgacgttgaccgcgcccttgccaggaaggaggttccagacggtgagttccccaagccagctgatggcgcacatgaataccgtgaacgagatcacgaatccttggtagaatccgccgaacttggcatatgcggcacctttcggatcaatgcgcggcaccacatagaacagtgcgagaaacgtcaatggaagcgcacccagaacggatgccatccaacgtggcccccatccgttcacaccgccgtcagcaccccaatgcatgggaatgcgctcaggtagccccggcatggcggcaagatgcgccacgacgttcagcgcgcaaagcagcatgaggacgacccatacacgggccggaataccggtcgaggctttggttgtctcgggtttttcctgcttttgcattgtcagacctttcattgcctgtcttccggatcgtccgcgaagcccatgaaccatccgaccaagtcctgcataactgtggtattgaggctgtacacgatgttctgcccatgtcgttcgtccgttacgagaccagcgttcctaagagtcgccagatggtgactgagcgatggcttgctgatgtcgaaatgctccgcgagctcccccgcggtcatatcccccgcacgcagcagctcgaggatacgacgccgcgtggggtcggcgagcgccttgaatccttctcctgccatcatcgctctctttccagtatcggattgcgatattcatcctaccagatatttagacgtttgtctaaatatctaaaatacggaagtctgaaaacgtcatggaaaccgaaatctcgttttttcggagcaacgctgatgtcaaggaacggcgccttccagcagactcggcaataatcccacgccataggcggcaacatgggcggaaccgcgcaagacaaggaggtcccgaatggaatacattcgaattaccagagacaacatcgatgcagagcacgtctgctgcgccatgtccggcaaacaggcccttgcgaaaaaggagtggctcaaacgtcgattcgacgaaggattgatcttctaccgcagcgtagaacgcggaaaatgcttcatcgaatatatccccgcggagaacgcgtgggttcctatccaagcggatgggtatctttacatcgactgtctatgggtcgccggctccatgaaagggcacggatattccaacgacctgttacggggggtgcgtgagggatgcgaaggagcaggggcggaagggattgtgtattttgtctgccgaaggacgcaagcgcgaattcctctccgacgcgaaataccttgcgcacaagggtttcatggttgcggacacgtcatcatgcggaatcatgctcatgtacctgccgttcggttcggacacggagcctccgcaattcaaagaatgcgccaaatatcccacggcggatggtgatggattcgttctctattacacggaccagtgtccgttcacccactactgggtgccacgcgtggaagcggtggcggaagagcacagcattccattaaaaaccattcacatcatcagccgtgagcaggcccagaatacgccagctccggtcacgacctacgcgctgttcaaggacggcgagttcctgactcaaggcatccagtccgacaagaagttcctgaagctcgcaggcgtacaggtctgatgccggcctgacgttttttaagatgcgggggcatcatgacgttccgcacgcattaccattcgaacaagtcggatcggcccgtacggcatggcggaaacacccccacccgcgcaaccgtcagcgtgcaatgcagcgaaaagcataaagaaaacgggttccgaatgaaccggaacccgtataacgtaaaacctcgaaatatctgaagtgtcagaagtatccgagtttcctagaaaatcaggcgaacaggaagccctggccgtgatgttccggatacgtgtcgaacagttcggcaacggaaccgtcttcgaacacggcgcggatggcacttgccagcaacggcgcgatcgacagaacagtcagaccgtcccaacgcttttcttccggaatcggcacggtatcggtgagcacgacctcgcgtgcgccgcagttcttcagtcggtccacggccgggccggacagcacgccatgcgtggcgacgacggtcaccgacttggctccggcatccttaagcacgttgcatgcgccggcgatggtgcccgcggtgtcaatcaggtcgtcgacaagcacgcagtccttgcctgcgacgtcgccgaccacacggttggcgaccgcctggttcgggcgggtgatgtcgcgggtcttgtgcacgaaggcgagcggaccgccgccgaggcgctgcgcccactgttcggcaacacggatacgaccggcgtccggggagacgacagcgacgttgtcaagttggttggagaaacggtcacggatgtaatcgaccagcaccggcatggcgatgagatgatcgaccgggccgtcaaagaagccttgcgactgcgccgcatgcagatcgacgctcatgatgcggtcggcgcctgcggtcttgagcaggtcaaacaccagacggcaggagatgggctcgcggccgcggtgcttcttatcctggcgggaatagcccagcagcgggcagaccgcggtgatggaacgcgcggaagcacgcttcaacgcatcaatcatgatgagctgttccatgatggcctggttgaccggattggaatggctctgcagtacgaacacgtccgcgccacgcacggactcggtgtagcgcacgtacatttcgccgttcgcaaaatcgtatgctgtggtttccagaacatcaatgccgagctgttcggcgacttccgccgccagcttcgggtgtgctctgcctgtgacaaggataaggttcttatccggctttccttcaaggattgcgctcaccgtgtctccaaacgtctgttctagcgaagtggatgtgacccatactaaccggccgcgcagacctcaccgaccccgtgtgttcggggggccatgcggacggccccatccatcttctatcggtataggccgtgtttaccgatgtattgcaccacgccatcgggtacgagataccaaacgggttcgccatgttcggcgcggcgacgcacatccgtggaggaaatcgccaaagcgggaatctccagcgtatccaccttgccttcaggtaatttcacgccgtccggcgaggaataaccgggacgtgtcacggccacgaaatgcgccagctcccacatcttgttggcgtccttccattgcatgatctccgccacggcgtcggcaccggtgatgaagaacagttccgcatcgggatactgggcgcggatgtcacgcagggtgtcgatggtgtaggtgacgccgggacggtcgatgtccacgcgcgacacggtgaatttcggattcgacgcggtggcgatgaccgtcataaggtaccggtcctccgcattggtgaccttcttgtccaacttgaacaccggccgtccggtcggcacgaagatcacctcgtcgaggtcgtacacccaggacacttcggaggctgcgaccaaatggccgttatggatcggatcgaaagtgccgcccatgatgccgatgcgcaaccggttgtgccagttgcctcgtgcggacctgcgtccggtggtcacggctgattgcggccggtctacggatagttccgacatgcgtcgttccggctcgaccacgtagctgacggtcagttcgggatcggcctccgcagattccggccgcatgcgttttggtccggtcatgcggacgctccgctcttttgcgcgccatcggcctgctgttcggcctgtttctcggcctgctgctctttgtccgcgtcggcggtttcctgctcgatgctgtccgcggtcggtgaggcgttgtcgggatcgatcttgtccatatcctcatcccactcgtcctgcaccacacgtcgaatctcggcgaatgtcggcagcgggaaatccggctggtatatactgcggattccggcaacgcgctcggtgacacgaatcagcgtgtcggtcatgccgacgatgtcatgatctcgttccatcgcgctgaacttggcgatgtgctgttccatgacccgcatctgctcgtcgatatcgtcaagctgggcggcatcgggagtgatgacgtccgaagcgtcggtttcgggccagccgatcaacaccgcgtcggcgtattcgagcgaggcgcgttcgtccgcggacgcgataccgtcttcgacctgcacaaggaacacataccgcacgatgctcaatcgttcggatgccaatcgcaatctgagcattgggtcggtcaagtccgcgttccatgggttcttgttgtcctgcatggtgtgctgcatattgtcctgcatgacttcgtcgctcattctctcacctgtcctgttccgtagccaatccatttggtcgtggtcatctcgtgcagccccatcggaccgcgcgcatgcatcttctgtgtggagatgccaagttccgcgccgaatccgaacacgccgccatcggtgaaacgtgtggaggcgttgaccatcaccaccgccgagtcgatgcgggcggtgaattcctcgatggccgaatagtcttcggcgatgatggattcggtgtgcccggtggagtggcggttgatatgcgcgatggcctcgtcaagcgagtcgaccaccttgatgccgattttgagtgccagatattcggtgtcccaatcctcgtcggtggcatgcacgagttgcgcatttgcgattccggcatgttcgatgatgccatacgcgcgttcgtcggcatgcatttcgactcccgctgcggcgagcgctgccgcggctttcggcaggaagctttcggcgatgtctttgtggacgaggagtttttcggtggcgttgcatacgccgacgcgttgggttttggcgttgatgaggatggggatggctttgtcggggttgccggtgcggtcgacgtagatgtgcacgttgccggctccggtttcgatgacggggactttggagttgcgtaccacggcttggatgagtcctgctcccccgcgtgggatgagcacgtcgatgtggccgcgtgcttccatcatggcggtggcgccgtcgcgtccgtattggtctacggtggcgatcatgttgtggtcgtatccgtgtttggtgagtacgtcggcgatgacggcgagtgttgccgcgttggtgtgttcggccgcgtgtccgccgcgcagcaggacggcgttgccggatttgatgcatagggaggcaacgtcgacggtgacgttggggcgtgcttcgtagatcatgccgagcacgccgatggggacgcgtacctgctgcagtcgtaggccgttttccagatggtatccgcgtacgatttcgccgatggggtctggtagggatgccacgtggcgtacgccttgcgcggcggcggtgatgcgctgctggtcgaatttgagtcggtcgagtttgccggcgtccatgccgtcggtttcggctttgttcatgtcgagcgtgttggctgcggcgatgtcgtccgcatgctggtcgagtgcgtcggcgatggcgttgagcagttggtttttggcttcggtgtttgcctgggcaagttgcgattgcgcggtgcgggctgcgtcgcccatggcgcatactgcttcgaacacgtcggcgttcatggcggtgccttggttctgtggattcgtcatagtctcttagaatagcgcgaaatcacgcctcgctgggcaatgacggccattttcgggtcgttggttgcgcggcgggacgcgatttcgtcagtcgaggctggtgatcagtggatttggtcgagtcccgggtaaagcgggaagtcttcggcaagcttgtcgacgcgcgccttgagcgcgtcgacgtcctgtcctgcggcgagcgcggtgccgatgatgtcggcgacttcctcgtattccttgggtccgaagccgcgggtggcgagtgcgctggtgccgatgcgcaggccggaggccacggatgcggggcgtgggtcgaacgggacggtgttgcggttgatggtgatgccgcattgtgcgagcaggtcttcgccttgtttgccgtccatttcgctgttgcgtaggtcgaccatgaccaggtgcacgtcggtgccgccggtcaggacgctgatgccgttgtttttgacgtcgtcggccatgaggcgttcggcaaggatcttggcgccgtcgagggtgcgttgcatgcggtctttgaattccggggtggcggcgactttgaaggcgacggccttgccggcgatgacgtgcatgagcgggccgccttgctggccggggaatacggcggagttgagtttcttggcgtattcctgcttggcgaggatgaagccggagcgtgggccgccgagggttttgtgcgcggtggaggatacgacgtcggcgtatgggacggggcttggatgcagtccggcggctacgaggccggcgaagtgggccatgtccacccagaatttggcgccgacctcgtcggcgatctccttcatggctttgaagtcttcgatgcgcgggtaggcgctccatccgccgatgatcatggcgggatgggtttcgagcgcacgctggcggatgatttccgggtcgatgcggaaggtttcgggattcacgccgtaggcttcggcgtggtagaagcggccggagaagttgattttcatgccatgggtgaggtggccgccgtggtcgagggcgaggccgaggaccgtgtcgccgggtttgacgagcgcctggtagacggctgcgttggcctgtgcgccggagtgcggctgtacgttggcgtattcggcgccgaataggcttttggcgcgttcgcgggcgatggtttcgattttgtccacctgctcgcagccgccgtagtagcggcgtcccggatagccttcggcgtatttgttggtcagtacggagccttgtgcctgaagcactgcacgcggcacgaagttttcggaggcgatcatttcgagtccgttttgctgcctggatagttcggcgtcgaggatttcggcgatttccggatccgcttcggcgatgggcgcgttgaacatgtcgttcggtgtttgcgcaagaggtgatgcagtcatgaagccctccttgacttcggaatgatcatccgctgtaccgcgggttacagagcagtgtacgtgtgaaaacgatcggaggaaaaccgggtttcgaaacatgtgggaaatatggcaccgcctgcgcgcgaagacatggacggcacgatcgcggtgccacgtggaaaagcaggaccttccgtcggcaatcgtatggggtcggcgtcccattccacggacgcgaggcgacgttcttcccacctgtgccggtacactgagaagcacgtttgacgtaatctgtccgttctattgctaaggaaatcaagtgaccacgttccacagcacacgcagcaccaccgattcgcttacctccaagcaggccatccgcaagggcatcgccgatgatggcggcctgttcgtgaccgactccttgggtgagacccatgtggatatcgcttccttggccggcaagtcctaccagcagatcgcgttcgatgtgctgtccgtgctgctgccggactacaccgaggccgagctcaaggagtgcatcgacgaggcgtacggcccgcagtggtccgacgagaagatcactccggtcaagccgctcggcgatgactatgtgatggaactgttcaacggtccgacttccgcgttcaaagatgtggcgctgcagattctgccgcgtttcatggcgcgcaccactccggcggatggcgacgcggatgagaagatcatgatcgtcaccgccacgtccggcgacaccggcaaggccgcgttggctggtttcgcggacgccgcgggcaccggcatcaccgtgttctatccggaaggcaaggtcagccaggtgcaggagctgcagatgaccacgcagtccggctccaatgtgaacgtgtgcgcggtcaagggcaatttcgatgacgcgcagtccgccgtcaagcgcatcttcggcgacaaggagcttgccggacgtctcgccgatgattcgcatgtggtgctttcctccgcgaattccatcaatgtgggccgtctggtgccgcaggtcgtctattacttctccgcgtacgcgcagctgctggaacgccaggtcatcaatgtgggcgacgaggtcgagttcgttgtgccgacgggtaatttcggcgacatcctcgccggctattacgcgaaactgctgggcctgccggtcaagcatcttgtggtggcgtccgacaagaacaacgtgctgttcgacttcctgacttccggcacgtacaaccgtcagcgtccgttcttccagaccatttccccgtcgatggatatcctcatctcatcgaacctggagcgcatgctgtattacatgtccgacaaggacacacgcctgatctccatgctgatgaacgatctgagccagtggggcgcctacgaggttcccgagccgatgatgaagaagattcgttccatcttcggcaccggttgggccgatgagaaccaggtgcgcgagatgatcgcggactgctggaacaagaaccattacgtgatcgacccgcacaccgcatgcggctactacgtcatgcagcagatgccgcgcgatccgctcacgccgcgcgtgctgctgtccaccgccagcccgtacaagttcccgcgcgtagtcaacgaatctctgggtcttgacgcgtccggcaccgatttcgaatgcatggacgtgcttgccaaggccaccggcaccaccgctccggccgcgctgcgcggtcttgagaccgccaacgtgcgtttcgataacgtcgtcgaaatcgacggcatggaaggattcgtcgagcaggccgcgaaggcgctgtaaggtttcgacaggcaaaacggcaacgatacatagaagaatcggctgtccgcgatatgcgggcggccgtttttcattgacgctggtacagtgcgttcccgaaaggcaggagaatcatgagcgtagcttcagcatcgcagtcgggcgtaacggcaaatcggccggatgaacccgcggaaccgaggaaggaccggctcatcacccgtgacgtggcgctggtgatgctggcgacgttcttcttcatgaccagcaacatggtgatcacgccggtcatcgccggctatggcgagtcgatgggagcgacgggcgcgctgatgggcgtgatcgccggcgcgatgagtttcgtgtctctgttctgccgtcccatcgcgggcaatctgtcggatttggtcagcaagaggttgctggtggctgcgggaacggtgctgtacatcgtggcgggcgtcatgtattgtcttgccgattcgacgggcatgctggtcgtggcgcgcatggtcaacgggcttggcttcgcatgcggcacggtttgtctggcgacgtgggtgtcgctgctgcttccgatccggcatatgggcgcgggcatgggattgtacggcatcgtcaacgcgttggcgattgcggtcggcccggcactcggcatccgtctgcaggcggccgtcggctaccagtggacgttcatcgcatcgctgacgcttaacgtgtgcgcgttcgtgacggttctgctggtgaaaaacggtggcaggccggctcgtaaaaccgttgccgccgagcagtcgttacggcatcgtctgcgtcttcgcaatctggtggagccacgggccattccattggccgcggtgttcatgatgttcgccatcccttatttcgcgaaccagtcgttcctggtggattacatttccacacgacatctgcgtatctcgtccgacttgttcttcgtgttctatgcggccgcgctgctggtactgcggctcacgttgcgcgacctgttcgattcgaagggtttccgtttctggcttgtcgtctgttcgtttgcgatgttggcgtcgcttgcctttctcacgttcatgacgaacgattggtatctgcttggcgcgggcatcgccatggcggccagttatggactgatgagttccgtcacgcaggcgcaggcggtggtgatcgccggccgggagcgcagtggcttggccaacggcacgtactatatgggcatcgacttgggtatggcgttggggccggtgctggctggagttctctatgggcacctgccgatcgcatggttctatcccctgttcatgctggcgctgccggtgtcttggctgatctacctgtccttccaccgtctcatccatccgtcgcacaagtaacggacaggcaccgcagccggtaggcaccaactgttcagaatggcggaataccaaggttttcaattacggccatgctgttatagatcatataataacagcatggccaaatctgtgttactgttatatatagctgttgaacagtttgcgtacactgttcggtcaggatatatatcactcgcagaaagggatacagtgaagctgaacatctcatccgcgtccggcaaaccgatttacgaacagatcgaagatcagatccgagcggcgatcatgtcgggcgaactgcaaaccggcgaggcgctcccctccctcaggaagcttgccaaggaactgcacatcagcgtgctcaccatcgccagagcgtacagcgagctggcggatgaggggcttgtcgagaatgtgcagggcaaaggcacgttcgtgctggcccacggcaacgagcttatgaaggaacgtgcgcgcgaacgcatcatggacgtgttccggcagacggtaaccgccgccaaggccgccgacatcagcctgcttgatctgcttggcatgttcgagaaggcgtatagggaacaatcatgagccgcgtcttcatgaggctcaacaagatatggacctgatcggcgtcatgaaagcgtgaagcggtcgaatcacgcaatggcccggaaacatcaggcgatgatgcaaaccgttacagtatgacgggcgcgtcgtggaagtcgaacatgacgccgtcggccagattgcagatctcaggccagtcggcgtcggaggaatcgtcgtgcatggcccacacatgcatgccgaccgacttggccgagcgcatgccgaccagcagatcctcgaatacggtgcagtcgcttggtttgatgccgagacgcgacgcggccagcagatatacgtccggctcagttttgccgacgtcgccagcatcgtcgacgctgaccacgtcatcgaaatagtcgaaaatgccgacgtgcttcatggccggttcgcgcagcatcggcggcaatgacgtggccacggccagtttcgcgccgctcgccttcaacgattccagatattcgcgcgcatacggtttggcttcaaccaccgtggcgtacatgacacgtgccatatggtcccactcctccatcaacgcttcgggagtgtccgacaggccgaatcgtgcgattgtgtattcggcgatctggcggaattgcatggccgcgaccttctgcatgtagtcgtccggcacctcgatgccgcgtttggcaaggaagtcgacgtccacctgatcccacacgcccatggagtcgagtagcgtgccgtcaaggtcgaagatggcgcctttgccttggttcgccttggttttctgtgtcatatcggctcctttgttttgcaattaccgcttttacgatttgcgattactttttacgattgaatccgccgtcagtcaagcaccgacgatttgagcagttcctcggcatgttccagagatgtttcactttcgctgccggacagcatgcgggcgatttcgtgcacgcgctcatccccgcgcacctggctgatggtggtggcgatggaaccatccttggtttcgcctttggcgaccacatattgttcgtccgcccaggaggcgacctgcggcaggtgcgtgacgaccagaacctgcgcggattgggcgagtttggccaagcgggcacccagttccacagcggccttgcctcccacgccggcgtcgacctcatcgaagatgaacgtcatcggcggcacggttccgccggccacgacatgcttttcggcggcgaccagttcaagcgcgagcatcagacggctcaattcgccgccggatgcgcttttgcccatcggcagttgcggggagccggggaacggggtgaagaggaattcgatgtcgtccgctccggtggcgtccaactgttcgcgttcggccacgcggatctccagtttcgaagtgcccatggccagcgaatcaagttccgcggtgactttggacgcgagttccttcgccgcggctctacgccgtttgctcacagcctgcgcggcttttttcgcagcctcaagcagttgggcgcgttcggcttccagctgttcgaccttttccggcgaggcgtccaaatcctccaaatcgtatacggccttgtccctccacgtgatcacgtcggacaattccggcccccatcggcgggtcagctcgtccagttcgtggatgcgcccgttgatggcatccagatcctccacgctcgcctcattgtccacttcgccggacaggctgaacaccacgtcggacaaatcggtgctgatggagtcgagccggtcggcgagttcggagaacacgccttccacgtgaatggcgcgcaatgcctgcgaggcacggtcgatcaaatcggcggcgctggccgattcaacgtcatccgccacttgcgaagcgtccaacgcacccaatgcgcgggtcacgccttcggcgatttcggcggcgttttcgatgcggtcccgccgtgcgcgcaattcgtccatctcccccggctgcgggtcgacccggttgatgcgttcgattgactcacgcaggtaatccgcctgctggcgcatggacgattcctggctgctgagcctttccaaacgctcgtccattgcgcgcagcgcgttccacgtcttgccgtaggcggccaacgccacttcatcccccgcgtagcggtccaggaattcacgctgccgcgaaacggtcgcgatacgtaactggtcggcctggccgtggatcgtcaccaattcggcggcgacggaagcaagcacggaacgaggcacgctacgtcccgacaacatgctgcgggatcgtccggaagccggcaccttgcgcgacaggaacagttcgccgtcctctggctcgaagccagcctcccgtgcggcggccaccgcggccggcgacgaagcgacttcgaacacgccctgcgcccacgcctcctgagcgccgacggaaacacggccgccgtcggagggaccgccggaaatcagtcggatcgcactgagcagcatcgatttgccggcacctgtttcgccggtgatcgccgtcataccgcctgccggggcgatcagcgcggaacggatcggaccgagattgtggatctcaagctcttccagcatgccctgtcacttcccgctttccggtttgccggttctagggaacgattgcccatgatgcgtgccaccggtcttgcgcgcctgctcgcgccatccgacgacaggcaggtcgaatttggtgacgagacggttcgtgaacggcacgccggacagtcgcgccaatcgcaaagtgcatttcgattcgcgcacttcgatgcgtgtgcctttcggcagggcgcgctggcggcggccgtcgcagcagatccaaccgtcggacgtggaatcgtcaagaatgtcgatggcgaacgtggagccggagccgatgatgagcggacgtgcgaacaatgcgtgcgcggccaacggcaccaattgcaatgccttcacattcggccacatgatcggcccgcccgcggaaaacgcgtaggcggtggaaccggtcggcgtggatacgatcacgccatcgcaaccgaaggagctcatctccacgtcgtcgacacggatggacagttccaccattttgccacggtcggcgcgttccagcgtgatgtcgttcaacgcccagtcctcgatgggttccgtcgcgcccggcagccatacgtcgacgtgggcgatcatacgttcgtcgatggaatagtcatggtcggcgatccggcggatggcctcgctcatctggaagctttcaaattcggcaagaaagccgacgtggcccaggttcacaccgagaatgggcacttcggtggcatgcaccagttcggctgcgcgcaggatggtaccgtctcctccgagcaccaccacgatttccgtgttcttcggcacggcgggcgtcctgctgccgaactcgggcgcttcgatattgtcgatgatcgtcacttcgaaattggcgcgtctcaactgctcgacggcttcttcgaccaccgtgccgctttcacgcagacgcgtatgcgtcaccaccaccgcatgtcgggtaccgatcatcgcaagccctttcgtataacgggcgccccatgcgaggtgccactacccgccagtgtagtcgaacaaatgaacgaatgacggcagcgggtgtccagaacacgccgcagacgtccgaagagtcccatggagccaccgcggaaccgtcgaacggtacgtccatggcccattcgtcacactaccgcctacaatatctcaaggaaacgaagaccgtttatacagacaaggagcgaggaacagcatgtccaacctcgtcttcgacgagtcctcctccaatcgcgaggcctcacatggctatgcctggtggttctccggggacacgttcgagaaggccatggcggaggagcgcaagccgcgcaagcgcagcctaatgcacagactcaccacacatcccggacgtctgaccatcctgtacttcatgatgttgggcgcattgtccacgctgctcctgctcacgcccaccgccacgccgaaaggcgagaagacgacgttcaccaccgcgttcttcaccgcgatctccgcgatttcgacgtgtggcatctccatcgtcaattcgacgacgcattggtccgctttcggccaggccgtgctcatcttctccgtgcagatgggcggcttgggcgtcatgacgttcgcttcactcatcgccttggccgtgaaccaccatctcaaggccacgcaaaagctgctgacggccaacgagctgggcaccacgaaactcggcgagatcaagggcgtgctcaccgtggtcatcgccaccgcgttcaccatcgaaggcatcacgttcgtggcgctgttccccggcctgtacaaagtcaatcatggcaatgtgcggcacacgctgtgggaatcgttgttcttcgcggtcatggcatacaacaacgccggcttcacccctgacggcgccggcctgcatgtcaacaattgggctgtcggtctgcctatcctcgtcagcgcgttctgcggcacgctcggctttcccgtcctgcttaacctcatgcgctcatggcgcaaccatcgtccgccgaagcgttggagcctgcataccaagctcacgctgaccaccacgttctgcatcgtgctcgcctcgttcacctggttcctcctcatggaatggaacaacaaactgctgttcgccaccgaaggtgtggaaccgcggttgtggcatgcgatggtggcggccgtcatgccccgcagttccggcttcgacctgtcatggatgccgggcgtgagcgacgcgacgaaggtgttcctatccatcgtcatgttcatcggcggcggcagcacttcgaccgcaggaggcatccgcgtcaccacattcgccgtgattctgttgacctgccgtgccgcgttcaccggacgccatgacgtcaacgcgttccatcgtcgtatccattcgcaagccgtcatgaccgctgtggccgtcaccacgtcatgtctgatgcttgtcaccgtggtgtccatggcgttgatggccatcaccggctgctcgctgagcaacgcgctgttcgacacctgctcggcgttcggtctgggaggctattcggtcggcgtggccagcgcttctagtccagcggtcctgtacattctcgccgcgaccatgttcatcggcaggctcggtccgctcaccatcgcctacgcgatctccaggccgcgcaatgtggagccggtccgctaccccaccgagcagatcgtggtcggctgagcggattcgtcgatacggtttctatacccgcaacttcctatacttgaatccggaacagaacatcgaaaggtacgcgaacaatcatggctaacaacaccagaagcgttcttgtggtaggactcggccgtttcggcagttccgtagccaccacattggatgcgatgggccaggatgtgctcgccgtcgacaaggacggcgaactggtgaaccgctggtcgtcgcagattcccaccgtgcaggccgatatgaccgatgtgatggcgttggagcagatcaacgcctccgatttcgatacggcggtcgttgccatcggcgacagcgtcgaagcgtccgtcatcaccgccggcaatctgcttgatgccggcatctccgacatttgggcgaagtcggtgtccaaggagcatgcgcgcattctgcagcgtatcggggcacgccacatcatcaacgcggagaccgatgccggcaagcgcgtggggcacttggtgtccggcaactatctggactacatcgagcttgaaggcgcgtacagcgtggtgaagatccacactcccccgcatgtcgtcggttactccatcgaggatgcgcgcgtgcatgaacggttcggcatcaccgtggtcggtgtcaaatcgccgggcaaggaattcgaatacggttcgaaagagctgattatgcaccgtaacgacgagctcatcatcatgggcaagcaggatcagatcgacaagtttttgaggggctaggcccgcggaacatgcaaaaggccggcggtccatatgggatttttcatatgggctgccggcctttcatttttacgctatcgattggcggagaacggtttacgccactgcatacagcagatactcgatgttgccgtgcgtgccttcgatcggtgagaccgccgtggcgcgtacatccagtccgttggctttcgcgcaggcggtgacggtgtcgagcgcctgtttgcgtaaggtttcgctttccacgatgccgtttttgccgaggttgcctttgccgacttcgaactgcggtttgaccagtagcacgacgtgtgcgccgggcgcggcgatgcgcgcgatgacgggaatcacgtatgtcaacgagatgaatgacacgtcggatacgatcatgcttggccggtacggcagatcatccgcttcgacgtcgcggatgttgacgccgctcatttcgatgatgcgctcgttgcctgcgatgcgcgggtcaagctggccgtgtcccacgtcgagcgcgatcacatgcgcggcaccgcgtcgcagaagcacgtcgcagaaaccgccggtggacgcgccgatgtcgaggcaatcgagtccttccgcggaacgcaggcccgtctgggagaacatgtcgaacgcgccgaccagcttgtaggctccacgggagacgtaatcgtctcccagatcggcatcaagcgtgtcggcggccgtgactttgagcgacgctttggatgcgacggtgccgttcacccggaccttgccggattcgatcagccgttgtgctttggagcgactatccgtgacgccacgctccaccagcgcgatgtcgagtcggacgacggcaccggaatcgtcattcatgttgcgcatacgcacgtgcggcaatcaggcgattcggaattccggcacgatcatgccgtcgacgctgtgtccgcgatccgccgcatcccacatggcggcgcaggccgcacgaagaccgtcgacgctggtgatgtcggtgacgtaaagacgatcgccgtcgacgcgcgcctgcacgtcgcggcagctccaagcgccagcctcatgcacgacttcgggggccgactcgttaagtccggtcaggtccttggcgatgtaggtcggacgcagatgctccggagcgaacatcagctcatgcggattggtgacgccggtcagcacggccagggaatcatagccgccacggttgccggcttcgatatcggtatcgaggcggtcgccgatggcgaggcatgcttccttggccactggttcggcaccatcatgcgcggcaagcagtcgggcttcgtcgtacatggcggattccggcttgcctgcggacgaaaccggttccacaccagtggcgttgatgacggccatgatcatggaaccgcaaccgggggcgatgcccagctcacgcggaatggtcaggtcgcggttggtcacgaaatacgtggcgccctgttctacggcgtaggcgatttgcgccatctggttccaagacatgtccgggtaccagccttggatggccgcgaccggcttgtcttcggcggaatcaaccacttcaagaccctgcttggcgacttcctcacgcagatgctgtgcgccgagcacgaacactttcgcaccttgcggcaccgcacgggccaccatgcgggcagccaccacggacgaggtaatgacctgccatggttcgacgtcaaggtcgaagcctttaagctggtcggccaccacggattgcagtcgggaggaattgttggtggtgtattccaccgtcatgccgaggccttcggccttacggatgctctctgcagcatgttccaccggattcttgccacggtagaccacgccgtcaagatcaagcagcgccagctggtaggcttcgctcagcggacgggttgtggatttcagcattgttttgcctcacctcactcgttgtcggaatcggctgcggattcgacctcatcctcagtctggtcgtcttcggagtcgcccgcgttttcgccgtcaccggcaggctcgtcgtcggactcggcgccttccttggccgcttcggcatcaagctgggtctcatcgttggtctcgccgttctcgtcgacggcctcggaatcgtcctcatcctcgtcttccggcgcatactgggcgtcatcttcggaaatgccgagcttgtccataagctcgtcgttcaattcctgcatgtcgtattcaatgaccagatcgtcggaggtctcgtcctcttcggcatcggcgtactgcagctcaagcttgtcaagcagctggtcgagggccacggcctcatcggagcgtccggcctgctcaaggaagtactgttcggcctgcaccgcacgcatgcggtattcgccggccaggcccttggaacggcccagcgtatgcacgatctcaatggccttatcccacagctcgaggtcacccagcgcgcccgcgtacacgaggaacatctcggccttggattcgccgcgcagatacttcgcgtcatcgctcatggcggtttcgatggccttcttcggctcgcccatgccacgctcgcagtcggcgatgaacggcagatagtcaaggaaaccgttcatgcggaacgcggtgcggaactcacgcagggcaagtttgtaatcgccctgacggtaggccacgaacgcaagggtctcacgcgcgaaatcaatacgggaagcctgatgcgccacccacttggcgtgttcgagcgccagctccggatccctttcctcaagcgtgtaggcggcgaggatgtgcaggccgatgttctccgcatgttccttggacaggccacgcagacgctcacggtcatcggtggacagcatgctccactcgatgcccttcggcatcttcggctcgcccgggcgacgatgcgtgtacgggttttgcgacgggaagctcatcgtgccgtcggaattgcgacgcggcttcgacaggtattcaccacgcttcgcctcgcggtactccatcttctcttcacgggtgaattcgcggcgctcctcgccttccggacgctggtcgcggtccttgtggaagtcacgacgctggttgtcacggcggaaatccctgcgatcgccgtcacgacgatcatcacgacggaaattacgacgctcgccatcacggcgctccccgcggcggtcatcgcggcggaagtctctgcgatcgccgtccttgtggaagttgcggccgccacgacgctcaccatcgtcacggcggaagtcacgacggtcaccgtcatgacggaaattgcgacgctcgccatcgcgacggtcatcatggcggaaaccggaacgctcaccatcacgctggtagcgcggattgtcgccgcgattgccgcgatagccgccgcggcggtcgtcacgacgctcgccatcgcggttgaacttgcgcggaccgttgtggaaacgacgctcctgaccttcgccttcgccatcgcgatggaaatcgcggtcgccacgacggtatccgccgccattgcccttacgatatccgcccttacggtcatcgttgtggaagccgccggacttgtgtccgtaggacttgccgccgttgccgcgcggcttgaatcccttgccaccgcggttacccggcctgcccgagccgtaggacttgtggttgccgtaggacttgccgcgcgatccgcgctgttcttctgccatgctgttccttattggtcttgagatacttgcgattatttacttacgattgcctatgcgtctcacgcctgttcgacgacgccgagcgccttcttgccgcggcggatgagcacgaaacgaccatgcaggaagtcaccttcctgcaacgtctgttcctcatcctccacgcgcgtgttgttgaggtacacgccaccggacttgatggtcttgcgcgcctcggaaatcgacttgaacaggcctgccttcataccagcctcggccacacggtcgccggctgcgaccttggcgaattccccatcgaccttcatgccgtcgatagcggcctcaagcgtggactcgtcgatgtccgccagatcgccgccacgtccgaacaacgcgccggcagcttcgatggcctggcgagtggcttcctcgccatgcacgaagctggtgacctcccatgcgagggtgcgctgcgcctcacgcgcgcccggattggtcttgctttcctcgataagccgttcgatttcggcctttggcaggaaggtgaacgccttgagcaggttctccatctcgctgtcgggacggttgaaccagaactggtagaacttgtaggggctgagcatcgtgccatccaaccagacggcgttgccttcggacttgccgaacttcttgccctgcgcgtcggtgatgatcgggctggtgaacacgttcacgtccacgccgcgcaccttgtggatcagatccagaccggaggtgaggttgccccactggtcggagccgccaatctccagcacgcaatggtattcgtcgaacaggtgcaggaagtcgttgccctgaagcacctgatagctgaactcggtgaaggagatgccttcctcggagttgaggcgacgggccacggtgtccttggcgagcatggtgcccatacggaaattcttgccgacgtcacgcaggaagtcgatgacgttcatcgaagcggtccaatcgtagttggacacgaaacgcaccggattgctgccttcggtctcgaggatgccgccgatctgcttcttcagacgatcggcccagccggccacgacgtccttcgggttgagcgtgcgttcgcccgactggcgcggatctccgatcaggccggtggcgccgccgaccaacgcgatcggatggtgtcctgcggcctgcaggtggcgcatgttgatgagctgaacgaggttgccgatgtgcagggaggcggcggtcggatcgaagccgcaataataggtgatgggctctccgttcaacgcttcggcgagtcgatccctgtcagtggactgggaaatcaacccgcgccattccagttcatcgaggacggaatcgaaaccggcctccttgaaatcgatgacgtgagccataactgtgctttctccctatcgaattgtggacattaccgcgttttacgcaccctacagtttcgcagaagacacagacagccgcgtgtgccgttttccatgtttttatcaaagcgatcacggaacatgccggttaaaatcgaaaatggaatctcatcgacgagaagaagggaggtctgcatggatcgcaaaggcatgaaggccaatgcaaggaaagcctataagagacactattggatgatagtcgtcatctgcctgttcgcttcggtgttcggtgtcgcctacagttcgtcgacatggtcggtgaacgccagttccccgtccgcaaccgtgcaggaggatggcacagcgcaatccgacaacgtgtcgaaagtgttggagaacctgcttgtcggcgatgaaagccaggcacgcaggcaagtggagcacaatcaggagcagatcgtgcaaaacgacaccaatgccatgatggggcgtaaacgcggcgtgttcgcgtctctgctcaactcgttctcatcgggttcggtcattctgtcgatggccgatgcggccaattccatcgtgcataatgacggcgtcgccgtggccgtaccgatcgtcgtatccctggccgtttaccttttcgtatggctgttcgtccagcagacataccgggtggtcatgatgcgcatgctgcttgaggggcggacctacgacaaacttcccgtgagccgtttcctctacccgatcaccacgcgcaaatggttgtcgatggcgaaggtgatgctgctcgagaacgtgttcctgttcctgtggacgttcaccatcatcggcgcgctcatcaaaccgtattcctaccgtatggtgccctacatcgtcgccgaaaatccgaatatcggggcacgggaggccatcagcctgtccaggcgcatgatgaagggtcacaagtgggagtgtttcgtggccgacctgtcgttccttggctggtggctgctcaatctgttcacgctcggcttgagcggcatcttctattccaacggctataacgcggcgtttttcgtagaatattacgtgcatgtgcgcggattgtccaaggattcgggattggagggaagcgagctgctcagcgacgaatacctgcacagcaaggcctccgctgagacattgcatgccgcgtatggtgatgttgccgaaacggtggagcagttgtccagcaatcttgttccggtggacaagccgaacggtttcgtcgggttcctgtccgaatggttgggcgtgcgtatcctgcatgcgcggtcggtgaccaagtatgaggagtatcgcgagcaactgcaccagatcgataccggcagggagattctggacggcgctatctatcctggtcgtctggctccggcgccgatggcgttccggttccgcgaatcccgcaccgtcagctccgatcgcagctattcgttggtcaatctggtcatgatgttcttcatcttctgtttcgtgggatgggtatgggaggtgagcctcgccttcatttccgaaggaacgttcgtgaatcgtggcacgctgcatgggccatggctgccgatctatggcaccggcggagtgattatccttattctgctgaagaagttgaggaagaagcccttgttcgagttcctggccgccatggtcttgtgtggcgggttggagtacttctcgtcctggtatctggagaagacccacggaggacaacgctggtgggattacaccggttattttctcaatctcaatggtcgtatctgtgccgagggtctgctgacgtttggtttgggcggtttggcgatcgtgtatctgctggctcctgcattggacaacttgctgagtcgtatcgatacaagaaagctcaccgttgtggccgtcgtgcttctggcgttctactgtgtggaccaggcgtattcggcgcagcatccgaacattggtaccggcatcaccgattacaaggggtcggccacatcgcaagtatcgtagcccctatccgatgtgatgcataaagggattttgcccgtcagcgtgcgcaacgcaggttggcggggcaaatcgtttttggacacatgctatacgacacgtgtggccggtggaaacttactttcggcgcagcatctcacgcacggtttccatgatcttgctgtatttggtggagtccgtggaacgcatgcgtgggaaggagcggatcatacgacgttgctgccaattcaacgcggaagagacaagctgacgcatattggcaacacgttcctgcgacgattccgacaaatcatgcatcttctcgcggaattcctctttgccccactgccaggagtctccggccttctccgcacgctcctgcaccgcttcgctgaatttggcgagacgctcggacaggccgacgatgcccaccacggtgacgatggtgtcgatgataacgacgatggcggcgaccgcgcatatcacgtgcacggcaagcagcggaatcatggcggtgagccgttcgacctgcggctggaccacatcgatgatcaatactccgccgaatccgaatacgattgcgccgagcagacagatgcggccttggatgttgaatcggtaatggctgtaatcccaccatctggcgtggaacagcttttccatgccccaagaggtgatgtattcgagtatgctcgcgccgaatgaggagataaggaaaatctcgatgggattcgtgaagtcatgcaacagcacgatcgcaagcaccgcgccgcatccgtaaattgggcacaacggcccgttaaggaaaccacggttgacccatcgacgttccgaaacggacacgagaaccgactcgtacacccatccgatgaaagcgtataacaggaaccaaaggaacaaatattcgagtgtgagcgccacagccatcagctcctgtccgtcggttgttcggatgcgggtttgtcgaaacgatcgaaagagagcgtttccttcgtggcgctgattttgtcggccgcggtgacaaggtatccttcgatgtacttcggcggatagggagtcaatgggaacatgtgatgttcgatgctgtcccgttcgatctggttgagtttgaaatcccgtatggcgttgcgcatggccgtttcaccatgtgtgaatccgtgtagccgatgggtgccgttgtcccagtcatgccaatcgtaaaggaagtaatcatggagcaaagcggcgcgaatcaacgaacgtagatcaaccctattccacaggtgcagtctgtctgccagccagacggacagacaagccacacgaatggaatgggcgaatgtggtgaccacgccatgctggtagcagaccctttcgatggccatgtggtcatgttccagaatctcccggccgtgcgcgtagaccagccgtcgtatctgcgtgcgcgtcaacagcaccgctttttgctccttgcttaatagggattacttgagcagggattcgggcgacttgtatgcggaaccgtcggacacggagttggcgaaggcgcgtagctgctcgatggtggtcttggcggaaacgatctgttcgcgcacgcgcagcggggaggtgcctcccttgccgttgcgggcggagacggagccttcggtggacagcacttcacgcacctgcggggccttgtccgccggcaggaagtccttgaacacgttgatgaagtcctcgtcggtcaaatcccacagctcctggccgtggtcttcggcaatcttgacgcatgcgccggaaagctcgtgcgcgtgacggaacggcacaccgttcttgacgagccattcggcgatgtcggtggcgagggcgaaaccggtcggggcttcggcttcgaggcgttccttgtcgaagaccatggtggcgaccatgccagtgaatgccggcagcagcacttcaagcgtgtccacttggtcgaatacggcttccttgtcttcctgcaggtcgcgcgcgtaggctgtcggcaggcctttcaaggtggcgagcaggccagtcaggtcgccgatgagtcgtccggacttgccgcgagtgagttcggcgatgtccggattcttcttctgcggcatgatggacgagccggtggagtaggcgtcatcaagacgcacgaacgcgaattcctgggtgttccagatgatgatctcttcggacaggcggctcagatcgacaccggtcatggcggcgatgaaggcgaattcggcgaccagatcacggctggcggtgccgtcgatggagttggcggtcaccttggagaagcccagctcacgggccacagccaccggttcgaggccaagggtgctgccggcgagggcaccggagccgtacgggctggcgtcgatgcgcttatcccaatcggcgagacgttccacgtcacgcagcagcggccacacgtgggccatgagctggtgggcaagcagaactggctgggcgtgctgcatatgcgtacgtcccggcatgacggtgcgaccggctttttcggactgctcgatcagtgttgcggcgagaccgagcagcattttggcgatgatgcggctgtggcggcgcagccacatgcggatgagcgcggcgatctgatcgttgcgggaacggccggcgcggagcttgccgccgagttcgtcacctgcgatttgaagcaggccgcgttcgagtgcagtggcctcgtcctcgtcatcctcgatcggagcgaatgctccggaatccacgcggcgctgcagctcgtcaagggcgtcttccatgcgctgcagctcatcggcggtcagcagtccggcgcggcccagtgcacgggcatgggcgcgcgaaccggcgatatcgtcatcggcgagtcgccagtcgaattgggtggacttgctcagccgtgcgagttccggcgacggaccagacttgaaacggccgccccacagggcaagatgctcaccattggtagtgctctcggtcattgtttttccaaatctccttgcagatatgactgagggagagcttaccagtcaggatggtcccgacggtacgctctcccccattatcaagacgattcacaacgtgaatccggatgatgcttactcgacgctgttctccggaacctcgatgccgttgccgaacttgacgtcgcgggctgcggccacgcggctcggcagaccatagatgtcgatgaagccgttggaggacttctggtcgaagctgtcgccggaatcgtaggtggccaggttgtagtcgtacagcgagctgtcggagcgacggccagtcacgacggcgcggccaccgtgcagaaccatgcgaatctcgccggagacgtacttctgggtgtcttcgatgaaggcgttcagggactgggttgccggggagaaccactgcgcgtcgtagaccagttcggcccagcgcttgtcgatgtcgcgcttgatgcggtgctgctcgcgttcgaggcagcagttctcgagttcctggtgggcggtgatcagcgccactgcgcccggagcctcgtacagctcgcgggacttgatgcctaccagacgatcctcaatcaaatcgatacggccgatgccctgcgcgcctgcacgacggttcatctcttcgatggcctgcagcggagtgacgtcatgaccgtcgatcttgaccgggacgccctgcttgaattcgatgacgacctcatcctcgaccggtgggaacgccggatcgtcggtgtaggagtagcagtccttggtcggaccgttccacggatcctcgaggaaaccggtctcgatggcgcggccccacacgttctggtcgatggagaacgggctcttctcggtctgcacgatcggcagcttgtgttccttggcgaaggcgatctcgacgtcgcgggtcagagacaggtcacgaatcgggctgatggccttcagcgtcgggtcgatggaggcgatggagacctcgaaacgaacctgatcgttgcccttgccggtgcagccgtgggaaatggtgtcagcgccgaactggtgggcggcacggacgagatgcttggaaatcagcggacgggagatggcggagaccagcgggtacacgccttcgtacatggcgttggccttcagggccttcatgcagtattcgttggcgaattcatcacgggcatcgaccacgtaggcttcgaccgcaccgcatgccagcgcgcgctgcttgatggtttcgaggctttcgccgccctggccgacgtcgagggacacggccacaacatccttgccggtgcgttccttcagatacgaaatggcgacggaggtgtcaagaccaccggagtacgccaggacgagacgattctgatcgctcatggtttccctttctaacatccaacgttattcatcagtatatgcacagctctgtatatttatgcatatttggtgcgtcgtgtccactatatggctattcacgctttggaagcgacatcaagcagccattgcgcacgccgtttggcgacatcatcctcggagcagataaccatgaccgtgtcatctccggcgatggtgccaagcacgccttcgatgggctgcttatcgatgacgctggccacatattgcgcggcgccggatggcgtgtgcacgaccacgagattacgtgccgcggccacggatgtgaccagtccggacagtacccggctaatctgctgctcggttttggcgtccgggttagaagccggatgttcatcaatgttctgtttgccgacggcgtaggccacggttccgtcggcaagacgggtcttcgtggcgtgaatctcatcgagatcacggctcagcgtggcctgcgtcacctcgatgccctggtcggcgagaatctgcgacagttgcgattgcgaggtgacgatgcgcgtcagcagcgcctgctcaatggcgctcagtcgagcggttcgtgtggcaggacgctgcaacgcgggagtgtggtcagtcatcagaccagcaggctttcatcgccacgggccttgccggccaaccaggtcagcaacgccttctgggcgtgcagacggttgcctgcttcatcccaaaccacggactgaggaccatcgataacctcggcggtgacctccttgccgcgatatgcaggcaggcagtgctggaagatggcgtcgtccttggccttggccatgagttcggcgttcacctggtaatcccagaacggcttggaacggacagcgtattccgcttcctcgcccatggagacccacgtgtcggtgaagacgcaatcggctccggcaacagcctcattcggatcagtagtgacgaggatggagccgccggtctcagaggcaatcgcttcggcatcggcaacgatctgcggatccggcaggtatccgtacggtcctgccacacgcacgttcatgcccgccacagcgccgccgagcaggtaggagttggacatgttgttggccgcatcgccgagataggcgatggtctggttcttgaggttgtctacaccgccgcgatgttccgcgatggtctggaagtcagcaagaatctggcacggatggaattcgtcggtcagtgcgttcaccaccggatgggtggagtacttggccatttccgcaacacggtcctgaccaaaggtgcgccacaccacgccgtaggccatacggtcaagcacgcgagccgtgtcggccaccggttcgccacggcccagctgggagccggacttgtcaatgaccagcggatagccaccgagttcggccacgccaatggagaagctggagcgggtacgggtactgggcttgtcgaaaatcacggcgatgccctgcgggccagcgaacggctggtgatagaaacggttcttgtggaacttgatggccagttccagcacctgcttctgttcttcgtggttcagatcgtcatcgcgcagcatatggcgcagttcaggggttgccattggtatagaggctcctttcaaattcttcgggttcgtccgagatcagtcgttaggcaggtcggacggaatcttggcgaggatggacaccgcttgatcgacgtcctgagcagtgatgaccagcggcggggcgagacgcaacgcattcggagccactgcattgacgatgagaccgtgttccaaagcccagttcatggccgcatgcgagcaggggtgggcaagttcgatggcgtcgagcaggccacggccacgcacggagacgaatagcggattaccgcaggaggcgataccgtcgcgcagctgcttgccgcgttcttcggcgttgtccacgaggctgtcctcttcgatgactcccagcgttgccaatgccgccgaagcgcccaatggattgcctgcgaaagtggagccgtgggaacccggggtgaacagcgcggacagttcggcgccgaaggaaatcatgccgcccatcgggaaaccaccgccaacgcccttggcgaaagtgacgatgtccggggtcacaccgccggaaagatcctcacgctggaaggcgaaccatgctccggtgcgtccgatgccggtctgcacttcgtcgatgatgaggagcgccttatgttcgtcgcacagtttgcgggcggccttcacatagtccgctccgagcggcatcacaccggcctcgccctggataagctccatgatgacggccgcgaccggccctttgccgtacttgccctgaccggtttcggcgaaagcgtcgtgcaaggcttcgacgttgccggcctccacaaattcgatgttcggtaccagcggctcgaatttctcacggatggcgggcttccacgttgcggacagcgcgcccatggtacggccgtggaaaccgtgggtcatggagatgatgcgtgccggtttgccgccgatctcaggcgacgcgcccggcagggtgcgcccgtagagcttggcgagcttcagcgccgcctcgttaccttccgcgccggaattgccgaagtagacgcgggaaccttccggagcgcccgcgagcttgacgagtttggcggcgagcttgatctgcggttcggtggcgaagtagttgctcacatgcgcggccttggcggcctgctcgctgacggccttcacccacttcggatgggcgtatccgagtgcgttgacggcgatgcctgcaaggaaatcgagatattcattgccgtcgacatcccagatgtgggcgccctcaccgtggtccatcacgcgcaggggcgtgccaaacacgttcatatgcacctgggagtactctcccagccacttggcatcttcagtgccgagtgtttccagttgttcagttgccataggaactcctcatttcaataccgtcctcgggcacgaccatggtgccgatgccgtcggtggtgaagatctcgttcaggatggaatgcggtttgcgaccgtcgatgatatgggcccgcggaacacctccgtcgatggcgcgcacgcaggcttccatcttcggacgcatgccgctttccaggtcggggagcatatcgcgcagattctccacgccgatgcggccaatcagggagtcacggtccggccaatcggcatacagaccatcgacgtcggtcaacacgaccagcttgctggctccaagggccgcggcaagggcggccgcggcggagtcggcgttcacgttgagcacttcggtggcatcgtcttcattcggcgccacggaggagaccaccggaatacgtccggcgttgattagatcctccacggcggacgcgtcgacgctcaccacgtcgccgaccaagccgatatcggtgggtttgccgtcaatgaccggtttgcgctgcatggccgagaacagggcgccgtcctcgccggacagtccgaccgcgaatggaccgtgcgcgttgatcaggccaacgagttcacgggacaccttgcctgtcagcaccatgcggaccacatccatggcttccggagtggtgacacgcaatccgcccttgaattcggacttgatacccagggccttaagcatttgggagatctgcggaccgccaccgtgcaccacgaccgggtgcagtcccacctgacgcaggaacaccatgtcttcggcgaagcaggctttcagatgatcgtcgatcatcgcattgccgccatatttgatgacgatgcgttgtccggcgaattcctccagccacggcagcgcttcgataagcacctccgccttctggtcggcgcgcaggtcggtgtgcacgtcgaagtggaatccaggtcctttgagttctttggccattcctattcgatcagctttcgtagtcagcgttgatgtgtacgtattcgtgggtcagatcgtcggtccagacggtcgcttccgcttctccggcgttcaggtcgatgtcgatgtgcacctcgcgtggggtcatgtccacttcggagcggtcgcgtccggctccgccgttttcgcagatgcgtacgccgttgacgtccaccgtgaccttttcggaatcgtatggtgcgacgtcggacggcacggtgccgagggagctgacgatacggccccagttcggatcgttgccggagatggcgcatttgagcagattggacgctgcgaccgcgcggccgcatgccagagcggcttcttcggtggtcgcgccggtaactttgacacggatgtcatggcttgcgccttcgccgtcgccgatgatctggcgggcgagcgaggcggtggccttggccacgagctcgttgaactcgtccggttccggttcgatgccggacgcgccggaagccagcagcagcacggtgtcgttggtggacatgcagccgtccacgtcgatgcggttgaacgacatttcgactccggcgttcaaggcggcttgaagctgtccggcggtcacgacggcatcggtggtgatgacgcacagcatggtggccagctgcggggcgatcatgccggaacccttgaccatgccaccgatacggaagccgttggaaccttccagctcgacggttttcggcttggtgtcggtggtcatgatggcgtgcgacgcatcggctccggcttcggcggtatcggcaagggtttcaaatgccttgtccgcgccggacagcacgttgtcgagcggcagcaattcgccgatgagaccagtggaacatacggccacgtcttcggctttggcgccgatgaggccggcgaccttttcagcggtggccttggactgctcgtatcctggcttgccggtgcatgcgttggcgccgccggagttcagaatcacggccttcgcatggccgtcggatacgatgttcctcgaccactgcacaggagccgcgcagaaacggttcgaggtgaacacgccggcagcggcgtcaagcggtccattgttgaccacgagagccagatccttcttgccttcgaccgcggaaatgccagctgccacgccagctgcggaaaaaccttgtgcgaacgttacgctcacggtgccactccaatcttcgtcaatcctgcatcctcaggaagtcccaatgccacattcagcgattgcacggcctgtccggcggttcctcggttgaggttgtcgatggccgcgaatgccagcaggcggccggcatgatggtcgacgaccacttgaatgtgggccgcgttagaaccgatgatgttggcggtggccggcattacgccttcaggcagcaccaccatgaaatcctggccttcgtatgcgtccagccagacctggcggatctcggcatccgtcatgccaagcgctttgtcggtgagtttggcggaaacggtggcgagaatgccacgcgccatcggcgcgagaatcggcgtgaaggcgagggtgtaatcgtccgcctccgcagcactcttgccggccgcgtgcgcgaagttctgcaggatctccggaatgtggcggtgcgtaccgcctaccgaatacggcagtgcggagccgaacgcctcagccgcaagcagattggtgcgcttgaggttcttgccggcgccggaataaccgaccaccaaatcagccacgatgtctttcggttcgacaagaccctgcgcaatgcccggttgcaaagccagcgtggtcgcagtgacgttgcagcccggtcccgcaatgcgcttggtgccgggaagcgcttcacgctgacggctgtaggagccgtctgtctcgatgccggtgatgagttccggcatgccgtaggtccaatgctggtagaagtcaccgccgtagaacgcgtcccatgcgctcttctcctcaaggcggtgatcggcacccagatccaccaccactgcgttcggatcaagctgggaggccaatgctccggaagcgccgtgcggcaatgccaggatgattacgtcatggccgttgagcacttccggcgtggtgtcctcgaccacgaggtccgccaactgcggaatgtgcggcatatgcttgccaagcttgtcccccaccgaagaatgtccggcgacgcaggtcacttcgaaattcgggtgtgccgcgagtatgcgcagcgcctcaccacccgcgtatccagtcgcgccggccacggctaccgtgtatttggccatgtcacgtctcttttccttgactcgttgaaacacattcagcatacactttatgcactacattgcataattatgcagttcaatcgtgtcggatagtggtcaccgcccgtaacgggaccgttcagacgaacataaaaagattggtttcaggcggaaatcgagctggaatcaccactttggccactgccaccgaacatgtactgcatcatctggttatacaaatcggctgtggaaatgccgtgaaccgtcatccaaatcaccgcaatggtgtacagcacgttgataatcagcgctgccacgccaagcgcgtagcctttcatatgcagttttttggtacgccacatggcgatggcgcccatcaccgcagggatgaccggtaccggcaggaatagtgcgaacacgaacgagatgatcgcatagctatcccaatggccgtacagggggttctggctgggatcattcgggttgatgggatatatgccgggctgttggtatggattcggcccatactggtttggcccgtattgatttggtccatactgatagccattgggctggcctgattgctgccgtcccgatgcatcatatggattcgccggatacccgttctgcatatacggattcgtctgcggctgctgcgccgtttgttgtgcatcgtccgccggcttgggctgttcgggagccccatacatgtatggattgtagttcgccggatactggttggacatcgcgccatattcaggctggttgtactgtccgaattccggctgtgccgactggtccgacgacgaagacgacgaaaccggagcagccccggccgcctcctgcccttcgtcggggttgatcggctggttctgctccggttcgttcatgtcgtcctctttatctttttggttacttcgatggacttgacgtgtcaggcacgcagttgcgcgcccagcttcgcggccgcatccacgatgcgcttgcgaacggcttcgctgtcctcggaggtcagcgtcttgtcctcagcgcggaacgtgacggcgtatgcgagggacttcaatccctcacccagctggtcgccggtgtacacgtcgaacaggtcgatgctctccaagctgttgccggcggcttcgacgatggtcttctcgagttcggcggcggtgacgtccgtcgacacggtgaaggccagatcctgcttgaccggcgggaaggtggaaatcggcttggcctgcaccggcttgccgctcaaggtggcgaacagcgcggtcaggttcagttcgaacgcggcggaatgggccgggaagcccaacgcctcgttgacatgcgggtgaagctcgccgaccatgccgacgaacgtgtcacctgccatcacacgtgccgcacggcccggatgccactgcgcgggtacgtcctcagccttcggctggtccaacgtgagctttgcgccgatgcggtcggaaatacgctgcacggcttcaactgcgtcagaccagtccacggcacggcgatcgcccatccagccggagtcgacggcgttgccggtcagaatgccggcgacgtgcatcggctggtccggcaggcctgcgtcaagcgcggccaactgctcgtcggtcggcttgacggcacccggcaatgccggaatcgccggagcgttcggatcccacaggtagacgtgtccgatttcgtacagcgacacgttttccacgccacggcgcaggttacgctgcacggtctgcgcgagggtcgggatgatgtcgcgacgcaggaacgggcgatcgccggccagtgggttggcaatttcgacgctgaccttcttggtggcgtcggcgtcaagtgcgaagttcttgtagtcttcgtcgcccacgaacggatagctcagggtctccaccatgccgtattcggcgagttcgtcggccacctggcgcttgcgcagctgctcggcggtcagtccgaccttgccttcgaccggtgccggcggcacggtgaccggaatctcatcgtagccgaccagacgggccacttcctccaccagatcgcacggttcgttgaggtccggacgccagctcggcggagtcacggagaactcaccgttgccaccgccggccacagtgcagccgatatcggtgagaatgtcgctgatggtgttcacgtcagtgtccagtcccgccacgcgggccacttcggacgccttgaacagaatcggacgacgattgcagacggtgttgtaatcagtcgggtgctcgctcggctcgccgttgccgtacttgaccagaagctcggcggccatctgggcggcagccggctgcagctgatcatccacgccacgctcgaaacgacgggacgcttcggacggaatcttgtgacgacgtgcggaacgcgcgatcgacacctggtcgaaatgagcggattccagcaggatgttcttagtttcagcagtgacctcgccatacaggccacccatcacgccggctatgccaagcacacgggagccacgctcgccgttcggcgagtcggtgatcagcaggtcctcgacgctcagatcgtggtccttgccgtccaatgtggtgagcttctcaccttcgttggcgcggcgcacgacgatcggtccttcgatcttgtccagatcgtaggcgtgcatcggctggccgagatcaagcatcacgtaattggtgacgtccaccgccaaagagatggagcgcatgcccgcgcggattaggcggcggcgcatccagttcggcgtgtggctcgccgggtcgaaaccacgcacggcgcgcgcgtagtagcgatcgcagccgaccacaccgtgaatcggattcttgtcgtcgacgatcacttcgatgtcgctcttgacaccttccggcagaccctgagtgacgggcgccttcttgccgagggcggttgccggatcagtgtagacggcgccagtggaatggtggtattcgcgggccacgccacggtaggagaacgcgtagccgcgatccggggtgatgttgatttccagcagcggctggtccaggtgcagcagatgcatggcgtcatcgcccggctggagcttttcgtattcctccggggtgaagccgtacttgcgtagcaggatgatgccgtcgtggttatcacccagaccaagctcgcgctcggaggcgcacatgccgttggagatgtggccgtaggtcttgcgcggttcgatcttgaaatcgcctggcagcacggcgcccggcagggtcacgacaaccttctcgccggctgccatgttcggagctccgcagatgatgccgcgtggcaccttgttgccgttttcatcggtctcgttgtattcgtcgccgacgtccacgtggcaccagttgatgatcttgccgttcttctgcggttccggagtggcgtcgaccacatagccgacgacaatcgggccggtgacctgggaggtgtggatctcttcctcttcgaggccgaccttcaccagatccttggcaagctgttcgtacgtaaggccttccggaacctcgacatggtccttgagccaatcaatgtcaaccattggcatgggtcaatcactcccccatcacaaactgttcgctgaatcgcacgtcgccttccaccaggtcgtgcatgtcgttgatgtcgtggcgcagcagcagggtacgctccacgccgacgccgaaggcgaagccggtgtagacctcaggatcgaggcccgcagacttcagcacgttcgggttgaccatgccgcagccgccccattcaagccaaccggcgccgcccttcttatcggggaaccacaggtcgagctcggcgctcggctcggtgaacgggaagtagctcggacgcagacgggttttggcttccgggccgaacatggccacggcaagcttgtcgagcacgcccttcaaatcggccatggtcagatgcttgtccacggcgagggcctccacctgatggaacaccggggtgtgggtggcgtcaagttcgtcggtacggaacacacggcccgggcaggcgatgtacagcggcacgccacgggtgatgagtccacggacctgatcggacgaggtctgggtgcgcagcaccatgttggagccgacaaagcccgcggcgtccttggcctgattgcccttgacgtagaaggtgtcctgcatctggcgggccggatggtccggaccgaagttcagcgcgtcgaagtcataccattcggtttccacttccggaccgtcggaaatctgccagcccatggagataaagaagtcctcgacatcctccatcagcttcggcagcggatggcgggcgccaagcggcttgcggttgaccggcaaggtcatatccacggtttcggcagcaagctcgcgggcctcttcttcggccttgacttgcttttccttggtgccgaacgcacgaccgaagtcggcgcgaagcttgcccatgagcttaccggcgtctttcttctggtccttcggcaacgcgccgatggccttgctggcctgcgtcatcgcggattccgctccggcgtactgcgtcttgatggctttcaattcctccattgtggaggcgttttcgattttcgcgatgccctcggcaaccgcatcggttaccgcttgggcgtcgaataccgcaccctctgccacgagatacctttcttatcaaccgtttgttttacgcataaaacgcgcaattccaacgtttttacgacttcacattctttcaacatgactcgacatagccaagctcagcagcatcaccgccgcactggtgccgagattgagcgattccgccttgccgtagatgggaatcgacacgattctgtcgacgcgttccaacacatcctgggtcagcccgcgcgcctcgttgccgaacagcaccgtcttggcttgcgcaagtgattgcggtacggcaagcacgtccgtaagcggttccggcggccgtgcatcggtaccatacacgtcggcggcgtacacggcgagtccacgttccgcacaccaatcgaaatactcgtccgtacccatggagacgaccggcagatggaacagcgagccagcagtggaacgaatcaccttcgggttgaagatgtccacgcagtcgtccaccagcaccacgcccgcgcaaccggccgcatccgcggaacgaatcacggtgccggcgttgcccggatcgcgcacctgccagaacgcggcgaccatcgtgcgttcgtcgaaatcgccatcaatgacggcggaatcgaggaaagcgcgcatgtcggcgacggcgagcactccctgcgcgtcggagctcatgtgctgcatgacggcatgcgtcaccttatgcacgtaagcaccggcctgcatggccttgccggccatctgcgccacggtaggcgtgatgaaagccgcgtccggctcggcagagacgacctccacatacagatcctcgacgatgtcgggatgccaggagagcagttcacgtaccgactgcggtccttccaccatgaacctgccggaccgcttgcggcctttcctgtcggcaagttcggagaccctgcggacgcgttcggcccttgggtttgcaatgacttcggatttcataggcatacgcgttagcctaacaccttcgaagcggttggcgacgcggccatgtcatgtttcgaggcgtccagaaaacatccagccacatcccagcgcgaacaaagcgtctttctgttgtatgccaagatacaacttttaccatcagcataaacgccgatcgcgagcggcgcggaaccatcaatcgctcatatctatcgaaacacataaggaaacagccatgttcgtcgtcaaaaacgcatggaaaagcgtcacccgcaacaagggacgcaatatgctcatcatcgtcatcgtgaccatcatcgccgctgccgccacaatcggcctatccatccggcaggcggccgccaccgcaagaagcagcggattagataacaccaccgtcaccgcgcagatcagccttgatcgcggcaaactcatttccgaatcgcgcgagcagtccaagtcggattccgattcgtccgatgcttccgccaaacctgacttcgacgccatgcgttccgctttggccgacaagcagttttcgcttgccgactatcagaagtacgcgaaggcttcatccgcggtgaaatccacatattatatggagaccacggggttggcggcgaccgacgatttccagccggtcaccgattcgtccggttcggattcctccagctcgtccggctcgtccaatatgaaggattcgtctgataccgccggtacggataacggcaaccgtcaggatgaacagcccggcgtccccgacggacaaatgggcgacgtcgcgggcagcaaagacggcgcgggcatggtcagcggcgatttctccctaatcggcttctccagcgacgaggccatcgccaacgcctccaatggcagcttcaccatggtgaagggcaaggtgttcggctatgacgcgagcagtgatggcgatgccatcatctccaaatcgctcgccgaccgttcctgacaatccaatcgcacgttttttctggaaaggacctcccatgacaacgaattccgcggataccgccaatacggcaatcgcaaaagaagccgtcgagaccaacggcgcacaatcgcagcagaccggcccgcctacgctgcagctggataacgtcagttatgcctacaccaaaggcggcaaacgcgtgctgaaaaacatcagccacgatttccaagccggcaaagtgcatgccatcaccggaccgtccggagcaggcaaaaccacgctgctatcactgatctcgggactggcgaatcccacggaagggatggtgctggtcgacggcaccgacctgtcggaacgagaccgataccgttttcgcagccatgacagcggcgtgatcttccaaagcttcaacctgctgccgaaccttacggtggcggagaacatcatcctgtcgatggacgcgtccggcaaatcgttcgacaagccgaagaaagcaatcgtcgaagaattgctcaaacaggtgcatctgccgaaggaatacgcgaacgagcggattctgcacctgtccggcggcgaacagcagcgtgtggcgatcgcccgcgcgctaagctacggcccttccatcatcgtcgctgacgagccgaccggcaatctcgacctggccacccaggacgacatcatgggtatttcccgaacgttggcgcatgatgggcatcgttgcgtcatcatcgtcacgcacagtccggaagtggcgaagacgtccgacgaggtgttcgagctggctcccatcaggcgtcgcagataagcgtcggcagcttctcgaaaagaaatacggcatgcgtccccatgcaacggacacgcatgccgtattttttcctgtttcggttggacggtggcgttatgattgggcgcgtcgaagtacaggggtgccgaatacggctgagacgggcgaccgcccggacccttgacctgatcaaggtaatgcttgcgtaggaacagtaccggcaaaacgcgtcgcgtcccgtagagacgatctccgttgtatttcggcttgtgcacatacccaatggaagtcgagaagggacaccatggccaacgaaaagccatcgacacagacgcagccgcacggcgatgccgcaaccagaaagaaaaccgaaacgagcgtggcggaagccggttcgtcagccgaaaagaaggtcacgccgaagaacgccctgctgggattgcagcatgtgctcgtatcaaacgtgtggcttgatccggtgttcgtggcgggcgccatcggtctgccgttggcattgtcgtcgaacatggtgaacgccattttcatcgtctccggcctggtcacgcttatccaggccacgaaactggtgcgcctgcccatcgttcagggtccttccgcggcgttcgacgcgctgatgatcgccgccggcaccgccggatcacttgccgcggccggcacgtccatcttcatcagctcgctgattttcctggtgctgtgcctgacgcgtgtgatcgagaagctgcggttcctgttcgccccgatcgtatcgggcgtgatcatcttcctcgtcggcgtctccctgtcgggattcacattgagcgagttccttggcggcgcgccgggagacaagggctccgccgatccgaagacgctggccgtctccatcatcacctgcgtgctggtggtggtgctttcccagttcggcaagggcatggtgaaggcgctgtcgtatctgatcgcactggtcgtgggcaccgcgctgtctctggcgttcggcatggccgacttctccgcggtggcctccaagccgtggctcggcctgcccaagttcatgccgtatggcggtttcgatttcaacgcggcgattttcgtaccgttcttcatcgcctatctggtggccatcatggaagccctcggcgtgtatcaggcggccacggagatccaaggcacgaagctccaggaccgccaggtgcgttacggtcttgccggagaggccgccggttcggcgatctcctcgctgatcggcggtttcaccaccaccgcgtatccgcagaacgtggcgctgctcaaagtcaccgacgaaggcaagacccgcacccgcgtgccggtgatcattgccggcgtggtgttcgtggtgcttggtttcattccgaaggcgggcgcagtgctgtcgctcatcccatctcccgtgatcggcgccatcttcctgccggccgccgcaagcctcatcagcaccggcttcaacacgctgcgcaaggtggaaagcgacgaccgcacccaagtggtgatcggcctttccctgctgcttggcatcgccctgccgaacgcgttgagtggtcttgaaggaggagcgcacgtgttcttctcgaattcgattctggtcggcgcgttcagcgtcgtgattctcaaggccctcatcatcgacctgccgaactttatcgcacaacacgcagacgagcggacgaaacaagcggaataatcgaaagcatccgaataatccgacaaccatacgacggaaaggacatggcatgagcatggggcaatcgcaggaatccacgaacatcgacgagacgaaggaaaccatcaaacgggaggtgctcgacttcatcgcacaatacggctgcggcaaggcgcccgatgaggcgttcgacacgctggcgaagcatatcttcgcctttcaattcgagcacaacctcccataccgcgcctactgcatgtccaaacgcgtgacgccgcagacgctcgccaactggatgcagattccccccatgccggtggacggcttcaaaatgctgacgctcacctccgtgcccgaacaggattgcgaagcggtgttcaccaccagcggtaccacgcatcccggtcaacgcgggcgcaacttccaccccgacctgcaagtgtgggacgagtcgatgatcgtgccgttcaggcatttcatcatgcccgaccgcgagcgcatccgcatcgcagtcctctcccccgcatgggacatgaacgagcattcgtcgctgtcccgatatctgacccgcgccgtggagcagtgcggcgccgaaggcagcggcttcttcttccatgaggatggccttgatttcacaggtgtcgagcgcttcctcgacgaggccgcgaccgacggcgaaccggtgatgcttatgggcgcctcctccgcctacctgtatctgctggattatctggacaagcagggcaagacctacgctctggccgccgattcccgcgtgttcgatacgggcggtttcaaaagcacgcgcaccgacatgacggtcgacgacctgtatgcggcgttcgaacgagtgttcggcgtgaagcgctcgcattgcgtgaacatgtatggcatgacggagttgagttcgcagatctacgatcagaacatcctgtcctattacacggatggttcgtcgaattatctcaaagccacgccgtcgtgggtgcgttcggtgttcctcgatccggcttcgcttacgccggtcgccgatggcgagcagggtgtgatcgcgcattacgatctggcgaattggaattcgtgcctggctattctgacggaggatctgggtgtgcgcaccgaacatggctatgtgctgaacggtcgtgcgaaaggcgccgaggcgcgtggctgttcgatcaccgtcgacgaggtgatggcggccaacgcatgagcgacgtcgacattttccacgcgccgcgggatttcgagttccatgatttcgacacacgcaacgtcacggcgtccgatggcggcacggcgacgttgtgtttcccccgtctcgacgccgatgccgtgcatgcgctggcggcgtcggtgcggcggcatcgcgccgagaaactggcgcggtattccacggacgggatcgtcgacgtgatcgcgcgcgccgtagaattgtggacggatccggaatatccggaacgtcggcttgcggagcggctcattcccgcggtcaccggctatgacgcgtccatggtgcgtatcgaattgaagcggtacatgcgcatgttccgtcggcgtgagctgctgcgtttcgtggatgacgagttgaattgcccgcagatgcttgacgagtatcgcccgaaccgttcgggcggatacacgcggctgtacggtccggaattgtcgttccacgtgttttccagcaatgtgccgggcattcccgtgtggagcatgacgatgggtctgctgacgaaaagcgcgattctcggcaaatcgtcgttcgacgagccgctgatgccggtgctgttcgcccgttccctggcaagcgtcgaccccgatatggcggacgctttggcgattgtgccttggcgtggcggcaccgtggatttggaggatgccgcgattggcgaggcggatgcggtggtcgcgtacggttcgtcgcacaccaccgaggcgattcgcccgcgcgtacgtgccggaaagcctttcctcagctacggcgcgaaaatcggcttctcgctgatcggccgcgaggcgcttcgcgccgacctgtatgccggcaccgtgcatcgtatggcgatcgacgtggccacatacgaccagcaaagctgtctggcgccgcaaaccatgttcgtggaacgtggcggcgcgatgtctccggcgcaggtcgccgaactgcttgccagcgaattggacgggcagcagcgcaaatatccccgttccacaccgtccgaagaggagtccatggcgattcagcggttgcgttccaccgcgcagatgaaagcgctgatgctgggcgccggcccgatggccgccgcggccggcaacgcggatgatgcgccgtccgacgacccgttcgtggtgcagtcgcgttcgggcaccgactggacggtgctgtactatccgtccatcggcatggccgactcgctgtccacaccactgaaccgcaccgtcaacatcgtggcggtggaccatgtcgaggacgcgctgcccacgctgcgcccttacgcgcaatggttgcagacctgcggtgtggcgctcgctccggaccggctgttcgacgtggcgcaacgcgtcggcgagaccggcatcgaccgcatctgcccggtaggcgagatgaatcgcgcgaaatccggctggcatcacgacggcggcttcaatctgcttgatctggtgcatgccgtcgatatcgaacgtaacaccgatatgtactgtgatggtttcgatatggatgtcgaataatcacattcaagcaatcccacgaaatacgtatacccaaaaacgaaaggaatttccatgcagcagtccgattctctgccgttgaagggacgtgtcgcattggtgactggcgcgagccgcggcatcggcgcggcgatcgcgttacgtctggttcgcgccggcgcatgcgtggctattaactacgtcagcgatgacgagcgtgcgaagcggtgtgcgcaacgcattatggacgattgtgaggcggccggtcgtgtgatcacctgcaaggccgatgtcaccgacgccggacaggtgcacgacatggtatccacggtggtcgcaacgttcggcggattggacattctcgtcaataacgcattcgcccgttattcgttcgacccacgcaatcgcaagaccttcggtaccatcggatggtccgattacgcggcacagctagaaggatgcctcaaaggcgcatacaacacctgcgaagcagcgctgccgcagatgaggcgtcagaccggaggacgcgttatcaacatctctagtaacctcgtcgactccccgattgtgccgtatcatgactacaccgctgcgaaaggtgcgttggtaggtttcaccagatcattggcgcaggaggctggggcatggggcgtgaccgtgaacgccatcgcggccgggctcaccgttggcaccgaatcgagccgtgccaccaccgaggatgtacgcgagcgtatcatcgcatccaccccgttgggcagactcgccaccgccgatgatatcgccggagccgtggctatgctggccagcgatgacgcatcattcatcactggccagacactgcacgtcgacgggggcttggtgatgcgttaaagcgtggttttgactttggtttgtggcgccagcatattcgtcggcaaagaaggatggttatgaatatcaccgtgtatctcggtgcgcatgagggaaacgatcccatatacaagaaagccgttgaggaattgggcatatggattgcggacaatggcaacaggctggtgtatggcggctccgatgaaggattgatggccgtgatcgccgacaccgtactcgcccatgacggcgacgtgaccggtatcgaggcgcagatgtttgtggacagaggcgttgcacaccataacctaacccaactggttgtcgtgccgaatatcgtggaacgccggacccgcatgattgagcttggcgacgtgttcatcgctttccctggcggcacgggaacgttggaggaaatcagtgaggtggtgtcgaaaatttgtcttgaccaactgacccaaccctgcatcttctataatctcaacggcttttatgatgatatgaaggcattcctacagcacatgatcgatgcgggcttctccaccgcagaacgtcagcatggtatctatttcgcgtctaatctgaccgaaatcgaacgcgtcattgcagcgcataacgcataggaatcggcaaacgtcagaccaccggcagaacagcgtgcagaatcgtcatgaacgtcagcccgataacggccgtgacggtcaacgagaagcctgcgagtttggcgttaccggtcagcgaatcagtgaattttgtggagaaaatcgttaccggtgcgaatgcggccagtaccatgatttctcggacacgttcatccaacggcaacaggaaccatgcggacaatgcgatgatgatgctgaacaggaatcgccatgcgataactttgcctagttccgaacgatccttatgactgtcagggatctccatcatcaggccgatcatggccattgctgcgaaagcgttggcgttggcgaacggagtgatgagcgtgacgatccaatgcggcacactccatccggcgaacatgatcaccagcatgagcatatagcagtcgaacgaaatggacgagtagaaatcgtgcgcgatattcttgatcttcaggctcaatggcaggtttttggtggggcttcccaagtgcagcagcgagcgggtaatggtcagggatgcggcagtggcgatgatggcgttgcctatatcgagcataatgaccggcagacctgcgctcggtcccatgaaggtctgcaccaccggcagacaaaacgcgccgatattcaatcccgacgcgttgagcatttgataggcacggtagcgtggctcgtcgccacgtgagccgaaatacacgacgaacagcggaataaggcaggcgaacaagccgaacacgaccagccacaacaggttcatcggatgcttattcgtagcgaaactcatgatgatggcgcatggcagggtgaggttgaacaccagcccctgcaccactttgtaggatttgtcagagaagatatggatgcgcttaagtagatagacgctgatgatgacgagcagcaatgacccagcttggaacaacatacggccgagtataggagcatcgccgacgcatcatggaaccacccgacacaatgtgaccgtacgacgcacaaagatacttgcatgtccatgccgcacgcctcgaactaaacgactagcttaaagctttaccggagaatcccgaataaacgccgcgagataacgtatgactcccacacgaaccgtgacggttcgtatgggagtcatacgttcaaagccaccgcataagtgacctataagtggcctaagctattctgtcgaaataaaaacgtagtcggcagtaggactcaagggcgatgcggccgaccaccgtgccgcggcggcacggtggtcggaaccggatgacgtacgctagttactctcggagtccggaaacacgtcccgcgttcctgaactccgagacgaatgtctcctccgtgataatttcggtgaccagtgcggaaatcagtttgtacaacgtgttctccgcaggatccgcgtcatcgtcgatggccagattgattccctccttgtccaggagggcgagggataccgacatcgcggtgcgcttgttgccatccgcgaacgagtggtcctttgcaagatggaagacgaaatgcgccacctgtccgaacagatcgggaagtagccccgacctccaacgcacttcgttggaaaaccgccgtttttggctattttccaacgaaatcggctcgtttcgaggatgaaaccggaagccgttttcctgctatatccggctatctccggcagacgtaagtacaccaataagtacacctggcggatggccgcatagcgaaacggcatggacgaaacggaacacatgccgagatacacgctgacgttggtcgactcgaccggcgccatggaaccgctgatactcatggacgacgacctgaagtcaatcgccgcgaagctggaagggagggtgtcggccaagacgcgcgggcgccggccacgcggcaccggcggcatatcggccacgccgaagggctacagggcgtactcgacggtgaccgacccgctgacgggcaaggaccaccgtgtgtccggcttcggacgcacacgctcgcaggccgaggcgcgactcaaggagaagctggccgagttcgaccgcacccaccgcgtcggctacgtcaggccgcccaccgtggccgaatggatggaccactggctgacggacgtgtgcaagccgcgcctcaagccccgcacctggggcacgtacgcgtccgtcatcgcgaacaacatcgtcccctccatcggcgccgtcaggctcgacgagctcaagcccgcgcacttccgccgcatggaacgctacgtcatggacgagcagggcaaaagctccggcaccgcgggcagcgcgtggcgcaccctgcacaaggctctggaggacgccgtattggagggcgtcatcgaacgcaaccccgccgtcaagggcaccgcgccccgcgtggcgttgaaggaacgcgccgccctgacgcccgaacaggccgccgacctcatcgccgcggagaccgacgacacctggcggctcatgtggatgctggccttcatgaccggcatgcgccagggcgaacggctgggcctgaccgaagacgaactcaggcgcgacggcgaccggctcatcatcctggtcgaatggcaggcccagcacttgacgaaacgcgaggtcgagggactgcccaagggcgtcgaatgcacgccgctcggcaacggcatgtaccgcacgcgccccaagaccgagaagggccgccgcgccataccattgcccgaggccctcgccgaccagctgctcgcctacatcgaacgccacggcgtgaacggcgacgggctcgtgttccacgacgaccggggactgcccctgaccggctgcgtggaacgcaggcgctggtaccgggccctggaccgcgtcggcctgggccacgagtacgtgccccactccgcccgccacaccaccgcgaccatcctgaaccggctcggactggacgacgtgacccgcaccgccatcatgggccacagcagggtcagcacgacgaacgagatctacacgcacgtcgagctcgaccggctcgtcgccgccaccgacggcgtggagagggccatcgagggctaggcgcgaaaagacccgcggcctattcggcaaggccgtgggccatgggcgcggaatggcatggggactttcatgatcttccgtcgcgcgccgaccaaccggggatgacgccggatgcgggtctcagacgagccgcagctccttgcctccgggcagggaggcggtgacgtgcaatgttccgccgatgccttcgagatagcgtttcagcgtgtccaccttgatatggtccacgtcgcccgactcgatgacgcttatcctcttctggctgacccccagggcctgcgccaatcgcttctgggtgacgtgttcggccttgcgggcctccttgagctcgtagagccggatctcctccaacatgcgccgtttctcggcctcgacctcgtcgcgggtgatgccgctgtcggccatgaaccgctccggtgtgtagctcatcggtccgtctcctttccgtaccgctcctccagccatacgagatagcgccgttcggcttcaggtatggccttccgataccatttgtcccatttccgctgcttgtctccgcccaccaacatgatcgccttccgcttcggatcgaacacgaacagtatgcgtatctcgcttctaccggaagatccgggcctgagctccttcatcgaggggatgaggctcgacccttttatcttgccgactatcggacgtttgaggtcaggcccctgctcctccaacaatgacacggcggcgagtatctgcacccgcgatttatggtcgagcgtgttcagccaatcggctatgggttccaattcaactttccacacacccgcaaatataccatataaggtatgtccccgcaaatcggcgaaacagcaagggcataccgcaaaaaacacgcgagaacacatcgccaaaggcgacgccccacgcccgaggccacatggcatccggcaccggccccgcggacgacaaggcatgacggcatcacgggcgaacgcatgggagaaaagaccgaaacaacgctagagtggacggcatgggagacttcgcaatgttcggccgcgcgatggcggaccgccatggcgtcggcatcatcgtcagcatcgactaccacggcgcctcctacggcatacagacgccgcgactgctctgcaagcacctgaccgccgccgaggtccaccccgtacccgcgggactgacactggcccaccggctcggcccggacgccacgcccgcgcgccggttcgccgcgacggccgtggacgacggcgcgttccaacgcctgttcgaggcgtacaaacccgactccgacgcgccggaccatctcctccaccggcagacgcggtacgcgttcgcccaagccgccgaaacgctcaactggcggggcatggccgacgccatggccacgcttccccgcgtcacgtccctgtcgccgtccgccacgctctacgactgggccatggatgtgatgtcggccgcatgcgacggcacggcgatgccggaacggccgcacggcttggacgccgaacgcgcacgcgccgagaggcggtcgaaggccatcatgccgaccacattcgcggcgctctgcgaacgcgagcggttggcggcgttcgcggacgtgtgccgccagtggcgggttctaggccaagtcgtcgaggctccggcggatggacgccaccaccgggtcggacaatgcggtgccgacgcccggcacgcttcgcaacgatccgatcctggcgagccgcatgcgcgcgtcggccgtctccacggcggacaacggcctgtggaatccgcgctcccattgtccggcgaacatgtccggatcggcgccgtcgtacaggacgccgccgtcgcggtcgatcacggtgagcctgtcgaccagcagcgacgcggcgacggcgcggaccgtggcgggcaggttcgccaccgcgttgtcatgcgcctccgcgggcgtccaacgcgccggcaatccgaccgaacggtcccggtagtagcgttccagcatcgccagccgcgacaggaccggcggcacggccagcgcggccccatacgcgagacgtccagcgtccagcatgaattgaacgggaacgtggaacggagccaaacgccctcctgcgtgcgaagccagtcgacgggaccggcctcgcggtagaagcccgggttggaagagatatacggtctggttggttttctttcgatgccgtcgtccatgccggcctccatgcgttccagaagactttcccgtcgatggcgcccggtcccgcgacgcatagccacatggcatgacagattcgaggaaaccatccacggccggccccaaggagaaaccctacgtgcccatcgagcaccgcccgctattgggcgtgtccgaagcggccgccctgaccggactggggacgagaagatcgtccgccaggccatacgccaaggcgagctcatcgcctgctacgcccattcgtcgaccaaacgcatccgccggcgtgacctcgacgactggatctcatccctgcccgaacggccccaatagacgggcccgacggatacgacacggcccccgcatggctccttcgagtcgtgcgggggtcgtgtcttttccggacgtaagtacaccttaagtacacctagtacctatactgaaccctgaaacgtagtcggcagtagggctcaggggttccgactatcagatgtggaagtacagctcgtactccagcggggtcggggccagacgagcctggtcgatctcgccgcgcttgatgctgatccaggtgtcaatcaggtcgtcggtgaagacgtcgcctgcggtgaggaagtcgtgatcttcctcaagggcgtccatggcctcagccagggagctcggaacctgcttgatgccagcgtgctcttccggcggcagctcgtacaggtccttgtcgaccggtgccggaggttcgatgtggttcaggatgccgtccaggcctgccatcagctgtgcggagaaggcgaggaacgggttgcaggacggatccggagcgcggaactcgatacgcttcgcagccggggaggtgccggccagcggaatacggatggcggcggagcggttacgagcggagtacaccaggttgaccggagcctcgaagcccgggaccagacggtggtaggagttcagagacgggttggtgaaggcgagcacagaggaagagtgcttgatcaggccgccgatgtaccagcgggcgaggtcggacagaccgccgtagttcttctcatcgtagaacagcggcttgccgtccttccacagggactggtggcagtgcatgccggtaccgttgtcgcctgcgatcggcttcggcatgaaggtggcggccttgccagcgagggcagcggtctcgtggacgacgtacttgtacttcatcaggtcatcgcctgcgtgctgcagggagttgaagcggtagttgatctcctgctggccagcgcctgccacctcgtggtgggaacgctcgagaatcaggccgaccttctgcaggttggcgaccatgtcgtcgcgcaggtcctgggtgtggtcaatcggcggaaccgggaagtagcccttcttgacgcggttcttgaaggcgatgttcggggtgccgtcatcttcggtgtcaatgccggagttccacggagcctcgatggagtccacctcgtagaaggagcgctgcatgctgttctcgaaacgtaccttgtcgaagatgaagaactcggcttccggagcgaaggaagcggtatcggcgatgccggtggacttcaggtaagcctcggccttgccggcaacctgacgcgggtcgcgggagtacggctcgtcggtcagcgggtcgacgatggagaatgccacgtcgagggtcttgtgcttgcggaacggatcgatgaatgcggtggaaacgtccggcaccagcttcatatcggactcgttgatggcctggaagccttccacggaggagccatcgaacggcatgccgtcggtgaaggcgtccttcaggaattcgcttgccggcacggtgaagtgctgctgaacaccgatcagatcggtgaagcgaacggagacatactcaatgccttccttgttgataagggcctcagcatcagccttggtttcaagtgcagtcacgggaccgctcctttcgaataagttacttacaggctattagtctatggtcgcgagtttcgctcactcgccatttgggttacgagaatgtttcgtaatgacatattcgaggtgtgatttcgcggaaaatcacgattcgattgttacgaacagccacgtccgccccttcagaagcgttcatttaatggacaggcagcatgaaaaaggtcccgatcgtatgaatacgttcggaaccttccgtgacatcatgcgggtgctatgaccgtcagcggccgcgcatggcgcgacggctgacgcgctgcggatgcatcgggtcgacgcccttcggcacgctcatgccgttcttcagctgcagagtgcgcagacgctcgttgagcaccgtgagctcggtcttggtgagcacgaaacgagtcctcggatggatggcggccatcagcttgttcttgtgatgggtcggctggtagctcttgaacttgagcagcgtcttgcgcacgtccttgaggcgggtctggtttgcgccggtgccgacgtacatacggtagaccgggatttcggagccggcggtcacgcccttgatgcgctgctcctgacgatccatggctcgcttgacgcgattgtaatcgccttcgcccagcagatagatgccgttgtaaccggtaccgcgccagatggcgtccttggtcttcgggtcaatccacaccggttcctgggggaagttgaagccggccttgctgatgttgccgagcacgcttactgcggcaccgggacgaccttcgatcttggcgtagccgaccttgtcggcacgcttggtgagcatcatggtggcgaacagcacgcccagcatgacggcaagaatcatgaacaggatccagctgaacacatgccacttgaatatgacgcccagtacgacgaacacgacaatcggtgccacgaacacgccaccgcacagccacggaagcgccttatcctcagcttgggtgtatttgaagatctggatgatctggctgatggtgccttgcttcttctgcttctttttctctgctttatctgccatcgacttcctcgcttgacggttcggttacacacactgggacgatagtttatcaggaaccatgccatttatggtgcgactgcgctattctactccgcctatctcgtatgcagcgggcgtccgtccgctttcagcaacgcctcaccgagcgtctcgctgaacgtgggatgcgggtggatgagccgtgccgcatcggcaagcgggacacggttgccgaccaactgttcggcttccgctatcaaatcactggcgattgggctgacgatgtgcacgcccaacaccacctgcatatcaggattgttcgcaaacgcaccgctgacgacggtcatcgatccgccttccccgctcatcagcatgcgcgcgttggacagcatcgggtatgccgtctccttcggctcgaccacgtcttcgcgcgcttttgcctggtcgagcgtcaatccgacgcttgctgcttcggggaaagagaacaccacctgtggcacggtgtcgtcaagcacgggttttggatcggctccggcgattttctcagcgatggtgatgccttgttcaaaggcgcggtgggccagcgcatgacctggagtgatgtctcccagcgcccacacgccatcaaggttcgtccgtccgtatccgtcgacggtcacgtatcctcgttcgtcgagcttcaggccgctggagcggaaccagtcggcgtcggtattgggcacacgtccgatggcggcaagcaccacttcgccgtaagcggtgcggtcctcatcggaatcgccctgccgatagtgcacagtggcccctaggttcgcgccagtgtcgacacggtccaccgcggtgcgtgcgatcacgttcactcccctgcgtttcagctcacgtgtcagcgtcatcgaagcacggcgttcccatgtggacagcacgcggtccttacgaatcagcagtgtcacttcgcaaccggcggcattccacagcgacgcgaattccaatgccaccgcacccgcaccgataatcaccgcgctggagggcaaggtattcagctccaacgcctgggtggaatcgatcagcgcgccggcgaacggatttccaggcaacgcaagcggacgcgatccggttgccaacacgacgtcgtcggcatcaatcgcaagttccgtttcaaccggttcgaacacgccggcttccacggaccgcgatacctgcgtctccccctcagccggcgtgacacgtactgtatgcgcgttctgcaatgccgcgcaaccgcggaatacggtgacgccgcgatgcgccagcaggcccgtcagccctttcgtcatcgtttccacggtggagacgcggaaatcacgtaatctgccgaaatcgatgctctgcagcgtggcgttgatgcccatgcgttcggcgttatggatggtttcgacgctatgcacggcagtcaacaatgccttcgatgggatgcatccgcggttgaggcatgtgccaccgagcgtaccgtcacgttcgatcaacgccaccgatttgccgagttccgcggcacgcagtgccgtagagtaaccgccggggccggctccgatgatagcgatgtcgaaatgctgttgaaccatattgaatcccaattcgttcctcattgattcgtttgcacgcacgtgaagtgagcttttgttcgatgcgagcaatcgttttccatggtaatggaaaagccgtcagttgttcgctgacggcttgaaaaatcaccggcggttctcgataccgatcactccggccagtgtccacgcttcgggtaacgaggcttcggaagcctccaacggcgaatctggagggcacggctccacgcataggaaccggaacgcatgcccttggccacggactgctcaccgaatttctcgatgagcttcttcttgagcttgtgccacatgaccgccacgtcgataatcacggcgaacaagtagacatacatgatcagcatgagcggcaacgccaatgcaggccacttgtaggtgacgaccatggatccgatcaggattatgaacgcgaccgggatgaagaactcgcccagattgaagcgggcatcgacgtagtcacggatgtagatgcgccacggcagacgttccgacttcggcatgtggttgatgtcgcctctctgcatggcatcgtactcggcgttctcacgctcacgcatacgagccttggcggctttacggcttgcctcgcgatccttggggaccagcggacggagattctgcgcctgggcgtccttgcgcttcggggttggacggcccttgccggaggtcggctgtgcagccttgctctcgacgttctcctgcgccggttcttccttcttggtaaacaaactcatgcctatagagcgtaaggtgacgtatcgacgctcgatgccgcccgcggtgccgtctgcgttgcggttcaagctgcgattcaagctgcggtcggacggtctgcaaagaacagatacaatggacattcgtcacacgatattcaatccgcgtaatacacacgcatatatagggagcatcaaggattatgacagctttaggagccgaagagatccgcacgcgcgtcgagtcggatttcaaccgcatcgtcgacgtgttgaaccagaagatcgccttgcagtcgatttccgcgaaaggcatcaccgccgatcatatgaagcgttccgcgcaattcgtggcggacctgctgcgcgaggtcggcgtcgatacgaaggtggtgcagtcgcacaaccctgacggcacgccgggcgcttgggaggtcatcggttccaaaaacgtcagcgaggatgcgccgacggtgctgctgtacgcgcaccatgacgtgcagccggtgccggatccgagcgtatggaacaccgacccgttcgtcggcactgaaatcgacacgcgtctgtacggccgcggagccgcggacgacggcggtggaatcgccattcattccggtgcgctgaaagcgcttgaagacgatctgaaggtgaacatcaaggtgttcatcgaaggtgaggaggagatgggttctccgagcttcattccgttcatcgaagagcaccgggacgagttcgcttccgatgtgatcattgtggccgattcgggcaactggtccgctgagattccgtcgctgaccacgtcgctgcgtggcaacaccgatattgatgtgcatgtcaaggcgttggaacatccggtgcattccggccagtatggcggcccgattcttgacgcgaacacgctggctgcgatgttgatttcctccatgtacgacgccaatggcgatttggccgtgccgggcgttgcgtccgaggaaccggttggcggcctgcagcgtgatatggacgaggcgactgtgcgtgccgacgcgggcatcgtcgaatcgtatcgtcttgccggcaccggttcgctcgccgcgcgtctgtggacgaagcccagcgtcaccgtcatcgggttcgacgcgcatccggtggaaggatccttcaacgtcatctctcctgaaaccacgttccgtctgagcttgcgcaccgcgccgaaccagcgcccggaagaggcccaggaggcgttggccaagttcatggtggagcatgcgccgttcggtgccgaagtgtgggtcgacaagctcgacaacggcatgggctgggccatggatccgaacgctgaggccaccaaggacgccatggacgccatggaggaagcgttcggtgtggctccggtcaacaagggcgagggtggctccatcccgttcattccggaattgcagcgcatcttcccgaaggcgcaggtgctggtcaccggtccggaggatccgaaggccaacgcgcatagcccgaacgagtccatcagtctgccggcgttgaagaacaacgtcatcaccgaagcgttgctgctggataagctcgccaagtaagaagccgtgtaaggcttgccgaaataggataaagctctctgtcatacgattccgattggaacgtatgacagagagctttttcatttagctgccgattggggaatcatcatccattagttggacacgttgctgaacgcccaatgccagtagccggtgtagtatgcggtggccaacgcgattgccggcaccgcgatgcagatggcgtagaacagccagtcgaccgcatgcagtttcgattcacgcgcttggcttcgtggcgcgtcggatccgaatccgcgcgcttccatggcggtggcgagtttcgttccacgtcggatggatacgacgagcaggctgaatgcttgcgagaagacgcgtttgatggtgctgccgtcgccgaggccacgcgagcggcgtgactggccgagtgcacgccaatcgtcctgcagcagcgtgaacatgcgcatgccggcaaggccgccgtatacgaaacgttgcggcaggcgcagaatctgcacgagtccgtcggccagatcggtcgggtcgagtcccaaagccagaatcacacccggcacggcgattgcggcgacacgtaggaatgtggccaacgccagatagagcgatccttgggagatgacgatgatgccgcccagattggccagcaccgtgccggatgtcttgccgtacaacgccacggaaacgaagctgcctgtggccgctatccataccggccatgtcttgcgcaagaccgtccagggagccactccgccgatccataacaatagcatttccaaaccaaacgccacggatgccgaaacgacatcgagggtgaagaacatcggaatgcacaggatcaacgcaccgatgaaacggcttaccgggttgattttcgccacgaaccatgacggtgacgccggcttcgtttcgttacgacgttccttgtgtggcaccacggtaatggtttcgagcttttcattgccgtcgcgcccactgtttttgttggtttcgagcatgtcactccccctctctgaccaaaatacggcgtgcgcccagcgcttcgatgagcggctcatcgtgcgtaatcatgatgaccgcgcaaccttggtcgcgcgcaccggcgatcaattggaccatgctggtccacgtggtgaaatcctgtccgaatgtcggctcgtccatgaccagcacttttggcgcggcagccagcatggacgccacggacagtcttcttttctcaccgcccgatagggtgaatggattcgctttggcgaagcgggaaagattcaggcgttccaacagcctgtcggcgatggaatacgcctcctcgtcggttttgcccatggatttggggccgatggctacctcgtctcgcacggtggatgcggcgaactggtgttccggctcttggaacaccatgccgatacgtcccagcaagtcgcggcttttccatgtgatcacattgttttcgcgatggggaggtaccagatcgtccgccatgcatacacgtcctgctatcggtttgagcagtcctgcgagagtgagtccgaatgtggatttgcccacgccgtttctgccggtcaacgcggtcacctcaccggaatggaattcgaggtcgatatgctcgccgagcgggaaatcatagccgaagctcagatcccgcgtgtaaagcacgacgtcctgcggttgccggatttgttccggtttgggcgcgtggctttcgatggtgcggcccggcacccacgcaccgccgtcggcaagcacctgacccatgtggccgaacacttcgtctggagtgccgtcggcgattacgccgccgacgttcgaatcgacttcgggcttgcccagcacgatgacgcggtcgaccaggtcgagccacacgtcgatatgatgttccaccacaaccagcgtctcatgggtttgttcgaggacgtggcggacagcgtcgtgcacttccttgacaccgtccgggtcaaggttggcggtcggttcgtcaagcagcagcaggccagggtgcatggccagcacgcccgccaaggcgaggcgctgacgttgcccgccggaaagtcctcgtgtggagcggtcgaacgccatgtagtcgagcccgacgatgtcaagggcggctcgtgcccggttccagatttcatctttcggcaggttcaggttctcacagccgaatgcggtgtcgtctccggcacgttcgagaatcgtctgcgagtccgggtcctgaagcaccagcccgcaacgtccgcgcgcttgtctggcgtcgacgccgtcgatgagcagctcgccttcctgctcgccttcgtcatctccaccgagcacgccggccaaaccggacatcagggttgatttgcctgcgccggaagcgccaagcaacagtacccgctcccccggtttgatgtcgaagtcgacgtgtcgtagcgcgaaatccttacgtgaggcgtgtctccatccccaatcatgtgcggtcacgccggccgctgttgtgttctgaacgtcagtggtcattcgtcgttctttcttctgattgtcatgctgttgtttcgtatgccgttgtcatgcgatgcgccatcacaagaaaatcccgcaccaccttgatgtgatgcgggatttgcttgcatcggacaatcagaccagttcctgcgtacgaccggattcgaagcggtcgagcacgccggtcttggcgatggccacctgcaggaggtacatcaccgcgccggcgagcaccgcgccggaaatggcggaggcgatcaggtagatgctgacgcgtagcgcgctccaagccggattggtaagccagtagtacaggccgcagccgacgcctgcaagtgcgccggagatcgtggtggacagcaggtcccacttcttataggcgaagagggcaagaccgatttcggcgccgaggccctgcacgatgccgacgatcagcgagccgccgacaccccactggttgcccatggtgagttcgagcgcggccgcgagggtttccgcgaacagtgcggctccaggcttgcgcacgatgatggcggccagagggcctgcgaacagccagaaagcgttaagcaggccttcgaagcctggagtcaccgcctcgaagagggccagcggcgcggtgcagacgatgtcccagccccagaaaatcacgccggatgcgacggcgatgatggctgcgacgacgatatcgaccacgcgccacttgttgttgtgtttgcgaactgcggaagactggttttcttcagtcatgggatatgtgcctttctcttttcgtcaaggcacgggaaatagagagacgtccgtgcgccggcattacccggtatacgttcatacggttgaagcggttgcttcctctcagccattcggcccccgtgtctgcgcctgatattacacaggacccacgatttacgtcagttttgtctcataacggattccgtattccgtggctgagtcgcattccgatgtgttgttttggaggaacgctccaaccgtatggtgattttattgaggcagtctcatcagcgattcggcaagattcttgaatgtttctccgataccgtccgaccgcaacgcgccctctttggttaggactgcgggccggcctgcttcgccggtttcgcgcagttcaggctccaatgggagttgtgcgagcagtggcacttcatagccgaggctgtgggtcagctgttcggatacgcgtgcgccgccaccttcgccgaagatacgtagcttctcgcctttgtgctcgtagtagctcatgttctccacgacgccgcgaactttcatcggcacctgcaatgccaccaggccggatcgtaccgcgatgtcggaggcggatggctgcggtgtggtgaccaccaccagttcggcgttcggcagtgcctgtgccacggaaatcgccatgtcgccggtgccgggcgccaggtcgagcagcaatacgtccggctcgccccaccatacgtcggataggaattgttccaaggagcgttgcagtcttggaccacgccataggatggctctgtccgcgccggcgaacatgccgatggagatcagtttcacaccccatgcggtgacgggcatgagcatgccgttgaggttcgtgggctgtgattgcacgccgaatagcctgggcagcgagaaaccgtagatgtcggcgtcgatggcggcggtatcgtagccgagcgccgcgaatgtggctgccagattggcggtgacagacgatttgcccacgccgcctttgccggaggcgatggcgaagatgcgggttctgatgccgggtttgttgaacgggttctgtttacgttccgctttgaggccggccaccagctgggtgagtttgtcttggctcatggagccgacttcgatgctgggaatcaacgtggcatcgggataggaggcgaccgcgccgttgatctggttggtgatggtctgcgacagcggacagccttccacggtcagttcgacccgcacccgtacgtcgtacgtgttggtttcgcctgccactggcgtggcgtcaatggctgcgatcatgcccaagtcggtgacggacctgcccagttcggggtcaatcactttgcttagccgttcgtagatgcgcgcttcgatggtgcgctcgtcgctcatgcttcctccttatgccgcgtaccacggtagcggttcgcggcacggctcgccagatggtgtggcgattattcaactgttcctgtgtcgagcagctgtttgaattggtcttcgttgagcatggggatgcccagttcctcggcttttgcggcttttgagccggcattctcgcctacgacgacccaatcggttttcttgctgacagatcctgcggctttgcctccgcgcagaacgatggcctctttggcggaatcgcgggagaatccttccaacgagccggtgaccacgaccgttttgcctgccaatgtctgtggtagtccgctggcttgggcttgtccgactcctacgccggcggccttccatgcgtcaagcacggcaccgcgccaattgcccggctcacgggccgcggtgaaccatgtgactacggattccgcaatttccgaaccaataccgtcgatttgggacaattcgtccacgctggcatgttcgatggcatccaacgtaccgaacgcgctggcgatggtgcgtgcggtgggcggtccgagcctgcggatggacagggccaccagaacgcgccacaggtcggcatggcgggctttgtccatttcgtcgagcatcttgcgggtgttttccgccggacgaatgtacaccggctgcacgctggacgtgcctccacgggataccttgatttcctcgcggatcaccacggcgtcatccggcaccacgtattgcggatattccgcggtctcgtcgatgtcggcttccttgcgtttgcgggcggcggtaggcgcggtccagaatgcgggcacctgatgccataatccggatccgcccacacgtttgcgcactttcttgatcttgccgtttgacccgacggtctcgtggatttcgatgattggagcctcgcgccagacgcgcacatccttgaggtctgcggacgtcaacgagaacagcccggcctcgctggacagcacaggtgtctgcatgggcggcagttccagtcccgccaccggctcgtacggttcaggctcctcaccgggtttcaccacgatttcggtgatgttcggcgcatacgtgtcgatggaatcgggcctgtcctcttcgggattcgtcagcgcaatggctgattggtcgcccagatgttcgatatcgaacgccttgcgggacgccagattgatgatccgctcggtcagctgcgccgggcaggattccacgttcgggcagcgtatatctttgtctccctctttggcgggagcgagttccgcgccgcagctcgggcaacgcgtgggcatcacgaaccggcggagctcgccctcgcgtcccttgcgtcgctccagcaccggaccgacgagctcgggaatcacgtctcccgccttgcgcaccaccacggtgtcgccgatgagcacgcctttgcgttccacttcaaaggggttgtgcagcgtggtacgggatactgtggaaccggccacgtacacgggtttcaacaccgccaccggagtcacacgtccggtgcgccccacctgcacagtgatgtcaagcagctcggtattgacttcttccggtggatatttgtaggcgatggcccagcgcggcgcacgcgatgtggcgccaagggaacgctgcaatcccaaatcgtcgaccttcacgacgatgccgtcaagcgcgtgttcgatgtcgcctcggtgttcgccgtaatagtcgatcatgtcgaggatttccttgaacgacgtgacctcacggttgtgcggagagacgggcacaccccatttcttatacaattcgtaggcttcggattggtcgttgaccacatcatggccgttgccggcgtgccccgcaccccaacgcagcgatccgatgccgtgcgcgtagaagctcaggcgacgggttgcggtgatacgcggatccttctgtctcaggctacctgcggccgcgttgcggggattggcgaatggcgcgcgaccggcgtcctcgttctcggcgttcagcttgttgaaatcgtcccatcgcatgaacacttcgccgcggatctccacgaattcgggaatgtcttcctccggtccggcaaggttctgcggaatggtggagatggtgcgcacgttgagagtgatgtcctcgccggtcacgccatcgcctctggtcagaccctgttcaagcacgccgttgcggtagatgaggttcagcgcaagaccgtcgattttcacctcgcaggtcatgggcagtggcttcgattcgggccaatccaatcccctgagcacgccgtcgtaccattcgcgcagctcctcgatggagaacacgtcatcgaggctcatcatgcgcgatggatgacgtacggaagcgaagtcgttggagaacgtgccgcccacgcgatgggtcggtgactgcggtgagtcaagtgatgggaactgcgcctcaagcgattgcaggcagcgcaatcttgcgtcatatgccgcgtcggatgagacgggggcatcgtcgatatagtatgcgatctggtctgattccacccatgcggccacgcgcgcccacagcctggccgcggcttcggcgctcatcgaagccacatcaaccttgtcgaggcgcatggcgtcggcatcggtcggctgcaacgcggcaatccaacgttcgctgcccggagtcagcgaagccagcccctcatcggccacgacggccgcggaactaccgtcgctctccggcgcgtcgaaatcccatgccaactgttcggaatcatcacgattcgtcattgtcaccgctttcccatcatttccgccatgccgcgcggatgtccacgccagcaccgattatcgcacaaatgttcgaccgttttgttagttgttcagagagcgcaggaactgcacctgcaccacgtcggcaccgtcatggtcttcgtaatccatgcgcatcgcggccaccgacagggtgcgtgcgggcacgaacatgcctttgtccacgcagacgcgggccgcttggtgcatcaggggcgcgaccggcgtgttcggccataccggcagtccggcgtcggcgagcacgtggatggcttcctgcacgttggtcggcaccggaatgcactgcgattgcgctcttccgatcagttcctgcagttcgctttcgagcatggcgatacgtccgggggcaatctcctcgctcatgatgtatgaggcggcggcaaggtcgaagtggtcgcacatccattccgcataggcgaggcgatagtaggcgaatgaggcgtcttcccggtcaagcgcgacgttcagcgcgttgaggcatgccgcacgtgccggatcccagtcctcggcacgccccagctgcacggcgagcttgaggtgcgacagcgggtatgcgggggcgtaacgcaccatggcgttcagatgcggcagcgcggcatcgacgcctttgacttgggcgagcaggtcggcaagctccatatgcatgtagaacaggttgtcgggaatgagcaccgttctttcgccttcggtggcgaacatgcggttgtagatgacgcgttccgcatatgaattgaagtaccgcggcacgcccggattttcagcgaagatccggtccatgcgttcgagtgtggactgggcggattcgatggcccgctcgacgtctccggagaacagcatgtctcgtgccttcagacgttcgtcatcgagggattgtgccagttcgaatgagaagtcgggcgtgtcttcgccgtcgatcagcgcgctggtgacctgcggtgccaattcggtcaattccggatcggatatggaattgatgatgtccatggcctgtttggctttggccaccgattcgagtccgtcgctttgcgcaagacgatggaactcccccacggcgcgctgcaacaggtcgacacgctggatagacaggcccatcatgttctcacagccgaacaactgcgccgtgccgtcatcaaaacgaatgtcggacagttcgggttcttcttggcttcccgccggtgagaatcggctgtcacgaaggtcgaaggccgcatcgatgggtttgagcgcgcctttgccgtccacgtccatttcggcgtcgaacatgcggtatgtggcggttggatgggccaatccgtcagtgtcgagccgcttcaggaactcgtcgcgggcgaaggtgacggtcaccaagttgcgtacggtcgggtttttgcgcagctgcgccatcggatcgtcgtcatcatcatcgaggtaggtgtcgtactccgttttgtcgctggcgtcgtcccgcatggaggcgtcgtcatcatcggcgcggccgtccggtaccgcgaacgccatttcgtcgaagtcgatgtctttcatcaggtcttcgaactggccgtccaccgtatcgtctccagtgccaacgctatccgagccagccgaatcgtcggaatcgattgattcggatgagatatcggtggttctcggagtgacgggccgagccggatcgccatggtagtcgccgtcctttggagcggctttggatccggatggcctcatgtctccggtacggatgcgttcgaaggcgcttaacgcctcgctcatcaactcgctgatggcggaatcctgttcggctacggcctcttccagaccaatcgaatcgatgtgcatcgacacgcgtttgacattcggatcggctccgaagctcagcgcggccatcatgagtccgacgcgcagattgtaatcgacgctcatacgcgtgcgttcgacgtcggtcaggtcgatccacgcgcggcgcgatacgtcgtatcgggtgaacggcatcatggacactccagcagaagtgaagccgattgcgacttcgccgtcgctgaggtcgcaccggaagtcaacgtcgaaacggtatggcagacgcaggctgcgcagcagacgggacatggtctgccggtacacccattcggaacctccgtcggcgccgaaatcgccttccaacacgttgtccttggttgattcggcgacttcacgccggaagtcggccgcgatatccgccagtcggctggcggcctggatgccgtcttcccggttcgggtcgaggatcgcgccgaaccggtcgtccggtttcaacgcgatcagcgccggattctccagcagggcgaagtcgatctgcgcggcttcggcacgcgtcaccgtgtcctccgtggggagagcgccgatgcgtgcgttacgttccagccatgagctgacggcggcgaagcggttgaggttgccctcgatgttgagggcgcacagcactgccgagaacggcagggaggaatcccatgcgaagaagtagcatccggaatagctggatgtgtacaggcgcagcggttccgctccgtgcacagcttcgagcccttgatcagtatcgagcacgtgggcttcgcgcatcagatcggcgaagtagtcttccaggccggaggcgcgcatgccatgcgaccgggcgctcatggtgtctctgatggaccgtcggatggcgcctatgggcgcttcgcggttgagcctgcggaaaatgttgccggaaccgaagccgacgagcaggccgttcatctgtggaagcatgtaggcggcgaagaaggcgatggtgatggcgtcccggtattcgaggtcgaaccgcatattcgctggcaggatggcgcgcatttgctcaagcgtgtatcggttgccggttttgagccatgaggcgagccacatcatgcgaccgcccggcatgcgtcccacgacgccgccttgcgtggcgcgcaccgttttcggattgcggctggccgcatggccgagtcttagaccgtccgccaacgtaagggtttcctctttgacgaagacgaaccgcggttcgagttcctgcgtgtccatgtccggatcggtgccggcgaagacacgcgctttgccgtccgcgagcgcgatttgggcgaagtggtcgctgtcggtgaacaatccgatggagaaggcatggccgtgggtctgcggcagttgggcccatccgaggcggaatcctccgggcacgccttcgaatccgtcgatgacgtgtcgtttgatgagcggattaagccggatggcgttgcgggtcagttcgtcgacgatgtcgtcgggcttgtcaagcgccttgccgaaggggttggcgtggatatggcgcggcgtggcctggttgacgagtcgccgcacattttgcctgacgcgttcgagcatggtccggttatgttccggttggctggccgggtctgatggtgtgcggtgagacatgtgtgccattctttcaatccaacgcgacatgaagctattagaataatgacgtgactttttcgaagcagcgttttcaggcacgtcgtcgtatgtgcgcagccattgtagtcgctttcgcggtgatggtggtggtcgagtgcgtgttgtgtaatatgccgttttggcgttccttggccgcatcaggtgattccgccgccgcgtacaacgtgatgggccctgggctcgaacgtactgacgaggggttgttgaaggtcaccgatccgacgcaggcatatatgcaggtcgatgcggatggctcgtcggaatatgttcgtatggatccggtgtcttcgaaggcgttggataaggcagccagacaatcggagcaggtgttgcgcacggttcgtgtccgtcctgatgtcaatcgcagggccggtacggtcagttcggtgtcggtgtcttcgccacgttcgctgtatgtgcatgcggcggctgcaggtggttcggtgtgcgtgcggattgtcgagccgaagggttcgctgattccgtttgatgcggtgcgtgcgaatgtgcgtgtaccgttcgcgttgaatccgttgcgtatcggcgtgatggtggccgtgttggcgatggtactggtgtggaggcctggttcgcggttgtggcggatgccgttggatacgacgagtgtgaggcagcgtgcgtggctgggggcgctgctggcggtgcctgttgtggtcacttgtgccgttgtggtgtggcagctggtggaggcggctccgttgagcttccatacgaaaggcacgtacacgtatgatttcgaccagtacgattacgtggcaagggcgctgcttgatggtcacgcgtggttggatttggatgtgccggatgcgttgcgtgacgcggcggatccgtatgatgtggccacccggcagcggttgcttgccgatggcgtaagcccagtgtattgggattacgcgctctatcaggggcactggtattcgtatttcggtgtggttcccgcgttgttgttgttcctgccgtatcgggcggtcacatcgttgttcgtcgatggcgggctgatgatgccctgcggcgcggccgtgccgctgctgatgcttggttttctggtattcggatgtctgctggtgattcgtgtgatatcccgaattcgtccgaatgcgccgttggctgcggtcagtatgctgtgcgtgttcatgctgttggcttccaatggtttgtatctgtggtatcggacgaatttctattcggtgccgatcgccgcctccctgtttctgagcgtgttgggattgtggctgtggttgggcgccgccaagcaggtgccggtgtcaggcgatcggattcgtgaggttgatggcacgcagtcgttgtcgttgccccatctggctgcaggctcgatgtgcattgcggccaatctggggtgccgtccgcagttcattctcgtggcgttgctggctttcgtaatattctggccgcagattcagtcgattttccgtcacgcccccaatgattcctcccttccccatatgtcggtctggcgtctgatgcgcgcgccgttggccgcattgcttcccgcgttgattgtgatcgttcctctgctggcgtacaacgtggtccggttcggatcaccgctcgacttcggcacctcatatcagatgacggtcacggatatgaccagttatcggcagccattgtcgaatcttgcgctgaccgtcgcatattacctgttcctgccgttgcggttcacggatgcgtttccgttcctcgccgtcaatccggcgcctcttcccacttggggatttaccgaggcaatgcctggcggcttattcacgatagctccgttgacgttggccgcgctggcctgcccgttcctctaccggcgtatgcgcaaggccgggcgcacgaacacatggctgttgttgacatccagcctggcattgggattgctgcttgtggtgattgactcccgcatggctggtttgggatggcggtacatcgccgatttcggatggctgtttgccttggccgcgttgccttcgttgctgatcgtacttgattgcggcaagccgcgtctgcgttgggtatgtcgtgccggattcctcgcactgctgctgttcacgctggttgtcgcgctgatgtcgttgttcctgcccgggcgtgacgatgagatgttgcgtaacaatcccgccctctatctcgacgtgcagtcctggttcatgttgggttgacgtccgacataagctacatccagtaaaaaatcaggtttctttcctgattcatatagcagtttttccggtttgctctgagtttcatcggcaatcataacgattgtcatcattgttgctttgaattatgttccgggggtcgccaaccatgaaaccgctttcgccgccacgcaaccatcctcgggccgcacgttggatgccaaaggcgacatcgtgctgctcaccaccgaactgggccgcgacgacaacgccgtgcaggaccaggtcgtcaaactcgatgccgaaaccagcagtgtgatgcgactgttggatttcggcagcctgttcgccgattacaaggcgtccgccacgcatgcgggcacggacgattcggatgaactgccggtgaacctgcgcgcggttgcgcctgcggttcgttacaatcgacggtatgggtttcttcgatttgctgttcgccggtaaacgttccacaccggcttcgtccgtcacgttccatctcgaccaggccgcccacatgtacgaggacggcaatatcggtttggaagccaccacgcttgatatcacacctgacagcaagcgtgtggcggtgataggtttgaacggtgccggcaagaccacgctgctcaaattgttggatggcgcgttggccgccacgtccggaacggtccgcatcgaagcggacggtaccgcatacgaccccgccgtgaaacgcgatctgaagcatgtcgaggatctggtcggccgcgtgcggcgcgaagagattccgaacgcctactacaaggcggcttcgattcgtgaggcgatcgacctgccgttgaagaagcacaaggtgccggaaagcgaacgtcaggcgatcatcggcaatctgttcgcgcatttcgacttggcttccgtggcccgcgagccggcctccgctttggatagcgagaagcggcatctgctggcgatcgcggccgcgttgagcttctcccccgctgcgatcgtcgccgacgagccgaccaagggcttggacgaggtggcatcggcacgcgtggcgaaggccctgttcagctatgacaagcaggtggtgttcgccacgcatgacacggatctgatcgtccgtccggaatatgcgatcgaccgcgtgctcgttgtcgacgaccatcgtgtggtgttcgacggcgtgcctcgtgaggcggtcgatttttacacggatttggttcgttcgaagtatgaggcggcgaagggcgacagggcgtagaagagatttcggactcggcagtccgttcagccgatcagttcgttgacggtgtcgatcaccacgtacacgttatgccggaaatcgtccggttcgggcagtagtgagatggccagatagccgttggaggtcatgtcgaagaagtagccgggctgtccggatacgccgtggcgttcgatcatgtgcagcaccagctcgttctcgtcgagcacgctgggcacgcgcagcagtacgttccatccgccttcggcacgcaatacgctgacgagaccttgctcgtccgcgtcgagcatggcatgcagtgctttgagattgccgcgcacacgttcctgcacgcgcgcggtctgcaatggcgccgcttcaagcagtgcgggaatttgttttgcgacgatctcgctcatgggcagatagtcgtcggcgatcacgtcgagacgacgcttggcttccgccacgtcttctgccggtccggacacttggatccagccgactttggcatgcggtgcggcgagcattttcgaaaaaccgtccaacgcgaatgtgagcgcgccacgctcccccgcgagtcgtgcattgccttcgaatggttccaaatcgtaatcgtagaacacttcgtcggcgatgatggccacgtcgtggtcccggcacaggcggacgatcgcctcgcgttccgacggtttgacgtacgaaccggtcggattgttggggttgatgagcaccagcgcgcggatgcgattgccgtccgggccttccagcgcggttttcagttcggccacgtcgatgtaccaggagccgtcgaatcgttgttggtattcgatcatgtcgacgcattcgaggcgtgcgatcgattcgatgagcggatagccgggtttcggtgcgagcacggcgtcaccggcatcacacagcagtttgataagccacgagtaggcttcggaagttgaactgaggatgtacaggtcgtccggcgagcaatggccgatttcctgcatgtcaaggaacgcggccagcgcctcacgcgcgtagcgttggccgcgcgggtcggcggagtagatgtccggaacaagatccggagccagcgcgtgccgtgtcggattggagtcgttgagcttgccgagcggtctgccggctgttttggcggtggcttccgccttggcgatgggattgggctcactgatgtcgactcttgaggaaaaacgcatgctctccaccctactccatggactgccgtcttccatctgcggcacatggaacaacgaaaaaggccgtccgacgaatcggacggccttgtgacaacctaatcggtcaacacatcacttctgcttggtgctcgcgtagtatgcggcgccgatgatgccggcctcgttgtgcagcttggctgcgacgatcggggtcttgatgtcgatgtacggcaggaacttctcggagacgcgggacacgccaccgccgacgacgaacagctgcgggtcgaagtagaactccatgagggagtagtacttggtcaggcgcttcgcccacttcttgtagcccatgtcgagcttctcgcggatggaggatgcggcgtacttctccgcgtcgcccttgcccttgagcagttccagatggccgagctcggtgttcggaatgagctcgccgttgaaaatcagcgcggtgccgatgccggtgcccagcgtggtggcgatgacgaggccatcctggcccttcgcggcgccgaactgctgctcggcaagaccggcggcgtcagcgtcgttcaccacggtgaccggacgaccgcaagcttcggagaacacttcggtgacgtccacgccgacccaggactggtccaggttggccatgtagccaagcttttcgcccacatgaatcggagccgggaaggcgatgccgaccggagcggactccggaacctcgaaatgctcgagctgctggcgaacgatttcgccgacggccttcggagtggacacctccggggtgaggatcttcagacgcggttcggcgaactcgcccttctcgaggttaaccggggcggccttaattccggagccaccaatgtcaacgccgaatgcctgtgcagtctcaatcatcttcaacctctctatcaaggtatgttatgggtgtattcgaaccggtacgtgttatggtaactcgcaacatgcccaaaatcgcgcgcgacatgcacaaatggtgagaacgattgcacaaattgtaatacttaaccgagtaaatatttcatcgcctgttttgcaaacgattcgtcccacgtcggtagaggctccgacgtgggacgaatcgtcaatcgcgtgatcgccgcgcgttgggaaacgcgtgggccacggtgttacttcagcggcggcatcggctgccattccggatcatgcagcagcttgcgcgaatcccaccatcccttggcgatctgaacgatgcctgtcttgaaatgctcgcggtccaccatcgtcagtcgaatcacttccttgaccgcggtcagcgccgtacccaggccgaacaacagcggacggtaatcgccgtacgtcatgaagtatcgggccatgtagccgcggttgcgcatgatgtggtagcggttcatgtcggaagtggagttgagctggcgcacgccggcgatgtcccaattgccgatctcgcgcgtacggcgcagcaccacgtcgggcacgacgatcggattggtgaccttgctggcacgatagccgtacatcgtgtcgtcccaatagatgaagaaacgcgggtcgggcagaccgatcttctcgacgatgttgcggcggaacaggccgccttcgaagcacaacgtgtccatcacgcgatagccagccgggccgaacgcagccggtgcgatcgggttcggaatgccgagcgggacgatgaaatcgtactgccagtagaacggaccgccatcatagtcgtagcggcttccctgaatcacgtcgtgccgatcggtccacttggccaagcgctcgatgccttccggcatgacggcgacgtcgtcgtccatgacccagaaccattcggcacccagctcgtacgccttcttcacgcctgcggagaaaccgcccgcgcctccgaggttgtcggtctgcggcgcgtagaccacgcggttctcgttgccggacaggtcggccacggtggtgccccactgcgcggtgagcttggcgctgaattcttcgaccatgccatgggtcttgtcactgtgctcgttgtccacgacgatgatgcgccacggggcgacggtaagcttctcgatggattcgaacagggtggcgagcagctgctggcgcttgtaggtcaccacgacgatagccagcttttcgatgggcttcttcgcaacttgcttttcagtcatacgttccattcttgcaccggccctcaaccacacatcggccatgttcgatatggagccgagcacgggcataatccgcgacaaatatggacagaaccttgcacggcacgaacttgtttgccataatgaaccgcgtatgcaggggaatccgtatgacggattgagatgggcgtggacgtccgaaccctttgaacctgatggttgacaccagcgtagggaggcatggccatatggctgatgtgatttccgtaaccaattccgattccgcgttcgacgcttcgaagggcgtcacgcgaaccaatcttcccccattcgcgcagcggctgcgcaaagccgccgacctcgtatgggaggaaggctacaagcagccgttcatccgcgaactgggcgaaggcactctgccgcgcgagaagttcgcgttctatctgctgcaggatttccgttatcttaacgactacgccagagtgcatgctttgggactggccaaaacagacgatcctgagatcatggcgttcatgctcaacgtgcagaacggcgcgttgaatgtggagtcgaccgtgcaccgcacgtatctggccagctacggcatcaccgacgagcagatgaacaacgtgcgccagtcggcgttcgcccgcgcgtacacgtcgaacatcctttccatcgcctatggcaaggacatcctcgacattctcgtggccgtgctcccctgcgcctgggtgtatgcggattacggatatcgtcttgcccatgaattcgcagacacgctcgatgtgaaccagtacaagagctgggtggacatgtacaagaccgacgagttctggcagggttcggcttggctcatcgagcatatcgaaaaactcgccgccgaggtgagcgaggaacgtaagcaggagctggtcgatatttttgtgaccggcgttgagaacgagtacatgttctggtccagcgcgtacgacatgcagtacacgtggaagcccgaatgggatcaggagagctgattctccggcacgctctcttccgattgtttatttccatatgaagcggcccgccttccgattggtttcggagggcgggccgcttcatataacgttcggatcgctattcgcgcacgagacgaatgtgctccacgtcgtcacgctgggaacgacggtagagcacgaaacggttgccgatgacctgcacgagttccgcgccaagctgttcggcgagaccttcgccggcctccttggcggtcagaccggaaccgtcgagcacggagcatttgatgagctcgcgcttctcgatggtctcgtccgcctgtttgacggcgttttcgctcagatcgttcttgccgacctggatgagcggattgagtttggtggccaggccgcgcagctgcttgacctgctttttggtaagtgccatatgtgttccattcctatctacaaatacccgctcaagcctagcgtgaggacggtatttgcccatccgcccgcaacgcaccggtcataacagcacgcccggcacgaccagtgcgacgagatagacgagcaccacgatcgccacggtcacgtccatgccggtgacgcgcatgacacgccaatgcgtgcgcgtcacaccttcctcatagcagcgcgcgtccaaggcgaggctcaggttgtcggcgtggcggatggctgcggcgaagaccggcacgacgaccgccaccatcgctttgatgcgtactacgaacgaacctgtttcgacgctgccaccgcgtgccgactgcgcgtcgatgatcgctttcgtttccatgccaagcgtcggcaggaaacgcagggcgaggctcatcaccaatgccgtctcctgcgtgtgcaggccgaatctggcgaacggtgacagcaatgattcgaacgcgtcggtcatggcggtcggtgtggtggaggcaaggaacatcgctccgatgacgatgaccacggcgaaccgacatgcgtagagtatggcgatgcggatgccgtcatcggtgatgggaatcggcccgaggctcgccaccgtggtgccggtgcgtacgaagaagatgttcagcaggccgcagaaaacgaacaatgccaggaacacacgcacggaagcggccaatcggcctacattgatgcgtccggccgcggcgatcacgccggcgaacaccacggcaagcagcaattgccagaatgagccgatggcgaacgcggagaacatgagcgccaatgcggacagcatgcccacgcgcggatcgaggcgttccaacagggtccgccgctcccccacggtcgcggtgtccgagccggcggcgtccacggatggttccgcatccggttccgcttcgcaggtggctttcactgtggattccgtggattccttagagtccgcacgtttcgccggcttgcccaacatgatggtacggtcggcaagctcgtccacttcatcctgcgaatgcgagatgagcagtatggtcacgccgcgtgatttgagctcgtggatgagcccgtgcacgcgtgcggcggcctcctcgtcaagacctgcggtcggctcgtccagaatcaacgctttcggctcgcatgcgatcacgccggcgatcgccaccagtcgctgctggccgcccgacaggtcgaacggcgaacggtctcgcagatgttcgatatgcagcagccgcatggcctgcatggcgcgttccatcgcctcggacgtatccaatcccaggttggaaggcccgtatgcgacgtcttcggccacggtgtcggcgaacagctgccgttccggatgctgcatgacgtagccgaccgtacggcgcagcctcgtacggtttttgcgattgaggggcttcgttccgccgttcgccttcgcagtggccacggcgatgccgtcgatgacgatcgagcctgtcgtgggtttctccaacgcgcacagcatgcgcgccaatgtggttttgccggcgccattgcgtcccatcaacgccactgtctcgcctttgccgatgctgaacgacaggtggttgaacacgtcacgttcggcgtccacgtaacgatacgatatgtcgcgtgcttcgatgagcgtttcggcggactcatcatcaatgcgtttcggcaggcccaccgattgaaccggcatccgaagccgctcgtcggcggggccatcgcctacgatgtggcctgcttccagctgaatcacacggtcggcatgttccaactcgtccgcatggtgcgtgacgagaatgatggtggtgccgcggtcctgcagttcgtccagcacccgcatgatgtcggcgcgcccttgcgggtcgagcatggcggtcggctcgtcgagcacgagcacgtcggaatccatcgccagcatgccggcgatggcgatgcgttgttgttggccgccgctcatgcgcgtcgggttggaagcgcgatagtcgctcatatccacggcgtccagcgaaccggagatgcgcagtccgatctcatcatgttcaatcgcaagattctccggtccgaacgccacgtcgtcttcggtgacggtggtgacgatttggtcttcgggatgctggaacaccgcgccgatgccgcaacgggcggttcgatactcgtcggcgtgcgcaccggactcgtcgaacaccacattgcctgacaatgcgacatatccctcatcgggagccaccagtccggcgatgacacgtgacagcgtggatttgcccgaaccgttcggccccgtcagacagatgcgttcgccacggcggatgtcaagactcataccgtcaagcgcccatgtcgcgccgccatcataggtgaatcgcacatcacgtagcgttatgatcggcgcattggtcgtaaccataaaatcttccttcaccagcactgtatggaattctcggggaaaacaagacggaggaacccccgacggatgcggacggcccctccatgttcatttcaatgggaacaaacgaagctcaacggttcagcaggttggagatcggcttgtagatcaagaacgtgaccacgccgtggatggtgaacttcaacgcgttgaacggcaggagcgccggcactataagcgccacgacctgcgcggtggtcatgtgcgcgtagaacggcgtgacgatgatgttgccgacgatggcgacggcgagcgccacgacagcgccgacgatgatgccgatcagcgcgcccttgcgcgtcttgttctttttgtagatgagcgatgccggcacggacagggccaatgccacgagcacggccatcagggtgccccatgggttggtgaacaggtgcggcacgaagccgagcacgctgacgatgacggctgcggccgggccgaacgcgaagcccgcgacgaggcagacgatgccggatgggtcgtatttgagccattgcacgcctgggatgatcgggaattcgatgaagctgacggccatggacagcgccacgaacagcgcgtacatggcgatgcgtttggtggaccagcggccggagtcggcgacgcctgtggagtgcgcgttgtccggacgggtcatcggtttgtctgcggcctgatcagctgcggtattggaggtattgctaggagaggatacactcatgttgagctccgtttcttccatccggactgtaaccgttggccccggattctcaccggatcagccgctttcgcgggtcgcgggcttcggtatggggccgttatgaatgccggtcgtgccgttaccgccagtaaggattttcaccttccctgaaacttgcttgtccatatatacgcccgccatgcgatatgcgcaacctgcgttccgttttcgtcttgcgattcggaacgcagtctgcgcacgccgcgacagcgggcatgttatgacagcaggtcgagcagatcgtccttgctgagcgtgccgacgccgccggatgcggtgccgtcggtgaattggcgcgccagctcgtttttcttttcctgcagtttcaggatgcgttcctcgatggtgtctttggccacgatctggtatacgttcacgtcctgggtttggccgatacggtgcgcgcggtcggttgcctggttctgcgcggcggcgttccaccatgggtcggcgtgcaccaccacggacgcgcccacgaggttcaggcccgtgttgccggctttgagcgagatgaggaatacgggcacgtcgttgccgttgaattcgtcgaccagttccacacggcgtttcttcggcgtctcgccggtgatggtgtagtattccacgccttgttcggcgagtctggcgccgatgagttcgaggaacgaggtgaattgcgagaacacgaggacctttttgccttcgtccatgcatgtggccacgagttcgacgatggcgtcgagtttggcggaggcgttcttcgcgtcggcgtagacgagtcttggatcgcagcagatttcgcgcagcaaggtgaattcggcgaggatgcggatcttcttggtgttgaagtcggcgtccgacgccttggtgagcgtggcgcgtagccgctgttcgtgtgcggcgtacagtttgcgctgctctccttccagtttgacggtgagcacgttctcgaatttgtcgggcaggtcggtgagcacgtcttttttcagacggcgtttgatgaacagtcccaccaatgcctgcagtttgtcggccatgacggaatgttccggaccgggagccatgatcggctgctcgtatttttcgcggaatttcgtataggtgccgagcagtccgggcatgaggaagtcgaaaatgctccacagttcgctcaaccggttttcgattggcgtgccggtcagagcgaagcgatggtcggccgtgacctgtttgaccgatttggccacctttgtggcgtggtttttgatgtattgcgcctcgtcgagcgccatcagcgcgaaatggcaggctgcgtaatcgtccacgtcgcgacgcagcagatcgtaggaggtgatcaccacgtcggtgccgtcgtacgtcgtggcgccattcgtcgtagcaccgtcgttctcctgcgattgcgtggccaccgtcgcgatggccttgcgtcgctgcgctttcgtaccggcgacgacttccaccgtcagatcgcccgcgaatttctcgcattccgcggcccagttgtagacgagcgatgccgggcagacgatgagtgacggaccgctccccttgcgcgcttcgatgagcgagagcagctgcacggatttgccgaggcccatctcgtcggcgaggatgccgccgaagcccttgtcccacagggtggacagccattggaagccctccacctggtatgggcggagcacggttttgagccgttcggacacttcgtagcgtttcggatcgatgattctcacatcgttgacatagtccacgaacgaggcgcttttgccttcgtcgtccacttgggagtccagcaggaacgcttggtatccggggattttgatgatgccggagtcaagctgtttttcactcaggtcgaggtccgtggacacttggtcgagctcatgcaggtcggcttccttcaaatccacgaacgtgccgtttttgagccgatggtagcggcgttttctgcggtaggagtcaagcagcgcgccgacttcgttcatcggcacctcgtcggcgatcggtgagatttcaacgaggttcgagtcgatggacaagccgaccttcaccgatggcgggttgggctgcatcatgccatcgaatgccgccgtggagaagacctggcccaccgatttgaggatctgcacgccgtcggtgagcatgagcaggatagcctgctcgtcctcttctttgacgcgtgccacgtcgatggagctccatgtagggcacagctggcgtaccacctgcacggcgaacgattctcgtgacaggtcgcgtttgacctgcgaggctcttgaacgtgaatcggggttgatcacgccgcgcagttctttggcggtgggcaccagttggaaggtgaagtcgccgtatttcgccaccgcttcgcaggtgatgccgtacaaatcgcggtccagatagaattcgatccggcattcggttcccaccgcttcggtcacttcctgcggaatgtcgaatccgatgcccgcttcggtgagtttcggcacgatggttcgggcgaacatgggccagtcgttttcggcgatgaacacgccgtccggatcgtcggaacacaggtcaggcagcacctgtaatgccgggcgcagtttatcggtgcagcggaagagcccgtcgatgcctatcctgtccgtctccgtggaatcgtcgggacgttcgcggctgaaaatgtagaagccgttgcgtccgttgatgacatcggagatgctttggttcgatgtgatgcgcacgcccgacgcggtgccctcatgcacgtaggacgccttgaacgtgaaggtggggtcgccttcgacaatgtcaaggccgaacggttcgcctccttcgttggccatgtggatgcggcttggcccggatttcttggtgcgttggaaatcctcgataagcaatcgtctcagcccgtcaccgtccgacgtgcgcaggaaaccacgggccttcgactcgtgttccttgtattcgtcctgtgtcacggcgtggaacaggtcgagcaggtcgcatgcctcccaatcggtgaggacgagttcacggtcgacgcgtaccgcttcgccgtaatagtatccgttttgcagttgggccgccgttctggatgcaatcacctgctgcaggaagcggtatagcttcagcgagaaggggtcgagcatgtccggagtgtgggtgaacgcgagttttttgccatatgactcgtatgttcccgtccgcatgtcggccacgaatcttgagatgtttttgagcgcatagtcggcgtcgccgcatccgatgcgcagggacaggcgcagggcgtcatggccgttgatcagcgtgggctcgaggtacacgcttcccggtttgacgtcgaccggcgcgcttgatttgcgtttcggtttggcggctccctgtccggaggcgccacgttgttcctcgatcaatcggcttttcgcgttgatgattcgtttcagcacgtcgagttgggcattctcgccggcgttgttgcttttcgcatcgagggagcgcatgtagtcggcgagggcccggggtgttgcggctgcggcgtggaatccccggaatcgttccggctgttgcaggaacagcagcagcatggcggctacgtgcttgcacatgccggtataccggcggctggtggaggaagccgagtcgtcatcatcgttgacgtggccgtacgtgctgccggagccgaaatcgtcgtagtcgtcgacgtaatcgtagtcgtcgtcatcgtcgaagctgcggtatttcggactgttgtggtagtcgaaggtccggtaggaaccgtagccgcgctgcgaaccgctgaatgccgggcaggagcagtagcgtgccagaaacagctcgtcggcgaaatcaagcgtggcttgcacttcgtaacggctggagggtgaggtggtgccccgtatggtggcatacagggtgatgcggttggatgcggtgtcgttcaggcaatgcaggtcctccattttggaacgccattggttggcgatgccgcgggcgcgctgcagtaccggctggctgcattcgctgcgcagctcgtcggaaagccatgccagagtgtccgccacctgaacccccatcgttcgtacgtttgttctcatgcaaccataccagcgcgatggaacagcaaaagccgcggcccgatccggaccgcggcatgttatcgcccgtgttgcgtcagcggcagcgtttggtcagcggctgccatgggtcgagttccaccggctcggtttcgagcagcgctcgggtggcgtcgtcgaggtattccttgcggatgatgatttcggtcacatagcggtcgaaccacttgtcggaggccacgtagtagccgtcttcgccgttgtctttgccccagctgttctccactttccagcggttcggcttgccttgctcgtcaaggttcacgccggtgagggtcatggcatggttgcttggactgtcgccgtattcgaggccgtgcgccttgtcgaagtcgaaatcggtgccgaacagctggtccacgcgcacgctgtcgcagtcgaaatagccggccgcacgcagcgagaactgggtgcagtcgcaggcgaaccagatcgggtgtccggcgctaatctggtcgaccgcggcctttttgaacacgtcgagcggcacgttgacgaattccatatcccccgcttcggccacattggcggtgtagcggatgcggtaacgcttgttgaacggacgggacgccatcggcacgttgcacaacgtcaccagatcgtcgacgtccaccggcacgtacttcttgtagaattccatcggcgtgatgccggtttcgcggatctgtctgcgctcgtccttgccggttttcggcttgtcggcctcgtcttcgccgcttttcttatcgtccttcttgtcatcgtcgctcacgcgggccaggaagtcgaacttctccggcggctcgcccaacgagatggcgcacatgcggtacacggtggacatgtcgtcgtccttgaccgcgcgcagttcatcgaccgtggcgccggctgcgtaacgttcgcgcaggtcggcggcgaactggcgcagcctgctgttgaggtattgtttgaacgcgtcggagtccttggaattggcggattccgggtaggcgctcttcggcacgagaccatacttgtctacaagggcggcgaacatctgccaccaaccgccgtcatcggccggcccgtagttgatctcctggaacaggcggctgtcggtcggctcgtcgagcgtggcgaacacgttttcgagatacgtgttggatttttccatcgcatcccagaagaacaggtaggtttcggagaattcgaaatcgtcgagtccccactggtgcatgagctcgtaacgcagggtgttgagggatgcgaacatccagcagcggccggatcggcgctggttggtgatggacccctgtttcagttcgatggagaagtcgcgtggcagcgcgcgctggcctttgtagtcggtggcggcttcgagcacgcccgaggacaccgcggcgttggcggccacaaggttggcccggtcggcgttgaagtctttggcgtattgtgcgagacgttccggtttgattgctgtgatgctgttggtcatacggccgattcttgccatacgtcttgacggatgcgaaatactggtttcggcatgccgaaaaatctgccgtaaataagcgattcgaattcgttccggggatattcttgtactacttgaggggtttttagggtgaggagcgtatcatgcgtcgtcatggttcgatgatggttgttttgtccggattgctggctgcgagtctggccatcggattgccggtcggttcggcgtatgcggacgagccgacggatggcaccggggccggcacgtccgccacggaggtgttggattcgttggaggtcaagggccgcgcgccgaaaaccgggtacaagcgcactcaattcggcaaggcgtgggccgacgtggaccacaacggctgcgacacccgcaatgatatcctcaaccgcgatctgaccggcgtgaggcacaagtggcgtacgcacaattgcgtggtgaagtccggaaaactgcatgatccatacactggcaaggacatcaagttcaagaagggcaagaagacttccaccgcggtgcagatcgaccatgtggtggcgttgagcgatgcgtggcagaagggcgcgcagaagctcagcgaggagcgccgcaccgcattggcgaacgatccgtacaatctgctggccgtgcaggggcgtgccaaccagaagaagtccgatggcgatgcggccacgtggctgccgtccaacaaggggttccgttgcgaatacgtggcgcgtcagatcggcgtgaagcacaaatactcactgtgggtcacgcaggccgaaaaggaagccatggccaaggtgctgtcctcctgtccgacgcaaaccgtgcccgactacacgggggtcaaggattccacggccgagaagaccaccgagtccgagcagaccgaacagacgcaaaccgaacagtcagctgagcaggcccagcagactcaacaaacgacacaggcacctgcgcccgaacccgctccggctccagctcccgcgccccagccagcgccacagcaggatgtctactaccagaactgcaccgcggcacgagccgctggcgccgcgcctatctaccagggccagccgggctaccgttcacaactggatcgcgaccatgacggagtcgcctgcgaataaatccaatgcagcgtctccgcctttccggttgtaagacgtatgacggtgaggcataggaaaagcgccgggttattcatccggcgcttttcctatgcctcagcctctttccgcattttccgcagtacagtcatgagaaccgctatggtctgcgcagccgcgcgatgtcgtcacgtagctggttgacggtgtccgtcagttcccgcacattgtggcgcaactgttccgtttccgattccgcctcgtccgcgcgcttgtcggtttcgtcacggacacgatcgactatccatgaggccagtgtcgcggtgacgatgccgatcagggccacgccggttatcatcagcccgatggcgatgcatcttccctgccatgtcaccggggacaaatcgccatagccgactgtggtgacggtcacgaacgaccaccatatcgcctcgccgaaatcggtgatggaagcgcctggaaccccacgttccacatccaattcggcaagggcgccgatatacatcagcagtgtcacgctgcagcatgtgtacagtgtgatgcgcccacgcaccgccatgccaccggtacggttgagcacgttgagcaccgccaccaatcgcagcagcctcaatggtctgaagatgggcaaggcgatggacaccagcatcagcagattgcctttgaaccaggctttcttgtccttcgccagcagaatcgaaacgacgtagtcgacgatgaacgccatccagatgatgttgatcaccgtttcgcacaatacgatatgcgtcctcgccagcacttcccacgaatacgcgaacagaaacaccaacgccaatgcggtcatgaaccactcggtcatccgctgccatttgtccaatgtcatatctcccgcctttctccccatggctgccatcatacgggtttgcccgtttttgtgacgtattccgggcgcggtacatgtgccttcagaccagatagacctcctcatgtggttcgtttcagagttcatctcggaggccgtccgattcggaccattcagccgacgaccgaaggagcggatacccacttttaatgaacgtcagcccttgagaggcatgcggttgtcgagcgattgtccgttggcgtagcagcgcacgttgcccaatgcgatggcgatgatgcgccgttcggtggactccaagtggttgccgcccgccacatgcggggtgatcaggcatttcggctcgctccataatggcgatgccgccggcagcggctccggttcggtcacgtcgaggccagcgccgcggatcatgccgttggcgagcgcgtcggcgagcgcctgcgtgtctatggcgtcaccgcggcccgcgttgatgacggtggcgtcggttttgagttttgcgatgcgttccgcgttgagcaggtggtgtgtggatggcgtggatggcacgcacatggcgatcacgtcggcgtattgcagcacgtcgtcgagcgattcgaatccgaccatgtggtcgatgcccggcgcttcgacggtggggttgcggcggatgccgatggtcgacatgccgacgctcttgcataggcgtgcgaaatgcgatccgatgtcgccggtgccgatgatgagcgcggttttgccgtcggggctgatgacgcggccggcgtcctgccatgcggcgttcgggttgccgacggcgtagatgtgcaggtttttcatgatggcccacatcatggcgaacatgtgttcggagacgctttgtccgtaggctccggtggcgttggtgagcatggatccgggctgtaggatgccggggtgctggtatttgtcgacgccggcgctccaggtctgcagccattcgagtctggggcattgcgcgcatgtttcgggcgtgatgttgccgatgaccgcggttgcatacgctttgagttcgtccggtatttcggcggtccagttcatggagcctcgttgtgccgggtcgccgacgaattcctgcggcatgccttttgcggcgcgtgtgaactgcgcgcgttcggcctcggtcagcggcaggcagttgacgaccagtttgcggtcattctctattcccatgcgcccaaccctatgtcaaccatcagatatgcggcgcggttcagatgccgagctcgtcggtgtcgaaaatgatggtgaccggaccatcgttggtaaggcttacgcgcatgtgggcgccgaatctgccttctttgacgtcgagtccctgcgcgcgcaacgcgtcgttgaacgcatgccatacctgttcggcatggtcgggcgcgcctgctttcacgaagcttggccggttgcctttgcgtacgtccgcatacagcgtgaactgggatatcgacagcacgctgccgtccacgtcgtggatggaacggttcattttgccgttctcgtcttcgaaaacgcgcaggttggcgattttgtgggcgagccagtcgatttgtttcgctccgtccgtatcttccactccgacaagcagcacatagccgatgcctatatgctgtggttcgaatgtggtgtcgacttctccgcttgtctcgtcgaccacgtcgacggatccttcgctgaccttctgcaatacgatgcgcatattccgtctcgttcttttcagccggcgtagtcgacgatggcctgcgtgacctgtttcagatagtcgagcgatgtctgccaatcgtccggcacttcgatggaatgattggcaccagcatacgtgcgcacatggtcggtgagcagatgcgctttggcgtcatcgtagtatgggtcggcgtcacctgcgcagattagcggcatcgggctgccggcagttcccggcagcggcgcgggaatgaccgacttgtgcttgtcgaatggcggcggattgagtaccggggtgagcagcaccacgcgcaatcctagctttgcggaatgcggatatgagagtgtggagagcgatttggtgacgaccagcaaatgcggctcctcacccgattcggcagcatgttcgagtgccgccttgcgccattcgtcgaccacgcgttccatgcaggcgatcatttccggaaactcgacgctttccgtcagtttcaggtcgagccggtccacgaaccatccgttggccgcaagcgcctgcgctgcccagtacagcagcggtcggtctacggtgtatccaatgcccggcatgatgagtacgtgcttgcctgtttcggtgttcttcacacggttcttgccccatggcgtgaccgcgggcgtcacattcttcgttttcgttgactttgcgctgttttcgttgattttgcccatgccctgccgaatgtctttcgatgtcttcgtatggttcgaccaccgtctcggttttccgaagaccggtttccttcaacgcatcatagggcacataggctacatgggcccatatccttccatattgcgttcattccgttcggagaatacggaagaaccgtcacgaacggtcggtcgccacgcgtctggtggtgtcacgcaacatcagcgtggcctcctgcgattcataggatgcgtctggcgtctgtccacgcagaagggacaacgtcttacgggcggcgttgcgtcccatttccagcggattctgtcgaacggtggtcagattcgccgcctgtgcgatgtcggcatcatcgaaccctatgacggagatatcttcaggaacatgcaattgttgcttgccgagttccttgatgactgcgattgccacttgatcggtttcggcacagatggcggttggcatgtgtggcaatgacagtaatttcgccaccagttgcgcagcaaggtccgctttcgacaatggcgcatcatgctcgtccgcggttatgacgtaggcatactcatcgtcgtaaccgttttgttcagccgcttccaagaacgcttccatacgctggctggtgctgtagaccatgtcgtcgggaatgtaatcaacgacgaaagcgatgcgctggtgtccaagcgatttgagcagacgcaccgccttggacatgccatcgtagttgtcaacaccgatggctgcgtcgcagaacgattcggctggaatgttcacaccgaccgtcggcatatcggtgacacgcagtttctcacgtgcggattcgtcgagttggaacgacgaaatgatgatcgcgtcagcattgcgatttttaggcaattgtgcgaagtaacgctccgtctcctgtctgcctgtgacaaatgtgggcgacacgtcgtagccttccggttccaacacttcgcacacgccctgcaacacgttggcgttgaaccattcgttgagtttgccggaaaacagcaggacaacccgcatggttttcccggacgccaaagacgatgcgcttttagataaggtaaagcccaaccggtccgcagctgcctcaactttggcacgcgttttcggagcgaccttgccaacacctcgcaatgcccgcgaaaccgtcgcctgagatactcccgccagttccgctacttcggcgatggtggctcgtgccatatccactccagtttcccattgtttatccagcgctttcatattagcagaatcgttgatttcacaagcagacacgccataacaaaacaattattgcattcacagaatgaaagcgctatcattttaagcaatacgaagacgagaacgaagtgattctaatcgtcaaaacagagcgttctcaacagaatgaactagtgaaaacgcttccataaaaagccataacaaaatcacaatgcatccaatgaaggaagacaacccaatgagcaacgaagccaacgagcggcacatcgctgacgatccatcactctggtggaagcaggcggtcgtctatcaggtctacccgcgttcgttcaaagacacaaccgggtcgggcctcggagacatcgcaggagtcgcacaacaaatcccatatctaaaaagactcggcgtggacgccatctggctcagcccgttctatccgtctcaactggcagacggcggatacgatgtggacgactaccgcaacgtcgacccgaaactcggcaccatggacgacttcgaccatctcaccaaaaccgcacatgcggcaggcatcaaaatagtcgtcgacatcgtaccgaaccactcgtccaaccagcataaatggttcaaggccgcgcttgccgcaggccccggctcaccggagcgagaccgttatattttccgtgacggcaaaggaccgaacggcgacgagccacccaccaactggattgccagcttcggtggatccgcttggactcgagtgcccgacggacaatggtatctgcacatgtttaccgtcgaacagcccgattggaattggaagaatccggacgtgcgcgccgatttcatcaagaccttgcacttctggctcgaccatggagcggacggcttccgcgtggatgtggcgcacggcctggctaaggatctcgaccgtgacgatctcgatgatttcaaaatcatcggaggcgagatgcattgcgccgacggcacgcatccgctgtatgacaggaacgaagtgcacgacatctatcgcgaatggcgcaaggtgttcaacgagtatgatccgccggcattcgccgtcgccgaagcctgggtacctccggagcatcaataccggtatgcctcgcccgaagaactcggccaagtgttcaacttcgaattcgccaagaaagactggattcgcaacgacatgcacctcgccatcgaagaaggcatcgccgctgcggaacgctccggctccacctccacatgggtaatgagcaaccacgacatcccccgccacgtcagccgctatgggctgccgcaggtgccggctgcagcccaccaccaacttgccaaggattggctgctgcgcaacggtacctcttaccatgaggatcgcgagctcggcacgaagcgtgcgcgtgcggccatcctgatggagctcgcgctaccaggttccgcttatatctaccagggtgaggagctcggcctgccagaggtcgccgacatcccgtgggacgagttggaggatccgaccgcgttcaaccgcgtccgagaccagatcgaaaagggccgcgacggctgccgcgtcccgctgccttggaaggccgggacgccgaccttcggcttctcccccgccaccaagcatgaaggcgccggcgtggacgcgagccaggcgggcgatccgtgcgagaagccgcatcttccgcaaccgcaatggttcgccgactacgccgtagacagggaggacacggactccggctccatgctcaacctataccgcaaggcgctcggactgcgtcacgaatggatgacggccgacacgaccctgacctggctcgactgcgaccggtcctccggcaagccggacggcgccgaggggcacaccggcggcaccatcgccttccgtagggccaacggctgggccagcgtcaccaacttcggtgcggaaccggccgaactgccggcaggcgatatcctgctcgtctccggacccctcaccgacgacggccgtctgccgcaggacaccaccgcgtggatcgcgctcggctgaccggaccccatcaaccgcaattcgcattcaacaaccaaacaaaggagcacatcatgaaccgcaacatcacacgaatcgtcgccatcgcggcgacactcgccatgggaacatcgctggcggcctgcggcggcagcagcgccgattccagcaagggccacgtgtatttcatgaacaacaaggccgaggtcgtggaccagtacaaggaactggccagcatgtacaccaagaagaccggcgtgcaggtggacatccagaccggagccgccggcacatacgatgccaccatgaaatccgaattggccaaggacaacgcaccaaccatgttcaacgtcgccggcttcgaccagttcgccaagtaccagaagtacgtcgaaccgctgcaggacaccgacgtgttcaaactgctcaacgataccggcaaggcttactcgtacaccatcgacggcaattcgtacaccctgccgtacgccgccgaatggtacggcatcatctacaacaagaagatcatcaaggattattgcgccaagagctacgcggtgatcaagtccgccgatgacatcaaggactacaagaccttgaagcaggtggcggaatccatcgagcagcacaaggacgacctcggcgtcgacggcgcgttcgccaccccgggcttggatgcctccgacacgtaccgattcgctgcgcatatgacgcgtctgccgctctactacgagtatcgggacgcgaacaccacgttctcgaagaccatcaagggcacgtatctcaagaactacaaggacatgttcgacctgcagctcaagaccagcccaaccgaggcaagcatggtgagctccaagacctacgatgacgtgacctccgaattcgcgctcggccaggtggcgttctacccgaacggcgtgtgggcgtattcgcagatcaagggcaatgacgtggccgatgaggacctgggcatgctcccctactacatgggcatcaagggcgaggaggattgcggccccgtaggagtgtatgacgcgagctgggcggtgaacaagaacgcctccgaaaaggacaagaaggccacgctcgacttcatcaagtggatgatcaccgacaacgaagccaagaagatcctgtccaaggacatgggattctccgtaccgttcaccacgttcaccgatgactaccagccggacaatcctctgaccgaggccgcccgagcctacagcaatgacggcaagaccgaagtgcgcagcttcaccattccggatcagcagtggcaggacgacatcgcctccgcgctggtcgaatacgcacagggcaccggcaagtgggacaaggtgcagagcgcgttcgtggacggctggtccaccgagtggaacaacaacgaggaatcgctgggttccgtgccggaagcgcagaagttcgacgcaaagagctgacgccatccgactcgtggaaaaacggctggacgccggtagataacaccccaatctaccggcgtccagccgttttttccatgcgacggtcgtccgatccgctgccgtacacttggtcgttatgaaagtttccctgcaacgcgtgtccgaggcgagcgccatcgtattgaacgagttgggcacaccggatccgacattcgacatggcgcagatcgggcccggattggtgctgaccattgaagtggagcccgatgatgatgagggaacgcttgcacggatggcgcatcgtgtgctcacgctacgctgtttcgattgtccgcagggcagactgtcgctgtctgttcaggagatgcgcggcgagattctgtcgattccacagccgctcaccatactgcggcgtcccgcggtcggcaggccgcagctagtatctcatgatgccgatgatgagcatgcgaatctgatatggatccggttcaatgaagcgctgcggtcgggcgatgttcccgtgcgcgaaggtcggttcggcgcccgcatgcgcgtcggttccgtggcggacggtcccttccaattcacgttgcaggaatgaccgcaacgcttgccagcatggattccaaaacgttgatcaccctttcccgaagtataaatgcgatattacgaacgtagaagattccgctatacggaatgtgctcccgtatggcatgatctagtgtatagataacagcatgacattcgcactacaattgcttgtagctgttacctgcatatgattaggagcaaccatgagcgacactgcgacgattagtttccgcacggacccagcgatcaagcgagaggcaaaggaactgtatgccgatatgggcatggatctgtcaacggcaatcaacatctttctgcgccaatcaatccgcgaaaacggcatgcctttcaagatcaccagggacaatccgtccagcattgaggcacgccgccaagcggaaacccatgacggagaatccttcaccagcacggatgcgttgatgaaggatctgctggatgcttaaatcggtctttcgtacaacacagttcaagaaggatttcaaggttctgctcaaaaaacactatagtcccgataagcttaaacaagccattgacgcactcatggctcagaacaagcaactactcagcacaaaataccgcgaccatccgctgactggaaattggaaaggatatcgcgaaatccatatcgagggtgactggcttgtgatttatcgcgtggaaaagcaggaactgcaactcgtgctcacacggaccgggtcgcatgatgatctgttctagcgattacccgattaccgactacttgaacaggtcgaacaggctgaacgtggtcttcttgtagattgtgttgtacagcttgcgcttgggatgcaaccaccccatgcccttcttgccatagccgggaatcaacgctttcttgaccgcgcgggtgacacggcctttcgtacgcgcggacaggctcttcttccagctgggttttctcattccgtatttcatggcggcctcttttcggacggttatgtatcgctcaacattgcatacgcatcggctggataaactcaaagatgaacatagacgaacatcaagtacagtcaagcaattacttactggcagcttctttgagagcggcctgcagttcaggatcaacggcgaataaatacaatccatgcacaccgcgtttgagcagaacattcagttcattacgcagattggattgcgcgtagctgattgagccgttcctcttactcactgcacgtttattacaacttgccttttcgttaaaaacgattttcccttcgcgataggtaaccgacggtccaatgatgacacctacataattaagatcaaacccttgaatagagaacgttgatcctacttcattaagcgtatgcggactttccgcccagacagcatctagggaaagacccttatcccctaccttgatttcgtaattccatggatgacagaaataatcagctcttccatcaggattaaacgcatcgtatcctctctgcattcccggagccgctcccatgcgccatactccctgtgcatcgcgatgcatctcaacattccaaagaccatcgggactggaatcgttgattttgccgcccttatactcccaatcatacgtagcaaccacacgagaaagcccgcatccgtcaacgcctgaagcctttagatatgccttctcctttatggctttaaacagtccaaccggcgaatcgaatactctgatttcaaatggctcgcggacatattcgcctgtttttctatccttctccccaatgtcttgaggaatacgacctattctcttaccatcagcgaaatcatcaatccatcgaatcgtcgcatcatccgcagcaatgcgaaattgcctatgcaagcatatgcgacttagcaaatagtgatcaccccacatattcaatggcacaaatcgctccaactgcccgctatagccagcagcagttttttgcacgtcgctttctgcttgctgcggaaagagcatgtcctgatcctcttcgctccaacgctgcgaagtttgcaaaatctgattcgggtcgaataccgcaataaccactttcgcacgacgcaataaatcgtgcagcatgttcttgcccgagtatccttggtcaccctgcgtcaacagcagatgagcttcatcaacaagcactacatcggctttgcctcggggcttgtccgcaatagctcgattacttgttgttttctcactaaatcgattgatgaattgactcggtttaagagccacctcgccaaaatgtttctgcaaacctaatttgcttgcaatttggttatagacgtgcatttgctggttatggttgacaaggatatatgcttttctgcgatcttccttactgatttttagtgatgaatcggtttccagaatatcttcatcatcttcgtcattgatgcgcccattgatatccatttctgttgctatgcgataaaacaggtgacttagcaaaaccgtctttccagtacccgcaacgccttgcacgaaaatcagtctcgataaaccggaatcggctgaatcaccagagccggcaagagcttcagaaagcgcgtccataatcgattcctccgcagctatctgatcatcactcaattggtgaaaaggcgatgctttaaaaagtgcagaatcgcgaataatctcctcagccggaaatagttccggatcctgtcggttcagttccatccagatgtccgagaaaatctggttgaattcatcctgcgtatagtagtcgccttgcgcattggtgcgacgattgttcaaattcttgactgcatcagagccaagaagataatgcatcagccggttctccacgtccaaagtcagagatttgttgaaatgcggattgccaatgacatactgccacacagaactagcgtcgctctgcaaattttcttgaaattccttccaatcaactctcgttttgggatcttccctcagatgctgcattgttcgactacgaatattattcgtctctcccacatacaccgtatattcgggacgtaaagtatgctgattcctcttctttgaatgaaccacatacaccgttggataatcgaaaatatagtgcaaagtctcacgctcaacagcagataatgtctcgtatcccaattgctcgacaaaggctttctctatttctgctttgtcatcaatgctctgatacggcaaatctataatgattggctttggaagcgcgctcttcgtcatatgctcattatgcacccgagagaggccttcagaaaagattcgacatacacttacgtattatgatttccgattcaagcatcaacgcgatccgtaaattcgtagcagagcgggactggtctcaattccacactcccggcaatcttgccaaatctatcagcattgaggccgcagaacttctggaatgttttcaatggaacgacgagccacaagacagcaatatcgaacatattcatgaggaaatagcagatgtactcatgtattgcatcatgctatctgacaaatttggatttgaccttgacgagataatcctcgataagcttgcgaagaatgctcagagatatccggttgaatttgcctacggcaatagtaataaagccaattgacgctgtatatacgttcgtagataacacctgaatagttgcacgctgcccaatctgcattcactatgagccacgttttcttcgcgagcgcgacaggggttccaacagatagaacctgcatctaggttagtaatccgtcagaatgcgttcgcgcactttcatgcattctcgcgtaccaacatcttgattacatattctgttcatgtacggcacgttcacttgcccagggatgtacagttctgtgtatcagcgcccacccaaggctacgtttacgtcctgaaacgcggtgggtctcttcttctctgtaacaacggtagagcattccttgagacacgctcgaatcgaccaagcgaaccaactatgctatcgtaactaataacagtagcctccaagcctcttaacaatgctcaaatccgggggctcttttttttatcaagtcgcacaaggatacgccatgacgaagcagccaaaaacaatacaggaaatgatgacgcttttagtcgaagaacgcggcttggatatcaccggattctccgatttcagcaccgtcctccttgattgcaactattacagattgtccggctacttccgagcctttcagattgatccttctcatggcaataatcgctttcgaaatggaacgcacattaaggatttcatgattccttatttgatggatgaacagctacgtctactcatccttcgtggaacatcatccttagaacaaacgcttcgggcccatttcgcttactaccttgctcaaaacggaggagcctactcctacacggaactcagctcatataagacaatcaaatattccgatggcaccgaagccagagaagttctaattgagaacattcacaaatggcttgaacgttccagcgaagtatgcattcgccattatcggaataacaacgagcctattcccatatgggcggcggtcgaggcgatgccctttgacactctctcaaaaatgatttcattgcataccaacacaacagctgttgacgaactcaatcagtcgctttctctagggaaaaatcgtcaacgtgctgcgcaaatcattcacagcatggtgtatctacgcaacatttgctcgcaccattgccgtctttggaacagggagattgtccttcctcccccagtccttgatgccacagctgagcgctatggctcatatgcttatgaagaccgctccgtctggaaatctcttattgttctcatggatttaatcgatggaataaaaaagaattccacatattcatccatgcttataaaacaagctgagtcgaatgataactatttctggggattatgtcatcctaaacggtggcattagacacagccacctgaccaatatttgtcagctccccgaatctcattgtcatgagaaagcccagtatcgaagaaaatgataaatatgacacacctcagataatgcggaacatcggattggaggttatggaattgacgaatatcacacgctgcatttcagccagtctgtcctgcagttcagtggtaatgtatcgttttttcaccaagtcgatctcccgaccaaaagtcgatgcaagatcatcacgcaaagcccactcatcaatcattggattggcggtgtcgtcaaactgatagatgaaatcgatatccgaatccgcatgcccctcccctcgagccatggaaccgaacaggtacagttcattgacatgatgccgcagcgcgataggacgagcaatctccgctatctgctgcggcatagcgacccgcgaaatcacatcaagcgctttcatagagctagaacatgtgcaagtttcttttccacctggcgcatgacatcatcttccaaaattccaatgcgttggcccaatgccgaagtgtgcactgcaagaatcttctccgtcatcacccaacttattttaatcaaaccattctgcgcagtaggaggaactttaacccgggtagtcatatcatccgacgtaaaagaaatcatcaggcataccacggtagagtcaaaaccctcgatttcgtcattctgcacaacgacaaccggccgaggctttctcgcgtaaccatcagccagcacagtccagatctcacccctcctcatcagcgatcatcctcatcgacaaatcattagcgaaatcagaagcctcccgttcattctcgaacggttccgcaacctgtcgaactcgtacctggtatgggaacccctgatattcattaaaggacgagacgaacatacgcagcgcatcagccgtggaaagaccgagcttctttgtcgtttcacggaactcttccgcctgatcatcatcaacacgtgtcgcaagctgaactaccattgccactccaatcactattttttatcattttatatcttattgacatgttttgctaatattccatatctggattactaaaactctagattcacagaatttgcaatgtggcagccgaacgccaaaacccgaagcatgagcgttggaattccaacgctcatactcgccataatcgccaaacggtgccacaaacaagccaacaagcgtttttggggagagtcattcgcgtgatgttgcgctctatcattgataaaaacatccagcaaccgcataccgtaaggaatcacatgcgctatttcacttcggacacgcatttcggccaccctctggtcaccgcactgcgcggattcctgaacaatggcaggctccgcaccgaataccgtgatgtctggcaggcgcagggtcgcgccgccgcgcacgcatggatcaacaatacgtacgcgacaatcagacgtcgttcaaagcaatctgcgacatcacacgccatgagaacaccatcatcggcaacatcaacgagaccgtcgggcgtgatgacgagctatggattctcggcgatctctcctaccgttgcaccgtcgagcacacgctcgactgtctacgccgcatcaactgccgccatctgcacctgatcatcggcaaccacgaccgcaacttccgtctccgctccaatgacgcgctatacgaggacgtgttcgagaccatcgatgactaccgcgagatcgacatggagcttcccgttctcgacggctccggcaagccgacggccgcaaccgcacggcagaccataggcatgagccacttccccaggctctcggcattggccgaagaacacggcaactggccggaaaactggaacaagttcgccgatgtggcgccgaccaccgaaggttggctgctctatggtcatacgcatcaaggcattcccgacggcaccgatccgctcagcgtgaatgtggggcttgatgcgtgggatttcgagcccgtcagcgagcagcagctcctcgcctggttcacattccggcacgccgaccaatcaaagtaaattcccccgagcatgcgtcatcgtccggaggcgaagcgggtgaggactcccgacttggccaaggctcggtagaggacccacgaaccgaacccggcgaatacgaccgcgctcagcaactcgcatgccatgccgatgagtccacgcggactgaagaacgaaaacgcctggtaatagaagaacaacaggtagaagttgtatacaatgccgatcgccacggccgacagcaacgtgacgccaagcgtccaacgacggtagcggaacaccgcgaacaccgcttcggcggcaagcgcctgcacaagcgcgatcaccaccaggctcacactgtatttcgtaccaagcaccacttcgacgaacgaggcgaccaacagcacgtaggccgacgcgcccggtttgcgtacgatcagcaagctcagtgtggcggggaaatagaacaatgcgtgcagcagtgccgcggagcctggaagtatcagggtcagtaaaggaaacaagccataggacatgccatcgaacacccagaacatcacgccggacattacgccgacggccgctccgacggcgatgtcgacgacacgccatttcagggatctgcgtgtttcctccgttgtttgcggagcatgcttcagcatcgggatgcgtggtttttgggtaatcgtttcagaggatggctctgccatgatgaatccttgccttggttgacgccgcgcaccgtgagttggagatcgcggcggtcgccgtgggccgttcctcgacctgcgcggcccgggcaggaacgacgcgcgccattatacggcctattgttgccgaaaatgttccatgctccgagttccggccgttttcgctcctcaacgcataggaaattcgccgctcgctggcatgcatgatgccatgtgggaaagccaagaagccgcgcatccagtccaaaatgtgtggcttcttgcttgagcaagcactgtttcagtggggaatgacttcagcaacgtccttcgtacaggaagtaagacatgggctcgtcatccgccaacaggcttgtcgtgccgaccgtcaacccgctggacgagctgtctgtcggattcggccgcgaggaaccatcgttccggtcatcacgttcggctttgcggattagtccgcgatggtcgtagaagccgacatcgcatgtgctgtcggtgaacaggaagtattcgcgcaggccggcgtcatggaatacgccaagcatatggttgaacagtctgcgccccactcccatgcctcgtgcggccggggaaacgacgaacagcaccacttcggcctcgtactccttgcccgcgtcatgtttcaacgcctcgtcggcctgcagaatggccagctgcgcaagcagaccgtgacgtccctcgtggcttgccagcaacggcaacgtgaggcaatgtcggcgcagcatatggcgtgtccgctgccgaccggtgatatccgaacgcagcgatccgagaatcacgccgagcacctgcccattaagttcggcaacgtatgctttggtggtgcgggccaggcaatcctgcatgtcgattgcggcaagtcgatgcatgttgcgcagacgggtcgccttgcgtagttcggcgcgatgcttgtctgggcctgacgtctgtccgacctcgtcatgcgtgttgtgtgaatcgttgccatcgtcgtaccatgcgagccgtatcagctcttccaaagcgggaaaatcggtgcgacgcaacggacggatggtaggtgtttcacaagtcatgcaaccatcctatacctcgcccctatcgaagatgcgctcagggcaaatgcgaaagaatcgttcgcattcgggcacggtacggcactctgcgggaatgatttcattacgctgatacacggtatgaagtgatgtaggacgatgacgacacgaggcttgcgatgaagatgatgctgcgacggctggcgattgtggtgtgtgttgcgctggcgttgctgtcggcggcctacgcgttcgccgtgttgaggacgcattcgggcacgggattttggaaggtctggctggttctcgccgttgttttcgcattgctggcgattggcatcgcatgtcactggtgggtggcgcttccccggatcatcaggggcgccatcatcgctgtggtggccatcggcattgtcgcgttttgcacaatagagggttgcatcatcggcaatatgaacgctcagggcgagccggatcttgattatgtgattgtgcttggcgcgcaggtgcgcgagtcaggccccagcaaagcgttgcgctatcggctggacagaaccatcgattatctggaggagaatccggataccatctgcattgtttccggcggtcagggccataacgagccgttcgccgaagcgcagggcatggccgattatctgcagaagcatgggattgcggaaaaccgcatcatccaggagtccaagtcggaatccactatggagaacatcgtcaacagcaagaagctcatgcggcaggagaacgcttcggtcggtatcgtcaccaatgatttccacatgttccgtgccttgcagatcgcacatgccaatggtctgaagcaggcgcagggcatcgcgacaagttccccgaaggacatgctggtcaacaatatggtccgtgagttcttcgccgaaatcaaattcctgttctcataagcgccaatcagcgtttcagtgcccgtcgtcactacgcaagatgcgtgccgcgcggcagccattccttcttcggcagggttgcgaatgtgggccattgttccgcagcggcaccggccgcgtccagccgacgttggaagccgggccatttcgggtcggcttccaacagtcgtccgagcagtatggcggtggcgtgagcgtcgcttaacgcgctatgcgcatcctcgttggcaatgccgaaatactcgcagcagtcggcgagcttgccccgtccgatcagggaacgcgacagtttcatcgtgcacagcatggtgctttgatcgaccggaatggaagctcccatacgcgagtattccgcaagtaggaaccgtgaatcgaacgacacgttgtgtgccacgaacacgcgtccggcgagcaggtcgcgcagctcatgcgcgataccttcgaaatcgggagcatgcagcagttcgcgtgcggtaatgtgatgcacccatgaggcgccgacactgcgatcgacatgaatcagcgtctcatgctcgtcttcgagcgtaccgtccggagccacatgcaccaggccgatttcgatggcccggtcgccttttgcgggacttaaacccgtggtttcgaagtcgactaccgcatatccttgagaattcatcacacctgccagtatataggtccggttaaggtccggttagctatctctgctgctcgtcagacgttcgccgaagcggcatgcgctatggttcggatatcgtctggagtcgttcggcagcatcctccaatgagtcgggctcccgcgtcgatccattgcggtaccagatgggcgaaggccggttcggaaccggtgggattaggcgaccaggttttggttttcggatcgtagatgtcaccgttgttcggatacacgatgatcggcttgtccgtaacctgtcggatggcccgaattgctggaagcacacgatcacgacggccaaaccggacacggacaccaataccagataaaccgtggaagcggccacgacgctggacagcaatgccagcagaccgccgatcatgctcaggcgaagcgcggtcatcggcactccctgctattggttttggcgatgttgtgtgggatcatgtcttcgttcgccaaggaccacagcatgcgtgtggaggcgtacaacccggagttcgcagccgaaagaatcgcggtgagcacaacgaagttcatcgcgtcgccggcgaaaggcagaccaatggagttgaacaccagtacgaaggggctttcgtccacaccggcgtcctgccaaggaatcagcgaagccatgaccacgatggaaccgatgaagaagatgacgagacggaacagggtggtgtggctcgccttcgggatggctttgtcaggatctttggtctcgccggccgttacgccgatcagctcggtgccggagaaggcgaagttcaccgtcagcatggtggtgaacaccggcatccacccgttggggaacaatccgtccttcacgaagttctcgaatagcggcgcatggtcatacccttgaatcggcagcacgccgaacaccgcgcaaccgcctatgaggatgaacagcacgatggccgccactttgatgaaagagaaccagaattcggtttccgcgaagaagcgcacggaaagcgcgttcgaggtgaagatcaccacgatgaacagggcactccaaatccataccggcgtgccggggaaccatttgcgcagataagtccggcagcggtgaattcggaccccaatgcgaccgtccaggtcagccaatacaggatcgcgacggtgaagcctgttccaggaccgatgaatttggtcgcatacacatggaatgagccggtttccggcatggcgacggaaagctcgccgaggctgagcatgaccagatacacaatcaccgcgccgatagcgtaggcgatgaccgtgcccaatgggcccgcctggttgtgatggtgtagccggagctgaggaacagtcccgtacctatcacgcctcccagtgaaatcatgcggaggtggcgtacctccatcttgcgtttcaaatcggtatgcgtggtcttcgcagggttctcccgcgtagcgtccttcatttgattctcccctctatcgtcggcggaacatgtcgccgacgcctgattcataatattggttgcatcattgaggagagtcgaacctccagtatttgagagaaaaacgaagaaggctggaatcatcaaaggattccagccttctttacgcgtttgtcagcgctttagcctatcggcggcagcgattcactcggcgtccttgtcggcggcgagtgaatcggccacagcggcggctgcggaagcggcttcaacgctctcggactcttcgtcttcagcggcttcgccgaggaaggcgctcaggtccagggtctcgccctcggacttgaaggtcacggcgcgcatgccggagagcaggcccttggagcggccgacttcctgcacggcggaaccgatctggccgttgcggatgatggcctggatgaaggcgttcgggtccatgccgtactgctgggcgatggaggcgaggaagttgaagacctcaccctgggagaccttgacgtccatggtctcggcgagcacgtcgagcaccatctggtcgcgcagttccttctccacggtttcttcggcttcggccttctgctccttggtggccttggacggatccgcggtcacgttcttgagctgctgctcgaccatttcggccttgacgcccttcggcaccggaatctcgaggccatcctcgagcttggcgatgaacgcgtcacgagcggcggtggcctgacggctttcggcgtcctgagcggcgaccttcttcaggtcttccttcagctcgtcgagggtgtcgaactcggaggcttcggaagcgaagtcgtcatcgagttccggcagttcctcggccttgacggagttgaccttgaccttgatcagggccttctcgccttcgtgcttgccggcctcgagggtgccttcgaagctggtttcctcaccggcggacaggccttcgagggcctcatccaggccgtcgagcatggtggcggagccgagctcgtagctcacgccctcttgggagtcgacggtttcgccgttgatttcggcgttgaggtcgatgttggcgtagtcacccttggcggccggacggtcgacgctcacgagggtgccgaaacgctggcgcagggcttccagacggttgttgatgtcctcatcggtgacctcggccttggcgacctcgatctccatgccgtcaagagccggcagttcgatgtccgggcgacgctcaacggtggcgacgaacttcagcttggtctcatccttggcggattccggcacgtcctgaacgtcgatctccggctgggccatcgggtggatcttcttggtttcaagagccttggaatacagctccggcacgccgttgttcacagcttcgccggcgacggcaccgaagccgatacgctggtcgatgatcttgccgggcacgtggcccttacggaagccaggcacgttgacctgctttgcgatttccttgcgagcctcgtcgagatacgggttgaactcctccgggtcgacggtgacggtgagcttcaccttggtcggctcaagattcctgacgctgattttcacgcttgcgctcctgaaaaatacggttcttcatatttctgccgttaggcaacctctatataatagcgcgacttacggactctgcaactagggagacctgccagtcgcgtgcgccctgttcgctgaggaatcgcgcgacgtcacgcttacgaggttcgtccgtccagcacaggttacgcaaatactgcggtttgatgacgatttccacaggcgtgcgcgtgtcctccgctatctgggagaccgccttgcgcaccctgttgagcacttgcagacgttccggataccgttccttccacacgcgaatcgatttgggagccgaggctgactgcgattcatgacgccgcgcggcgccgccgtccacgtccggccattcgcttggcggcagggcgagcgcgtcctggatgatgttcttccacatgctcggtttgattttgcgttgaatcggcgcgtaccgttcgaacatcttgtcctgttcggaatcggtatggatgcgcacacgttcgttgatggagcgaatcgaacggaattgcgcagcgttgtgtggtttgcgtttcgccacttcgataatggagctgtcggacaatagcagggtcggcgcgatgtcgtattcgcgcgcgagttcgtcgcgtcgggtccatagcgcgcggacgatggccagcgcctgccggtcacgcatgacttcagtgatgtgcgagacatgcatccagggaatcagatgctccttgcgtggtcccagaccttctttgagcgcgtaatcgaactcttcctgagcccattccatcttgccttggcgtttgagttcggcgcgcatcttcgtttcaagctcgatgagcagttcgacgtccaacgccgcgtaatttcgccagtcgcggggcaacggacgatacgaccagtcagccgcagaatgttctttggcaagggtcagtccaagaaaatgctcggtgacagcggcgagtccgaatcgtttcaatcccagcagacgcgcggcgatttccgtgtcgaacagccgttgcggttccatgccgagttcgtcgaatcccggaagatcctgcagggaatcatgcagaatccataccgcatctccgacggcacggttgaaatcgttccaatccgccccggccgcggcgagcgcctgcggatcgagcaggccgatgccggctccgtcgcgtttgaactgcaccaaccagtcctcatgcccataccggaagccggatgcgcgttccgcgtccgcggcaagggagccatgtgaggaagccagctcactgcaatagtcacggaatgccggcaacgtgtcgatcacgttgggcacgccttcgcgcggttccgccagcagcttcggctcatcagtcaacggggttttcctcctcggattgcgtcatggaccggaggaacgacgcccactgtccgacttgggagccggcgtcaaggcctccatcggcatagtctagtggagtccaagacacccggatctcgcagcccaccctgggcacgtcggggtcatggccgaatgctgtgttttgggtgactgtgacggtgccggatacatgttcggaatcgtttggattgagacgttccatcatcatgtcccagtacatgcccggagtcaggcagtcgtcctccttgtcgggcagtggcagggatgcgaaagccacgcaacgccagtgggagtgccagtcctctcggaatttgagcgagtacaggatcatgatccagccggatgcgtatgtttcatcgcattccaacgcgacgccgatgccgaagttcgccatggaattgggcaccggaatctcacggtatgtcatgcctttcaaacgccgcatacggtccacggaaagcaccgcgttccagacttggtcgggaacgccctgcggtcgcataagcatggtctgtggggcttcgccgcccatatccgcttccttgccatcggcgcgcgccacgttgcgcgcatctcgtggaaaatcaaagatgtctgccatagttcaaggctacgacagagaagggcatttcgtagtatttcgaaccactttgccacgcgtcgaatgtgaagatttttcagcgtatgaataaattggtccatgccatcgattcagtcggtggcatggaccgatatgaggcgttccgcatatccagcgaatatggggaagccattgagaggacgggcgtttagtacacggtgaagccgtgcgactggaactgctcgaccacacgttgtttcattgccgcggacgggcctttctggtcctccaacgggtatgggatgttcagcatgtgccacttcggacggccaagctggtggaagggcaatacgtcgatatgttccaacgcgtcgccgaaggtctcgcagatcttcgccacgttctcgacgttttcttcggaggatgtgaggcccggcacgagcacgaaacgcacccagatcttcttgcctgccttggccagacgctgtccgaagtcgatggtcggctgcaggatgccgccggtcaccttatggtaggtctcctcatcgccggatttgacgtcaagcaggcacaggtcgatgtcatccaccatgtcatcggtgtagctcgccccgaggaatccggacgtgtcgaggcaggtatgcactcccatctgcttggcggcatggaacacgcgtgacacgaaagccggctgcatcatggattcgccgccggagaaagtgatgccgccgccggtggccttgaataaatcggcataccgctcgattttcttgaccatggcttcgtagtagacgggcttgccgtcgcgcatcttccaagtatccggattctggcagtactggcagcgcagagggcatccgctcatgaacacggtcattctggtgccaggaccatccacggaagtgttgatgtcccacgagtgcacgaaaccgatatcgccgcttttcaacgccttgatgcggtcgagacggtccaagccgattggcgattcgaatccggacaggcctcccatcagcgtctgattgacgtagtccttggaatccctcagcatgtgtctggtcgtggaacggaaaatatgttcagacatcaatgtcccctttcatctgccatcccaatcatatgggaaaacgatatgggaaaagcgaaagggacgaagccacgagctccgtcccttcgcattaccgtcgtttcatgcggcggctttcatttggctgattgtgccgttcagtcgacgacagcgccctggtggaacgtacgggagatcacgtcgagctgctgttccttggtgagcttgacgaagttcaccgcgtagccggagacgcgcacggtcaggtgcgggtacttctccggatgctcgacggcatcctcgagctgctccttgcgcagcacgttgatgttggcgtggtacaggccgtggccgttgccggcgtccaggatgccaacgaggttgccgatacgctcttcctcgtcgcggcccagaccatcaggggtgatggtgttggtcagcgagatgccgtcaagagcgtcgttgtagtcgatcttgccgacggagaacatggacggcagcatgccgtgggagtccatgccgttctccgggttggcgcccggagcgtacggggtgcccttcttgtggccggacgggaaggcgccggtggccttgccgtattccacattggaggtgatggtcaggatggactgggtcgggacggcgtcgcggtacaccggcagacgcttgacctggcccatgacggtggagacgacccacttggcgatgtcgtcggcacggtcatcatcgttgccgtacagcgggaagtcgccttcggtgcggtagccgacgatcagatcgtcatcggcgccttcgacgtactcgttctcgtggcccggcgtggtcttggcgtccttgttgtagatcgggtagaccttggcgtacttgcatgcggacagggagtcggccgcgatcgacaggccggacatgccgcagccgagggtgcggtacacttccttgtcgtgcagagccatctcgatggactcgtaagcgtacttatcatgcatgtaatggatgatgttcagagccatcacataggtctcggacagccattcgagggccttctcgtagttggccttgaccttctcgtaatccagcgtgccatcggcttccggcttgatcgggtcgatgacgcccttgtcgatgacctgcatgccggtcatctcgtcgcgtccgccgttgatggcgtacagcagggccttggcggagttcacacgggcggcgaagaactgcatctgcttgcccacgcgcatcggggagacgcagcatgcgatggcggcgtcgtcgccccagtgggagcggatttccttatcggactcgtactggatggccgaggtgtcgatggagattcgggcgcagaagcgcttgtaggcttccggcagcttcggatcccagaagatggtgatgttcggctccgggccaggtccgaggtgctcgagggtcagggtgttgagcagacggaacgaggtcttggtgaccatggtacggccgtcgtcgccgaagccggcgtcggaccaagtcgcccagtacggatcgccggagaagatcgcgtcgtaatccttggtgcgcaggaagcgcacgatgcgcagcttcatgaccaggttatcgatgatctcctgtgcgtcggtctcggtgatcttgccggccttcaggtcgcgctcgaagtagacgtcgaagaaggtggagacacggccgaaggacatggcggcgccgtcctggctcttgacggaggcgaggtagcccatgtaggtccactgcacggcttcctgtgcggtctgtgccgggcgggacaggtcgaggccgtactcgttgccgaggttgatcagctgcttcagggccttgatctgctcgtcatgctcctcacggaagcggatccagtgctcgatctccggctcggtgaagtcgttgcggtacgggatggagtccttgtcgcgctgcttgaacttgatcagcgcgttcacgccgtacagggccacacgacggtaatcgccgatgatgcggccacggccgtaggcatccggcaggccggtgaggatcttgttgtggcgagctaccttgatctgcttggtgtagacgccgaagacgccgtcgttgtgggtcttgcggtacttggtgaagatcttcttgatctccggatcgggctccttgccggcttccttgatggcctgctcgaccatacgccagccgccgttcggcatcatggcgcgcttgcacggcacatcggtctgcagaccgacaatcacattgtcgacttccggggaatcgatgtagccggccgggaaggcgtcgatgcccgccggggtgtgggtgtccacgtcgtagacgcgctgcttgcgctccacggacagatagttgtcgtccagatacttccacaggtgcttggtcttgtcggtggcgtcagccaggaaggactcgtcgccctcatatggcgtgtagttcttctggatgaagtcgcggacatcaatgtccttctgccagttgccctcggtgaagccttcccaagccttagcctcaagttcctcctgggagaccgccgttgcatcaactgctgccatttccactccttactgggtgtcggttggcgacgcatcgttacgccgtcgctacttcacgattgtaacggcaatcatctgcgaaaagcctgaaaaccactcccgaaattagtgacataaatcacaatcgggcgtggttttcatatggaattcacttttcggaagatgccgagccgtccgctgaccagcgtttccattcgcggtcctgttcctcccatttgagattgcgttcctgcacgatcttccacgcgtcgagcgcgtcctcacgggttctgtacggccccatgcggtggcttgccggggaaatcatgcccaattccggctgctcggtgacggtgttgaaataccactgcttttccatatcggcttccttcggctctcgatgttctacttgcgatcgccgattattcgcggaatgcgttggtgaccggcagacggcgatcacgtccaaacgccagcgccgtcaccttcggtcccagcggatactggcgacgcttccattcggcgcggtcgaccaatcgcatgaccgtgtcgacggtcgcctcgtcgaagccgtcggccagcaggtcggcgcggccatgagcatgctcgatgtacatcgccaatacttggtcgagcagcgcgtattccggcagtgaatcggaatccttctgccctgggcgcaattcggcggacggcgccttctcgatcgagttgacggggatcatcacaccatccggcagcgcagtgcccgcgctcccctgctcgttgccgacgacatgcagaccgccgatgcccatgccggcggcggcagccttgttgcgccagcgggagatctcccacacgcgggtcttgagcaggtccttgatcggcgcatagccgccgaccgcatcgccgtagatcgtggaatagccgcatgccagttcggacttgttgccggtggccacggccagcagtcctttggagttcgagtaggccatgacgatgacgccgcggatgcgcgcctgcaggttctcggcggcgacgccttccagttccagctggttttggaaggagacgaacagcggctcgatgggctggatgtcataatgcgcgccgatattgcgcgccagatcagctgcatcgtccttggatccgtcggacgaatacatgctcggcatggagatgccgtacacgttctcgccgcccaccgcgtcggccgccatggcagccacgagcgcggaatcgatgccgccggacaggcccaggcacacgcccttgaaatggttcttggccatgtaatccttcagacccagcacgcaggcggtgtacacttcctcgtccggatcgggcttggctgcgatcgtaccgaccttctgatgctccgcggacgtgtccaagtcgaagaagctcagatcctccatgaacatcggcgagcactcaagcagggtgccgttggtgtccacaacgaagctgccgccgtcgaagacgaggtcgtcctggccgcccacttggttcaggtagatcatcggggcgttcacttcggccgcgcggcgcaccgcgaggtcgagacgggtgtcggttttgccttcctcgtatggcgaaccgttcatggtcagcagcaggtcgatgttctccttggcgagttcggccacagggccgccgtcctgccagatgtcctcgcagatggccacgccgatgcgcgcgccgttcacgtcgagcaccatggatttgttgccggggctgaagatgcggaattcgtcgaacacgccgtaattgggcaggaaatgcttgtcgtagccggcccagacaacgccgtcgtgcaggacgacgagtcggttgcgcggtttggaggtttcacggtcggtgcctacagtgccgaccaccacatatagttcgccgagactgtcggatgccagttcggtggcgagccagttggctttgtcccatgcggctttgcggaaggtggcacgcagtgcgaggtcttcgatggggtatccggtcaatgtcatttccgggaacacgacgacttgcgcgccctgccgagcggcgagatgcgcgtatcgcatgaccttgtcggcgttggaatcaaggtctccgacgcaggtgtcgatttgggcgagtgcgaagcgaatgtctgtcatagctgcctaacctaccgttgatttgttggatatgttgtgtttttacgattatgaaaattacgattacggcgttccgcacgtggcgtcacgacagttcgttgagcaccgtcagcgccgcgttggcgtagaattccacgccggcttgcagcgattcgtcaagaccgacgaaatgcgggctgtgccaatccgggcagccttcctcgccgttagatccgatgaaggcgaacacaggcatggtgacgggcatgaaatcgcagaagtcctcccccgccatcgacgggtggatgggttcgagctgggcgtaatcgcgcacgttgtcggcgactatcttggaaagttccgtatcggagacgagcgggttctggaaatcgtcccaatcgatgtcggcggtgatgccataaccggccgcaatggactggacctgttgcttgaagcgtttctccaccagttcaccgtcggacttgtggaagtatcgtacggtgccttggaagctcgccttgtcgggtacgacgttccacacgtggccgccgtgcatctcggtgatggacagtacgagcggatggaacggcgagacgttacggctcacgatggtctgcaatgcgaggaccatggtggcgagcgcctcgatcgggccggtgcccttgtgcggatagccggcgtgtgtgccggtggcgtgcagggttacatggaatttcacgcagccggccatcatcggttcggggccgacggcgatctgtccgggcgcgtagttcgggttgttgtgcgcgccgatggcggctgatacgtcggcgagcagtcccgcgtcgaccatggccttcgcgccgaggccaagttcctcggcgggctggaacagcagtttaatggagcccttgatgcgcttgcgatgcttggcgagccagaacgccgcgccgagcatgtacgacatgtgcaggtcgtggccgcagccgtgcatcacgccgtcgttgacggatgagaacggcagaccggtgtcttcctggatgggcagaccatcgatgtcggcgcgcaatgcgatgcgtggtcccggctggtcgccgcggatcagtccgaccacgccggtttcgagcggattgttgagcacttcgatgtcgtgtgcgcgcagcagcttctcaatgtaggcgctggtctcgtattccttgaagctgcgttcggggtgcgcatgcagatagtgcctgatttcgatgatctccggcgtgatttcgatatgttcgctcatggttgacgattgtaggcacatccggccgtttttcctattttcgtggtcgtgttccgtgccgtgcacgacgttttcgcatatatcctcgtaagctggataccgggtttgacatggtttttcatggaggcagcatggctcaggacatcaagacggcgtttttcgacatcgacggcacgttgacgagtttcgtcacgcatgtggtgccgcagtccaccgtcgacgcgttgcatgcattgcagcgcaatggcgtgaaggtgttcatctgttcgggccgcgcaccctcctacatgggcgtggtgcttgataccattcccgtcacgttcgacggcatcgtgggacttaacggccagtattgcaccacgcgcgacggtctcgactaccggcatccgatcgaccaggccgacgtgaagctgatcaccgactggcttgaaacgcatgccgacgtggtcgccaactatgcggaaagcgactacgggtatttcaatcgcacgaacgccgcattggaacgcacgtggaacagtctcggcaagaccgcgccgaaaatcgacgtgcatgatccgcgcgaacgcatcgcaaaccattccacgttccaaatcagcccgtatgtggacgagacgatggaagccgaaatcgccagcatgtgcggcaacgtgcgcggcgtcagatggcatcccgctttcaccgatctgattcccgccgatggaggcaaggcggttggtatgcaggtgatgctggagcatttcggttggacgaaagacaatgcgatcgcattcggcgacggcggcaacgatgtggacatgctacgattcgcgggaatcggcgtggcaatgggcaacgccaccgacgagccgaaagcggcggccgattacgtcaccgacagcgtcgacgacgccggcatagccaacgcgcttaagcatttcggcgttatatgacggtgtttccgcaagattatttacgattcacaagtctgtttttcgcatattcctgcggtttttgcgccctttataaataattccgataagcgcgcgacgtgttgccgtcacaggttcctctatattggtcaatcgttggcccgcaaccgcagtaagcgtccgggccgtgtagcgaaattgagagagaggaactcaaccatgcgtaacaagaagattctcggcgcactgctcgccgtcaccacgctcgcgaccttcggcctggcaggctgcggcaattccggttccaacggtgccgcctccaaggaggacgacaagaccatcaccgtggccgcctccccgaccccgcacgcggagattctgaacaaggcggtcaaaccgctcgtcgagaaggacggctacaagctggtcgtcaaggagttcaccgactacgtgcagccgaacaccgccaccgaggatggcgaggttgacgccaactacttccagcacaagccgtacctcgacaacttcaacaaggagaagggcacgcatctggtgtccgtggagggcatccatttcgagccgttcggcctgtacccgggcaagaccaaggagctgaaggatcttcaggacggcgccaccgtggccgtaccgaatgatgccaccaacgaggcccgcgcgcttctgctgctgcaggatgccggcctgatcaagctgaaggatccgaaggacatcaacgccacgccgaaggacatcacctccaatccgaagaacctgaagttcaaggagcttgaggccgccgtcgtgccgaccgtcatcaaggatgtcgacatcgcagccctgaacggcaactacgccatccaggccggcttcgacccgaccaaggacacgctagccaccgagaaggccgacggtctggccgcgaagacctaccagaacatcctcgtggtgaaggaaggcaatgagaacaccgccaagaccaaggagctcaagaaggctttgaagtccgacgaggtgcgtgactacatcaacaagaactacaagggcgctgtcgttccggtcttctaagacccgtttcggcagtaggagttcaatgccgcaggtatactaccctgcggcattcttgttatggaacacgattaggaacaggacattatgacgattcagatcgaccatctgcacaaaagctacggcagtggcgccgaagcgcatgaggtgctgcacgacattaacctgaccatcgattcgggtgaggtcttcggcattctcggctcgtccggcgcgggcaaatcgacattggtgcgttgcatcaacctgctggaacgccccacttccggcaaggtgctcatcgacggacgagacatcaccggcgtgaaaggcaaggagctggcggacgtacgcgccggaatcggcatgatcttccagaacttcagcctgtttcaacagcgcaccgtgctacgcaacgtgaccttcccgctggaactcaaccacacgccgaaagccaagcgtgaggaacgtgcgcggtatctgctcgatctggtcggtctggctgatctggccgaccgctaccccagccagctgtccggcggccagcagcagcgcgtggccatcgcacgcgcgttggccaacaatccgtccatcatgctgtgcgatgaggccaccagcgcgctcgactccaccacgacggcgcagatcctcgacctgctgcgtcgcatcaaccgtgaacttaatgtgacgctggtcgtcatcacgcattcgctgtccgtggcacgcaacatctgcgaccgtgtggccatgatagacggaggccgcattgtggaaatgggcgatacggaagcgctgttcgccgatccgcacagtgacattctgaagactttgatcgccgacgcgaaggtgacgaaccatcggcatacgcacgaaacggcggatggcgcgaagaatgggacggccgatgattccgcccagaaagaggtgaagtgagatgggacaggtggtttcgcaattcatcgccgattatggcgaactgctggtcgaaggcgtgcgtgacacgatcatcatgactgctgtggcgacgctgctggcatatgtgatcggcctgccggtcggcgtgctgctcatcacgtccgcgaaaaagggcatccgtccgaatgcaccgctcaacaccgtgctcggctggatcgtgaacatcgtgcgttccgtgccgttcatcattctgctggtggccatcatcccgctgacccgactgattgtcggcacctcgctcggcgtgccgggcgccatcgtgccgctggtcatcaccgcggctccgttcgtggcgcgcgtggtggaacagtcgctcgccgaagtggacggcagtctggtggaggccgcgcaaagcttcggtgccagcaacctgcagatcgtgttcaaggtgctgctgttcgaaagcctgccatcgctggtgcgcggtgcggcactgacgttcatcactctgttcggcttctccgccatggccggtaccgtcggcgcgggcggcctgggcgatatcgccatccgttacggctaccagcgttaccagtacgacgtgatgaccgttgccgtgatcctgtgcgtcattctcgtgcagatcgtgcagaccatcggcgacgtggtgtccgaccatatcgaccatcacgagcgttgagccagcacattcgcgttccttatgaaaagcgggtccaaacgtttgttgtttggacccgcttttcgtacgcggaaagagacgctgctcgtagacgattacttgttgagctcggccttgaccagaccggccagcttgccgccatcgatggttttgccggcaagcgcggcacgagcggctttgacgacgcgacccatgtccttggggccggccgggttcacttctgccacggcgtcggcgacggctttggcgtagtcctcgtcgctggcggccgccggcaggaaggtttccaggaaatcggcctcggcggtttcgggagcggccttgtccgccagtcccttgtcttcgtacagtttggcggtctcacgacgggtcttgacgcccttctggatgaccttgagcacttcctcgtcggtcgcttcgtgaccgttggcgatctccaggttctggatgtccgccaacgtcaggttgatcgggttgagcttggccttgtccttggctttcatcgccgcgatcttggctttcttcagcgtgtccttcatcgacatgttcgttcctcttttcttgaccgttcgaacaccgtcttaatactacgcgtctaccaatccgccgtcctgtatccgtgccgtcggcatccacgccggtctcaagcccatgagacacttggagccatgactacagttatcatgcgcacctccgaaggtgacatcaaaatcaacctgttcgacgacgaaaccccggaaaccgtggccaatttcctcggccttgccaccggcgagaaggaatggatcgatccgatgaccggccagccttcccatgagccgttctacaacggtctaaccttccaccgcatcatcaaggatttcatgattcagggtggctgcccgctgggcaacggcaccggcggcccgggctacgacttcgacgatgagatcgttcctgatctgaagttcgaccacccgtacctgctggccatggcgaacgccggcctgcgtcgtggcatggacggcaagatccacggcaccaacggttcccagttcttcatcaccaccgtgccgaccccgtggctcgacggccaccacaccatcttcggcgaggttgcggatgacgattccaaggcagtggtcgacaagctcgaagccgtgaacaccgatcgcatggaccgtccgaccgagccggtcggcatcgtgtccgtggaagtgctcaagtaagcgtttcccgcacagccgtacaatataggaaagcccctcgattgaggggctttcttcattttatttatagaggcgtttgcttgcaatcaccggcttatgtgattcgtcaacatcacattttgcgcagtcgcggttccgcggaatccttcgcgccggtgatgcggtacacgtcgaacacgccttcgattttacgcacggcggcgagcagagtgttcagatgctgcggatcggccatttcgaagctgaattggctggtggccacgcagtcggtgccggtggaaatcgagccggagataatgttcacgccgtggtcggacagcacgcgtgtcacatcgctcagcagatgcggacggtcaagcgcctcgacctggatcttgaccatgaacacgcccttggtgctggtccactgcacatccaccacacgttcgggctggcgtttctccagttcgagcatgttctggcagtccacgcgatgcacggacacgccttggttgcgggtgatgaagccgatgatcttgtctccaggaaccggcatgcagcatcgggccaatttgacccagatgtcacccacacccttaacggagatgccgagcgagctggtggtcttcttggtacgctccacctgcttgagcggcaacgcctcctgctcgacttcctcatccacctcgtcactgcccgcgtcacggaccagatgcgagatgacgttctgcgtggagatctggccatcaccaatcgccacgaacacggcttccgcgttggcaaggttcaactcgtcggcgacacccaccaatgcttccggagtcagcagcgtggtgattggcaggttgcgcttgcgcatggcgcgcgtcagctcgtcacggccttcctcgacggcttcggtacggcgttccttgctgaaccattgacgaatcttgttgcgtgccttcgggctcttggcgaagctcagccaatcacgcgacggacctgcggattcggacttggatgtcaatatttcaacggtatcgccattctcgagcttggtatcaagcggcaccaatcgtccgttcacgcgcgcacccatggtacggtgaccgacttcggtgtgcaccgcataagcgaaatcaatcggagtggcttcggcgggaagcgagacgatcttgcctttcggcgtgaacacgtagacctctgccgcgcccaaatcctctttgagggagccaaggaattcgtcggaatccggcgtttcgctcgtccagtcggcaagttgctgaatccatttgaggttgtcggcctcgctcagctcctggttttcgccacgcttgcggtcgaacttgtcaggcgagctcaacgcgcgtccggcttggccgttctccttgtacttccaatgcgcagcgatgccgaattccgcgcggcggtgcatgtcccacgtgcggatctgaatctccaccggcttgccgccggggccgaccaccgtggtgtgcaggctctggtacatgttgagcttcggcatggcgatatagtctttgaaacggccgggaacagggttccaccgcgcatgcacggcacccaacgccgcatagcagtcctgaatcgtgtcgacgatgatacgcacgcccaccaaatcataaatgttggcgaaatcgtgcccgcgcacgatcatcttctggtaaatggagaagtagtccttcgggcggcctgtcacataggctttgatgtgctgttcgtcgagatcctcattgatttcggcgagaatctgcttcaggtacacgtcgcgttgtccggcgcgacgggccaccaataccacaatctcgttgtagatcttcggatacagaaccttgaagctgagttcttccaactcggttttgatggcgttcatgccaagacggttggcgagcggcgcatacacatccagcgtttcacgtgcctttttctgcgcgttcgactgcttgacgtaacgccatgtgcgggcgttgtgcacacgatcggcgagcttgaccaccaatacgcgcacgtcgcggctcatcgccaccaccattttgcggatggtctcggcctgggcggaatcgccgtattccattttggaaagcttcgtgacaccgtccaccaggccggtcaccgtgtcgccgaattcggcgcggcattcgtcgagcgtgtagtcggtgtcctccaccgtgtcgtgcagaaggcccgctgccacaaccagcggccccatgccaagatcggcgaggatctgcgccactgcaagcggatggatgatgtacggttcgccggatttacgccgttgcgacgaatgctgggtgacggcgcgccgataggctctcgcgagaatgctcatgtcctcgtcgggatggtggtattcgcacatcttgaggattggttcaagcgggtcaagcggattcgtgctgatctcgcagcccaacattctggccgaacgaacctcatgatccatgtcgctcatttcgctcctcctcgcttggaatgtaccctatagtacccgcgcatcaccatatgacggatgtatccggccgcgtgttgcacggccggatacatcctcggtctttgtgtattgcagtcccgtcaggacgcaacgccggttgatccgaagccacgttccgcgcggtcggatccgggcagggtctgcgcctcgatgaattttgcctcgacgtagcgttggatgaccagctgtgcgatgcggtcgcccggatggaacgtcacggcgcgttccggatcgaggttgatcaacggcaccttgatttcgccacggtacccagcgtcgatggttcccggcgcgttaagcaccgtgacgccctgcttgacggcgagtcccgaacgcggatgcaccagcgccacatagccggcaggcaatgcgattgccgttcccgtgggcaccagcgcccgctggaacggcttcaacgtcacttcttcggtggtgcgcaaatcggcaccggcgtctccggcatgggcgtaatgcagctgagccggctgcccgggatccagcgactttaccagaacctcgacgttttccggctcgttgtatgcctcgtcgaacgccatcaggccgcacactccttgcataccggctgtccgtcgtcggtagtgtaggcaagctggctgcgatgcttcaccaggaagcattcggagcagatgaactcgtcgccctgcatcggaatgacggtcaccgaagcgtcctcattgctcaaatcggcgcccggcagctcgtagtcttcggcaatggcgttctcgtcatcgtccatatcgttggaattgttctgagaacccttgctcaaagcctggagcgactcctcgtcctcgtctttgttgcgcggggaatcataatcctgtgccatcgagattcctttcgtcatctatggtgcttatgcgccatagaatacatgacttttcccccgctaggatacacgaattgaaatactcgtaaaatccgacacgtggggcacaatagaattaatagaaaaatctaagggaaagtggtgtgttgtgcctgagaatgcgctcgaagatgcacggttcgatcatgtgagtgaaaccggtgagctcgtctttgtttcaggtgccggcaaattcgccgtcaaggtcgatgaagcgcttgaaagagccattttggaggcaaagcagattcgcaccgaaacccaagaggagcgtcagcagcaagcgccttccacgctgccgatctcccaaatccaatccttgattcgagccggagccaatccgacccgcgtggcggagcgatattcgttgagcgaagcgcttgttcggcgtttctcggcggcggtggaaaccgaaaagcaatatgcgatcgaacagttcctggcggttcccgcgccgaaggaaagccgtgtgcgcacgctttccgaactgatcgaacgcactttcgccgcagcccacgtacggttggaggatgtgcggtggaaggccaccagacgcggtttggaaccgtggaagattaccgcggagttcgattccgcaggtcatgccgcccgtgcggaatggtcttggaacatgcatgacaacgcggtcaactgtctgaacgcaacggcacgcaagctcatcggcgaacaagacacgccgacggaaggacacgccgagaagcaggtcgaccagaattttctcgcatcattgaatttgccgggcgattccgcacgttccgcacgtatcgaacagacggtgtccgcttggaatgctccggaaccggttgcaccacaagccacgaatatcaagaccaccgttgagactcagccatcggcgaccgttccgctgccgaaccgtccggaaatcgcgacgacgcagcaccccgccccttcaacgacggaacctgcccaaaactcgcaaaacacgcaatccgccggcgagcagcagtccgataagtccaagatggcatcatccgatcctcatagtcagagcaccaccaaatcgaagcgccgtgcaggacgctccgcagtgccgagttgggatgaaattctgttcggtgactgattaacgttccctaacatcccacggcaacatccgttcagacgttcggatcattcgatcaagccacgtcaatcaggcatggaatatcagattccatgtaggtcagcgacccgtgcacgctgggcagatgcatcgccttctccgcctgtgtgcgggaatcgacaatggtggtagagcccgcagcggagacgaccacatcgccgatcatcgacttgacgcgttcatcgactggtccgtagacgccttcctcgattgcctgccggcgggtgcgcacctgggcgcgctcccccagcacgtcacgccaacgagcggcgatgtcctccggattctcgccatcctcgccataaagcatgacacagcgtggttcgccgccgacattcgcgacgccccgcatcagctggggttcggacgctatgtcgatgcaggcttccgggtcggcggttatcatgccatgatccgccacgatgacgatcagcgtgttcttcggcacacttcgacgcagcaaagacaactgggcgtcgatacgctcatatgtgccgatccacttgtcggagtcccagccgtaattgtgtccgatcttgtccacgtcgcgcaggtacacgtatgtcagtccgggcgtgttcgccgctttcgccgcggtcatgatacgtcggcgtggatcgtcattggagatgtagtcgctgccacgtaacgccgcctgagtcaacgcggagaacgcgaatttcggcagtcccgaactggtgacgcgaacgtcctgttccgccaatcgttcgaatatggtcggctgctgttgcagtttcagcggtgcgggcgcgtttttgaaagagatgagctggcagatttcgccattgtcgggattgagctgcgtatatcccgtcatgccggttaatccggggcatgtgccggtgccgaacgtggacattgcggccacggtggtgctgggcatgcatgtggcgattggccgctggttaacgccatccgccatcagcgaccgtagatagggtgaatgtcccaatctcatattgatgttccaatatccgagaccgtccaccaggaccacgactgccgaacgcgcgtccggcaggccaagtgcctcttggagtcgtttcggatcggcatggatggccgttggaatcggatgcccgatggcgctggaaatggcgggaagtaccgaggataggtgaagagcaccgccgcggccgccctcatccggcagttcgtcgccatatcgtgccggactggtcatggctagcagctggtcgatttcgggcacttcaacactcatggttcccattcaagcaccgcggcagtaccagctggtaatattgctaggttgattaccataacctttccgtgaggagaaccaccgcatggtgtcgcaccgcaaaccggcaaaaccagcctttgacccgcgtacggtcaaggagaacatcgtcgaaacgccgttgaacgaggaaatgagcaagtcgttcctcgaatacgcgtattcggtgatttacgcccgagcgctgcctgatgccagggacggtctcaagccggtgcaacgacgcatcatctatcagatgggtcagatgaacctcaatccggaccggccgtatatgaagtcggcgcgtgtggttggcgaagtgatgggcaagctccatccgcatggcgattccgcgatttacgaggcgatggtacgtttggcgcagccgttcgcgatgcggctgccattggtggacggtcacggcaatttcggttctctcgatgacggtcctgctgcttctcgttataccgaggctcgtatggcgccggccgcgttgggcatgaatgccgatatcgccgaaaataccgtcgatttcacgccgaattacgataacaagcttcaggagccgactgtgctgcctgccgcgattccgaacctgctggtcaatggtggttccggcattgccgtcggcatggccacgaatatggccacgcacaatcttggcgaggtggtggccgcagccaagcatcttatgcgccatcccgacgcgacgttagaggagttgatgcgctacgtgccgggtccggattggccgggcggcggcgtgattgtgggccgcaagggcatccgcgaggcgtacgagacgggtcgtggcgcgttgaccacgcgttccgtgacgcatatcgaaaacgtgacggctcgcaaaaaggccatcgtcgtgacggaactgccgttcatggtgggtccggaacgtgtgttggaacgtatttccgaaggtgtgaagaaccgtaagctggacggcatttccggtgccatcgatctgactgaccggcataacggcacgcgcctcgtcatcgaaatcaaaaccgggttcgatccgaacgcggtgctggcgcagctgttcaaacacacgccgttgcaggacaatttcaccatcaacaatgtggcgttggtcaatggccgtccgcacaccatgggattgaaggaaatgcttcaggtgtgggtggaccatcgtcgtgtggtgatccgccgacgcagtgaattccgcaggaagaaggcgcttgagcggctgcacttggtggagggcttgctgctcgccatggtggacatcgatgaagtcattcaggtgattcgctcttctgatgatgccgaggccgcgaaaacaaagcttatcgccgtattcgatctggatgagattcaggcacagtacattcttgacttgcggctgcgccgtctgaccaagatgagtcgtatcgagcttgaggcggaacgcgacgacctgaagcggcgtatcgaagagcttgaacgcattcttgcttccgatgaggcgcttgacggcgtggtcattgacgaaatggatgacgccgtggccaaatacggcactccccggcgcacggtgctgctggatgaggatgaggaaggcaatttgacgcctgttgtggcgcatggcgatgatggcgtctctgcaaacgcgatggctgccgcgcgcgccgccgcgaccgtatcctccgcagcagccgatgtcgccgcagccgcaaaggccgcaaagaaagccggcgatgagaatgccaccgcatcggctctgcagattgatgacgagccgtgcgcggtgatgctgtccgccacgggcctgatcgcacgcacttccgaggatgcggtggaacgttgggagaatcgttcggcttccgacggacgcgccaaggatgatcagatcgtttcgatgttccgcacgtccacacgttcctcatacggcttggttacttcagcgggtcgtctggtgctggcccatgtggtcgaattgccgaaggtttccgcggatgggccgctcagtgtcacgggtggtgtgaaggccgaggaactgctgggcatgacggagaacaccgatccgatccgcggcgaacgggtgattgctgcgattgatatgccgtccacggatgacgacggtcagcttgttcctttggcgttgggcacccgcaacggcgtggtcaagcgttggaaccgtgaatctccgaccacaatggattcgtggagcgtcatcgatttgaaggatgatgacgaagtgcttgccgctgccgaagcccgtgatgaggatcgtctggtgtttgtgtccaccgattcctcgttgttgacgttcgaagcgaagaatgtgcgtccgcagggccgtaccgctggcggcatggcgggcattcgtctggctgaggggtgttcggcggccgcgttcgcggtggtgcctgacggcaaggtgacatggaattacgaagaaggcgagaatggactgttctccgcttccggagccgtggtgttgacggttgccggcgattccgaagcgttgcctggcactgaaaacggtgccgcgaaggtcacgccgttggagatgtatccgacgaagggccgtggtacgggtggcgtgcgttcgcagcgattcctcaaggggcaggatacgttgattctcgcgttcgtgggcgcgtatccgttgcatgcttccacgcaaagcggcgctcctgtggaattgccgaagcctgatatgcgacgcgatggttccggtacggatctgtcggcgccgattgcggtggtcggctgattcgacgaaatcgattggcggggctctggactggttcttcttccggttcagggccttcccgttttgcgcacttgggccgccaggttgaatgagcaggctgggtgaaagtgcctccggcttggttcagccatatagcttcatgccttgtgggctgtccacgaacccggcagcatgcagcaaacgtctgtattcgttgcgttccttcaatgattcaccgttcatttcggcgaagctgacgctgcccttggactgatgctgcaatgcataggcaagttccgtacatgccggctgcaatattcgctcgtcatcggtgaagctgacgattctgtggcttttcggcacggcgaacagcaccggcatgccgtggtcgagcacgatgaccgattccgctctgcacgccggtttcatatggtgttgttcgggccatgtgatcgcggagcctgtcaggttggccgggtcggtcacgtcgagcgccacgcaggattggctgcgcgcctcgtcgtcgccgcgcaaggcgtccactgtgtcacgtccggcgaattgggccgctccgaatcctttgacgaacatgcctctgaccagattgccgtgttcttccatacgtttgagtaccgggtatagtccggagaatccgcctgcgacctgctccttgtcgattagcggagcggcgatcacgccatatcggtcgagcagcgattcgatcaatgcgatgtcgtattcctcgatgccggctgttggtttgccggcggtatcgtccgtttgatccggtatcgccattggactggtccgggacgagtcgaccgcggaccataatccaccgagcgtcgccggtgtcgaggcgtggatccgtacgcgtctgcgtgcggcagtgcgtggcgcgcgcactgaaaccgtgccttgagtcaaggcccgaacgggagcgaatgaactgttcgtcactttgccttgccataccaaggaccacaaggcttcctcgaactggctttcgccccatgcgggaaggatgatttcccctgtttcaggattcacgttgacttccgcatgttcctgccagatggctttggcggctgtggaaagctgccgcgcatggaaggctcccccattcgataatacggcaagtatcgtctccggcacggtcatggttccggcactataggcattgttctgcgattgttcgccgggtttcgtcagcagccgtgaatcagctggatggaatgcgatgccgccggcttccttggcgttggaaccattgattttggagccgacccataccacgtctccggatgcgagcaattcgtccaacatactcggttggtagtcgcgaacgcgtgcggggaagaccgaggattcccaaacggaggcgttgaggtatatgccttcaagctgttcgatcacacgcatcagcccgtcgacgctttcatatcgggcgccacccacaggtccgacaccttgtctgtccaacaggaacgcctgatagacggccggttccaccggcttgatggctttgcgtgccttggcaagcgaaagcgcgcggatacgccgaaacacgtctttgtggagccattgctggggcgtttgccgaggtgaccgttccgatgctgaatcatcggaaccattggcgtccgctccggccgcatcatcgacgaaatggcctttcagcagttcgcctttggcatgtaattcatccaacatgcgtacgccttggacagcgtccaatcccagttcggcgatcatctgatccgcggtgaatgggccatgcgttttgacatatcgcgccacacggccggcaatgtcggtctcgtccaaatcgttccagaacgtccgtccggcaagctccttcccaacctgcgcgatgacgtcggcatccaacagcgaagccatgtccgtggctcccagaagacgttccagcacttccgggtccatggacagcagttgcgtgctgcgttcggcttgcggcacgtcgtattggtacatgaccgcgcccacgtatccgaacagcatgttttccgcgaacggcgacggcgtttccgtgacggtctcgctcaaagagatgacgccggagcgtaatccggacatcacatgtttcagcgcgggcagatcgtacacgtcctgtaggcattcgcgtgcggtttccaacagcaacgggaagttcttccgagttcgggcggcgttgagcagttgcgccgcgcgcagccgctgctgccataaggggacgcgtctgccggggttggcgcgtggcaggaacagcgatcgcgccgcgcattctcggaatcgtgcggcatacagcacgctttcgccgacttgcgtttcgatgatgcgttgcagctcttccgtgtcgaacagcagcagctcgcggatcggcaggttgccgtcgccgtccgggaggcggatgatgatgccgtcgtcggccgcgtatacctgcccatcgaacccgtatcgttgtttgatacgtgtggtgatggccatggcccatggttcgtgcacgcgtctgccgtatggcgagtggacgatcacacgccaatcgccttcttcatcctggcagcgttcgacgaccagctcacggtcgttgggaatcgttcccgtggcggcgcgctgttcggcaagcaggtcggcaagattgccgatggcgttgtcgtccaatccgtcacgacgtagacgtgcgattgttgtcgtgtcgaatcggctggtcttgtctcctgcgatgccgtccgagacttccgcgcgtagtccttgcgccatatcgcgtatgaatcggccttgggaccgtccgaatgccgcgtcccgcccgtcgccttcgccatgccagaacggcagtcgggcggtacgccctggagcaggaaccaccaccacacggtcccgggtgatttcctggatctgccaggtcgatgtgccgagggtgatgacgtctccaacccgggattcgtacaccatttcctcatccagctcccccactttgcgtgggcccggtccggagccttcttcgggaagcaccacggtgtaggttcctcggtcgggtatggtgcctccgctggtcacggccagtcgttgagcgccagggcgcgcggagatgagacccgcctcttcgttgtattgcaatggaggtcggaaggcggagaaatcctcgccgttgtaggcaccggtcatcatgcccatcacagcatcgaacatggttctgtcgagatcttcgaatggcgcggccttgcgcacggtcacgtaccagtcgtctggtttcagatcatccatcgccgcggcggcgacggtttgctgggcaagcacgtccaagggggtgcatggaatggtcagtgtttcgatgtctccggagcgcatgcattcgatgcttgcggccgtgccgatgatttgctctcgtgtaatcgggtagaacagtgcatgcgagactcccccgaccttgtggtcggcgcgccccacccgctgcaatcccgaggacacggacaatggcggtgcgatctggatgaccagatccactgaacccatgtcgatgccgagttcaaggctcgatgtggcgaccacgcaacgcaattggccgcgtttgagctgctcttcgatctgtttgcgccggtctttggaaacggaaccatgatgcgccatggcgatcgcgtcggcgtccgcatgcgaggagaccagcatggtggtggatccgaccacggaatcgtagtgtttggcgaagccttcacggccttccggggagcccagatccggatacggctgggtggaatcactggctgtggactccggctgggatgcgttgtccgacacactcaagtccgttcggccaagcctacggtcggacagcgcatcccgccctgcgtccgctttgacggcggtttcagacccagttttccgggatgtgcacaattgcgcatacaggtcgttgagccgtgcggtgagtttttccgcaaggccacgggagttgacgaacacgagggtggtgtggtgtttcagcacttcgtcaagcacgctgcgttcgatggccggccataccgaacctccggttgaaacccgtgaggtatgttcgtctcccccgaccgaagtcagtcctttacgttccgccaatgcttccatggcaggactcaccccggaaatatgcgtggtatggcggttcggaagtttcacggcgcctgccctccgccctgcgtcgtcggagacgggatcgcgcatggccgaaagcggttccaccactttcagatccatgtcggggtgcgattcgggtctgatgacgcgtaccggccgtatgccgccaaggaaacgtgcggcttcggccggcggttccacagtggcggaaagcccgatgcgttggacagaccggccggcaaggctttccaatcgttccaagctcagcgccaggtgcgcgccacgtttggagcccgcgatggcgtgcacttcatccacgataacggtatcaacggcggaaagtatccgtcgcgccttggaggtgagcagcaggaacagcgattctggcgtggttacgaggatatccggcggatggctgacgattctgcgccgttcctgcggcgtggtgtcgccgcttcgtatgcccacgctgactttcggcgatggcaatcccatcgcctcgcactgtccggcgatgccggccaatggcgcttggaggttcttggccacatccacgcccagagccttcaatggcgaaatatacaggaccttgacgccgcggacgggtttgcgtttcttggcattgcaatcggattcagccgtgccgtccccaccgccggacgtccgcaataagtcatcgccctccttcgtcatcagacggtcgattgcggaaaggaaggcgcacaatgtcttgccgaagccggtgggcgccaccaccaatacgttctcgccggaacggatggccggccatgccaaacgttgcgcctccgtcggagcattgaacgcatgcttgaaccaggccttggtaggctccgagaacaagtccatgcattcgtacatacgttcgattatggcatcgccttcagacatcatccacaaccggcggaaagctcgtcatccaccgtcgtcggctcattcgagcacaccgcccggctgacacattcgagcgtctcacatatggcgtcgtcaggcggccgcacggtcgccgcacttgcggcgcaaagtctcatgcatggcgaccatcagcgccaggaacaccaccagatagaacgggaacaggttgaccgaaacatgttgcgcgatcagcccgaacagcggcggcatgcacatcgatcccacataggcgcaagccatctgcatgccgacgatggcctgcgatttgtcctcgccgaaataagcaggagtggaatggatgacgcacggatagatcggcgcgcagcccaaaccgatgaccattagtcccgcgatggtgccgatattgtgcggcaacggcaggagcatgatgacgatgccggtcagcaccaacgcctggccaagacgaatcatggccggatcgttcagtttcatggtcaggaaaccgctggcgagacgtccgacggtgatgccgatgcaaaacaggcttccccacatggccgccgtggtcttgtcgatgcccttgccaagcgccatatagctgctggcccacaacatggcggtcgattcgagcgcggaatagcagaagaacatcacgaggatctcgcgggcgccacggatggcgagcacaccgcgaataccaagcggcttgcgccggtcagctgtttccccttccgattgctcggactgcgcggattgcacggaagaggtttcactcgtccgctgcggttcgacggtcttacgcgccttccacaacggcaggctcagcaccagcaccgcggtgagcacgacctgcagaatggagatggtccggtagccccacgcccagccatggccggcacccaatgcgcttgccatgatgtacgggccaagcagagtgcccaagccccacatggcgtgcagccagctcatgtgacggctttcgtagtggattgccacatagttgttgagcgccgcatcgacgccgcccgcgcccaagccgtacggaatggcgaagagcagcagcatccagtaattcggcgagatggagaagccgaacaatgcgaacgccgttaacgcaacggacactgccgtgaccttgcctgcaccgaaccgcaaggtcatgcggtctgatagcagcgcggacacgatggtgccggcggaaatcgtcatggaaatgccacccgcccaggaaatcggcgcatgcaggtcgccgctcatcgtcggccatgcggcgccgagcaccgcgtccggcagacccagactgatgaaggcgatgtaaatcacggcgagcagcagattggccacagtcagctccttgtatgttttatgtttgcggcaataaaatcacgaaaatactccgctattttatccaaagttacctaccaaacggtattttgtatcttgcactatcgaccgacgtttttgcattatcgtgcatacacgaaaagcgggtctccgccgtaacgcaagacccgccaatcgcaatcgccatgcaatatcaggtgtcgatcttggaacggtcgaaatcgtcggcgttctccacgatgaacgccttgcgcggcggcacgtcatcacccatgagcaggctgaagatgtggctggcctgttcggcgtcctccatgcggatacggcgcagcatgcgggtgcgcggatccatggtggtatcggccagctggtcggcgtccatctcacccaaacccttgtaacgctggatgtcctcgttgtagccgatgtgctttttatcaagctcggcgagtttgcctgccaactcatcatcggaatacgtgtagatgtactcgcccttatgcgtacccgtcaacgcgatacgatgcagcggcggcacggcggcatacacatgaccgtattcgataagcggccgcatgtaccggtagaacagcgtcagcagcaggatgcggatgtgcgcgccgtcgacatcggcatcggtcatcatgatgatcttgttgtatcgggcctgttcgatgtcgaagcttgcgccggatcctgcgccgaccacctggatgatggctgcgcattccttgttggacagcatctgcgcgagcgatgccttctgcacgttgagtattttgcctcgaatcggcagcaacgcttggaaaccggaattacgggcggccttggctgtgcccaatgcggaatcaccctcgacgatgaacagttcggccacatcgtcattgccgggctggcagtcggacagtttcggcggcatggacgcggattcaagcgcgttcttacggcgtgtgacttccttggtcttgcgcgcctgcacgcgggcatgcatttcgccgacgattttctccagcacgcggccggactgttccttgtaaccgcgtttggagccggtaatcatctcaccgaactgcttatcggtcattctggagacgatcggcttgacttgcgcggtgccgagcacgtccttggtctggccttggaactgcggttcggcgatgcggacggtgacgacggccaccagaccggcgagaatgtcgtcacgttccaccttcatatgggaatccttgagattcaccttgagtttgcgcgcgttgtcctcgatggccttgcgcacctgcttggtgatgccttggaggaagccgtccacgtgcatgccgccgccgggcgtctccaccacgttgacgaagctgcgcatggtggtgtcgtagccgttggtccatcgcatggcgatatcgactgcgcaatcacgcgtcaccttctgcgcatgcagttcaccatcgtctccgaccgcctgcgtttcttcaacatacgtgtcctcgccggcgatgcgccaaatatcggagaccgcttcgcctttggacaggaagtcgacgaaatccttcacgcctccggtatggcagaattcttcgacgcgcgcatgcggatatttcggctgcacgggttgggaaacggtttcctgcgattgcgtggcagcatcgttttcttgcgattcggctgattcatcagcttcggctgaatcctcctgcagtatgtcggcagaggttccgatatcatccgtttcagcggacgtgttctcttccgtcacctgttcgatgacattgtcatcgacttccagcatttcgtcaatggactcgtcgccggtttcgggaatgttctcgtcgatgacggtgattttcagccctggcaccaggaaactggtctgccgtacacggtcgatgagctggtcatagctgaattcagcggtgtcgttgaaaatctccggatccgcccaatagcggatgcgggtacccgtggtcttcggactgactttgccgatgatctcaagttcggtgggacgattcttgcgcgtcttcttgaatggcgaatcgggagacgggtgttccggatcaacgtcggaatacactccggggtggccctgatggaaagccatgtggtgggttttgccgtcacgatccacttccacgtcgagacgggagctcaatgcgttcacaacggatgagccgacaccatgcagaccgccggaagcgccatacgaggaattgccgaatttggcgccggcatgcagcttggtcagcaccacttccacgccggtgagcttggttttcggctccacgtccaccggaatgcctcggccattgtccgccacttcaacggaaccatcgtcatgcaaggtcacgatgatgtggttgcaggctcccgcaagagcctcatcgacggcattgtcgatgatctcccacaggcagtgcatcaggccctggctgtcggtcgtgccgatgtacatgcccggacgtttgcgcaccgcatccaagccttcgagcacggtaagactctcagcaccgtaattatccttagccatgttccctttcaattgtcgccttacaagacatgaagtcgagaaaccctgcgttcatgccggtttctcgacttcatttactcgcgtctgattactatcactggtccaggaagtcgcgcagcgtctgcgaacgggacggatggcgcagcttggacatggtcttcgattcgatttggcggatacgttcgcgcgtcacgccatacacacgtccgatatcatccagcgtcttcggctggccgtcctccaaaccgtagcgcatcttgatgacgccagcttcacgcggagacagcgtttcaagcacctgcttgaactgctcctgcaacagcgagaaggcgacggcatcggacggtgcgatggcgtcggtgtcttcgatcagatcaccgaactcggaatcgccatcctcgcccagcggcgtgtgcagggaaatcggctcacgcccgtacttctgcacttcctgcaccttctcgaccggcatgtcgagctcgcgggctagttcgtccggcgtaggttcgcggccgaggtcctgaagcatctggcgctgcacgcgggacagcttgttgatgacttccaccatatgcacaggcacacgaatggtgcgggcctgatcagccatggcacgggtgatggcctggcgaatccaccatgtggcgtacgtggagaacttgaagcccttcttccagtcgaacttctctacggcacgaatcagaccaagattgccttcctgaatcaaatcgaggaacagcatgccacggcccgtatagcgcttggcaagagagaccacgagtcgaaggttggcttccagcagatggtccttggcgcgcttgccgtcgttcgcggcccacttcagttcacgccggcgcttgaaatccatcttgtcggattccgtgtccagcagatgttgggcgtacagaccggcctcgatgcgttcggacaggtcgacttcctgttcggcgttcagcaggttcactcggcctatctgcttcaggtaatccttgaccggatctgcggtggcgccggctgcgatcacacgacgcttcggattgccggacggcgtcagattgtcgtcgtcatcatcgtcacgcaccacgaaagcgcctttttccttgggctcttccggctttttgcgcttgtcttcgtcatcgtcttccagttcggaatcgtcatcctcgtcgatattgtcctcgtcgaggtcgtcatcctccccttcgtcgtccacgtcatcaaggtcatcgtcgaaatcatcaagatcggcatcctcgacgggatcgtcttcaggagcgtcctgctcgatcaggttctcttcttcttcttccgctttcttgcttttcttggcggcggaggtcttcttcgcggccgtcttgcgcgacgtcttcgtagcggtctttgaggactcgctcttcttggcagcaggcttgcgcgtggaggccttttttccggaggtggtcttttcggtcagatcagtctgttccgtatttaccgtcgtttccttggtggccaaacttatcctcctattgatcccgccggaagcgtataccatatggacccacttctggcaagggcaaatcgtcaactatgtgagttaaccatcttgcgaggacgattattcccgcgtgttgagctcaccatgcgcaagtaccgcttcctttcggcgtgttgctctatgtctcttcggcccatgccggtccgatatgacgatgcgccgcggagcagatgatcgccgcgagcgaacaattctcatccaacgcgagcgcacgcatcgcgcacagcatggcgcgctcatcgcccatccaccacagcacataactgatgatggccaatggctgcacatgataccgttcggggaccataccgatgatgtcgaacatcatgttgacgccgttgtcgcaacgtttcgtgtcgggttttcttgatgcgtcacggaacgatccgttgagggattcctccagatgacgcgtgttgccgggaagtgtcggattggccatgaatcccatgagaaagtcacgtgacgaacgtcgttcatccacgatgatggagaccagcagcgcgtcacgcaccgccatggtctgctgcatggcgatggcaagtgctcccgcaccgtttctggacagtctgcattctggcgatgaatcgtcacctcccgacgattcatcggccagctcatccatccattccgagaatggctcctgcaggaaatcgcgtatgctctccgccatgcccagcgatttgcaatcctccaccaattggtcttcaagccgttccatctcggcttcgcatatcggcatgggctcgtcgatcgtcttcatgtctcgtcctccttggcgtatcggagcggtcgcttgatgcaggccgctttgttggaactatgcatcatccggcaatgcaatgaggcgtttcggcacccctgtggtcggagaacgtgaagctcggcgtgtcacgaaacgtccggcaccgtctcacccgctgcaatcattatgttttcctcttgtcgaatgtgtgtggataaccttgacccatgactagctcttccgatttggaacagattgaaacgcgcacgctctcgctggtaagggatttttcgttcctgcatgcggacgatccggtggcgaattcctgcaaagccgtcgctgatgcggtggcgcagcaggcggtcacgtcaagtgagggcggcaaacgtctgcgggcgttgctgacgttggatgcgttccgtgcgttcgcgccgcaggatgtggcggaacgtgatatggatgcggtgttggatctggcatgcgcgatcgaagtgtttcagaccggcgcgttggtgcatgacgacatcatcgacgattccgatctgcgccgtggcaagccgtccgctcatcgtgcgcttgccacggatacccatagtgatgccatcggccatggtttgggcatcatgttgggtgatatgctggccaccgcgagcgtggatatcgccaataaagcggcttgccggcttggctccgggtcttccgtggtgtcggccttcctgaatatgcaccgtgaagtggaaatcggccaagtactcgatttggccgtggaactcaatacgttagacgatcctgaagagctggcgtcggcctctttgaatgtcttccgttggaagaccgccagttataccactatcgcacctttggaattcggtatgcttgccgccggcctcgcccctgcggacgcgcgcaggctcgcactggcgattggattgcctcttggtttggcgttccagctcgcggatgatcttctggacgtcatcgggtcgagccgcaataccggcaaaccggtgggcggtgatatccgtgaaggcaaacgcacggtgttgctggccgatgcgattgaggctgccggcgatgtcgaacgacgtgaactcatcgacatgtgggaagccgaatcacgtgacgaggcacatgttaggcgtgccatcgcattgttcgagtccactggtgccatcgcacgttccaaggaacggatcgccggtctgtggctcgagtcgaaggccgccatcgagacgcttgaactatcgcaggatcgcaaagacatgcttaccgaggcatgcgcacgtttcgtaccgattgtgcgggaacagggctgatgccgccgcactgtgaaagacccgtgttcatcgcatcttccgcaaaccattccttgtagactacaagtgaacacatctttgtcgcgaaacgttttttgaagaaggaatcgtaccgattagccatgagtgaagcccagcatgcccccgaaggccaggtcatcgaaggccggtaccgagtcgtcagcagaatcgccgatggcggcatggccacggtgtatcaagctgttgacgagcgtctgggacgcaccgtcgccattaagatcatgcacacgcagctggcacagggcccacaacgcgaccagttcgtggaacgtttccatcgcgaggcccgttccgcagcagcaatagccaatccccatatcgtgcaggtgtatgacaccggtgagttcgatggactggattttcttgtcatggagtacgtgcatggcgtgaacctgcggtacgaaatgaaccagcaagtcacgttcagcgttcgtgagacgctacgcatagtcggtgagacgttggacggcttggcttcggcgcatcgcgcaggcgtggtgcaccgcgatatcaaaccggagaatattctgctcaatgaccgaggacatgtgcagatcaccgatttcggcctggccaaggcggtgtcgcaggccacgctgtcctccaccggcatgctgctgggcacggccgcctatctggcgccagaaatgattcagcacaatcaggcaacgccgcagggagacctgtattccgtaggcatcatggcttgggagatgctggccggcaaggtgccgttcaccgcggacaatccggtgacgctggtgttcaagcacgtgcatgaggatgtgccggatatcacgaccgcttgtccgggcatcaatgcaggcgtggccgcattcctcgcccgtcttacggcgcgcgcggtcgaggaccgtccccaggatgcgtccgtggcattcgacgaattgcagcagttgcaatcgaacctcaccatcgacgactggcaataccgtctgtcagccgtttccccggccgcaaacgatgccgccgacaccatgcccggcgatggcacccggcagatgccgctaccgcccgctcccccagcaccgcctgtgcgtcagaacgacgatcgtacacgacagttcaatccggaaaacccgaacaaaaccaccgtcatgccggcgcagcaggcagatccggaggcaaccacccgcttggctttggaaaagaacgacgtccccgccaacaacgttccagcttccccctcgaacggtccggtcagtggtggacagccgaaacgcagtggcaagcgtgcacctgtcatcatcgccgtcgtagcagccatcgtgcttgcctgcgcaggcggtggaggctatgcctggtggtatttccgaggaccgggcagctactggaccatgcctcagccggcagatctcacatgttccgattcggagccctgccgtatttccaacatcaaatggaacgcctatgaggaactgctgaaattctccaacatcgagtacgaagagaccgaggcgttcagtgattccgtcaaggctggcaatgtcatctccaccgacccggagaatgtcggttcgcatgtgagcaaacgtcatcatcagaaggtcaaggtggtagtgtccaagggtattaagcagggcactgttcccacagacattctcgatgccaccagtgcgaacggcaaggatccgatcaacgcgttgaagcgtgccggcttcgacaacatcgaacagactccggccaatgatgacgcatattccatggacgtacctcagggcgcgttgcttgatttaagcgtggatcccggcgcgactctgccccataacgcgaagattaccgtcacgctgtcccaaggaccgaaaccggttaccatgccggacgtcgtgggcaaatcgaaggatgaggcgcagcagacgcttgatgcgctcaagctcaccgtcaactggaccgagcaattcgatgacaagattccgcaaggacaggtgatttccgcttccgcgaagaccggagacgagttgcactggggcgatagcgtcaatgcggtggtgtcgaagggaccggaaaccgtaacgctgccgaattatgtcggacagaaagccgccgctgccaaagccgcattggagaagctgggattcagtgtgaagatcagctcgcaactgacacttgactccagtcaagacaagaaggtcgcttcgcaggatccggtaggaggcaccgaggtgcgactgcgtcaggaggatggcacgccgaataccgtcaccttgaaaatgtattcgtcgctgttcgactgattatcctgattacaaaatagaaatcaggggtgtctgttccgaaaacattcttcggaacagacacccctgattggtttggaatgaacctcgctgaaaacttatgccttcttggcagcggattcggcttgtgcctgcgcttcggcctcctgctgggctttgagctcggccttgaccttctgcgcgtattcgtcgacgtattcctgtccgctcatcttctggatctcacgggtcacgcggtcggtaagcgaacgcaaatcatcgtgggtaatctggtcggcggatttcttctcgacttcaatcggcttgccgtaaatcaccttggacttgcctttgttcggaatgacctgtcctggcttctgcagttcacgcgaaccgatgatggcggccggaataatggggcaaccggtttcgaatgccagacgcgccgcgccggtgtgtcctttgtaaagacgtccatcggggctgcgagtaccttcgatgtgaatgccgaacagatgtccgtcctcgatgatctcacgggcgtggttcagtgcgccaagtgatttggaaccgccggaacggtccacggggaacacgccgactgacgtgaaccaccatttcttgaatttgcctttgatgcctttgccttcgaaatattcggccttgcccatgaaatgaatcatgcgcgggcaggtcaacggcagcaacgcatcgtcgatgacggcaagatggttggctgcgatgatggcgccaccttcgtgcggaatgttctcaagtccttgcgcggtcggtcccaaacggtggatggcgattggtcccaagccttttacgaaaaaccaatagagcattcttcacgatcctcccggcggattggcctccgcccgattagagtataagtatgactgacctcaacaatagcaatgacgatgaagaacgcccaaatgacgcgtcgcatggtggcggctctccaatggacgacttggatgcggcttgggccgagtttgcggattcgcatgctgacgatttgaaggccgtggaacgttcgcgtagtgcgaaacgtttcgagaagcatgcgcaacgtcgggaaaaagaggctttgctgtccatcgatgacttggatcagggcacgttcaccaatgatgcgccggcgaatggtcgtgggccgcgcgatttcactggttcgagctggcttgacacggatcgggtcatggaccgttacggtgacgacttcgtgccgccgaatcctgaaatcggccatgtgaaactgtcaaaactggtgttctggatattgctggtggccggcgtcatcggcattatcgcttccgtgttcgttccggcgttggcttcgattcttggttcgattttcggtttgtgtgcgctggtcggcgccgctggcctcatcgtgcagcataaagggcatcgtgaaacgcgtaccgacgaattcgatgatggagcacgcgtctgacgattctttggcgacaaactgaatacatccatctatgtgaaggccccggcggttattgaactgcgccccgtttgttggacgttgttaattgggatacagggtcagaccgcgagggacatgctccggaactcctccggggtgcgtccctcgagtcgtatctggcgtcgtctggtgttccaatggatgatgtaggcgtccagctcgcgtttgaactgttcgtacgagtcgaacacacggccgcggtagaactcgtccttcaagtggccgaagacctgctcggccgccgcgttgtccaggcagttgcccttgcggctcatggaccggcggatgccgaggcgttcgagctccttcctccaccattggtgctggtactgccatcccatgtccgagtgcaggatcggctccgcgccggcgggcaggcgctccgcgagcatggcgggcagacgcttctgctgaccgaggtccggactgcggctcacgtcccaggccacgatctccttgctggccatgtcgtacacgggagcgaggtacgccttggatccggcgaccttgaactcggtgacgtcggtgccgagcctggagaacggacgggccgcgtcgaagtcgcgttcgggcaggttatgcacgcggtcgcccgtctcgcccctgtacgagctgtagcgtatccacgggttcctggagcggatggcgcatctcagcccatacggcgcatgaccctgagcacggtcttggcggatatgcgcgtgccgaactcgtggaccaggcacatgcgcacctgccggtggccgcacccgttcggggtgcgctcccatatctcccgtaccatcggctccacgtccggcctggacacgtgtgccgggcgcgacaggtggtggtagtacgtggatttcggcagcccggctatcctcaggaggtggtcgagccggtgtccccgccctgcgagcagtcggacgacggcgcttcgctcgcgccgcgtgacttggacgcccgcagggcccggagtttttccaggtacgcgaccttcgccttcaggtacgcgacctgttcggcgagctcctgctcgcgcgtcggttcgggcttcggtttggatttcgcgcctttcggcctgcccttgggtttcggcctgagcgcctccggaccggtagtcgcggcaccagcgctccagggacgcgatgctcgcgatcccgtgcctggccatggcctccgtcttggtcagaccgttctcgacgtggtcgcgcgacgcggcgaccttcgtctcccagtcgtagcgtctgctgccgccgcctcccatgaccgcctcctcgccgttggacctgtacagcccgatccagtttctcgcgatatacaccggtatggcaagccttctggcgagcgtgtccttgccggctccggacttgatgagctccagcgcctcgcgccggaacccgtcgtcgtaacgtctccttcgatcctcacgcatacgaaagaaccgcacctccgatcatcgaatctgaatttcttcagtccaacaatcggggtgcggttcatatttacgccgggccttcacatacacatacgttgtcagcgttttcaggctttcttcgcagcttgggcggtggcgatccacttgtcaagcagcgccgtggccttgccggagtcgacggtctgctccgcgatggcgtaggcggctttgaaccggtcagccaagcttgcgtcgcccggcaccaaatgaccgtcggcgacgattgcggaagcggcgttcagcagcgcggtggtacggaacgacacatccttgcctgcgaagaagtctcgtgccagctgcgcgttgagcgtcggttcgccacccttcagatctgcgatggtgactttggcgaggccgagttcgacggtcggatcgaatttgttttcggtaaccttgccgtccttgaattcccaaatggagaccggaccggtcggtgccatctcgtcaaggccctcatgggaagtgtagaccatgccgatctggccgttcgccgcatatacggcggccatgatcgggctcatcttgcgattagcgcagccgacggccatatgcttcgggcttgccgggttggtcagcggaccaagcacgttgaacacgcatggcacgccgagcgcagcgcgaatcggaccgacaaaacgcatggcggggtggaaggtgcgtgcgaaagcgaaggcgatgccgcattcgttgccgacttcgctcacttgttccggagtcaaatccatgggcaggccgagcgcttcgaagcagtcagcagtgccgcacttggatgaggccgcacgattgccgtgcttgacgacttttacgcctgcggccgcggctacgacggcccccatggatgacaggttcacggtggaggctccgtcgccaccggtgccgacgatgtcggtggtttcaccgtcgatgtgcagcggaatggcatgggccaccatggccttcgccgcaccacgcacttcgtcgggggtcagccccaactgctgctgggtggcgagtaccgcgccaacggccgccggatcggcattgccgttcatgaggtcatcgacgaaccactcggattcctcggcgctcaagtggtcccctccgaccagcttggtgaggatcgacttccatgtgatttcggccatgatgccctccttggcgctgtcgcacgcctttattgttgttctgatgccgccaattgtaacgattggacgttcccccacgtccgcacgtccatatcacgaaacggcccatcgaagattcttcaaaaaagaaaacctcccccgattacggtcgggggaggttatgtcatgagcaagtcagcgactcagcgaatcactgctcgttctggccgtggcacatcttgtacttacgaccggaaccgcacgggcactgggcgttcttgccggttcccgggaaagtacggccatccgcccacggagagtggagttcctcgctcttcggacgcttgttggccgggaccttgccttcggcatggctaatcggctgcatgccgacgatgcccttctcgttcttctgctcgtcagccagttcatcgatggtggtcttttcggcctcgtcatcggtctccggctctgcaggagcggattcgccggtcgcggcggcttcgccgtccagacccattacggcctcggcggcgttcacggcctcatcctcatcggattcggtctcctcgtcctcggtcatggccacgcgttcgatgtccacgtggaacagcagctggatggtttcctccttgatggcttcgatcatggagttgtacatctggtagccttcacgctggtattcgaccagcgggtcgcgctggcccataccgcgcaggccgatgccgtccttgaggtagtccatctcgtagaggtgttcacgccacttgcggtcgagcacggcgagcaccacgcggcgctcgagctggcgcaggccttcgctgccgagcttgtcttcgaaatcggagtactggtccttggcgtcggagacgatgagctccttcagggcctcaacggccttgtcgcccttgagcttgtcgacggcgtccttggccccttcctgctccacggcgatcgggtacacggaggagatggccttgaacagaccgtcccaatcccaatcggccggcttgtcggaaccgttgttggcgcccttgatgtagctcagcacggtgtcgtcgatgaacttgaggatgtcctcgtggatgtcggcgcccttcagcacagcctgacgctccgcataaatgacggtgcgctgcttgttcatcacgtcatcgtacttcagcacgttcttacggatttcgaagttacgcgattcgacggccttctgtgcggtgcgcacgcccttggaaacgctcttggcttcgatcggctcgccttccggcatgcccttggccatgacacgcgccaccagctgggtgttgaacagacgcatcagatcatcttcgagggacaggtagaaacgggattcacccggatctccctgacggccggaacggccgcgcagctggttgtcgatacggcgggattcgtggcgctcggtgccgagcacgtacagaccgccgagcttgacgacttcctcatgctcgtccttgacctggtccttgatttcggccaaagtgcccggccaacgcttctcgtactcgtccggagtgtcatccggagaatagccttcggacttgagcttcgcatcagcgaggaactcgacgttgccgccgagcatgatatcggtaccacggcctgccatgttggtggccacggtgacggcgcccttacggcctgcgacggccacaacggcggcttccttgtcatgctgcttcgcgttcagcacctggtgaggaatcttggccacgtcaagcagagaggacacgacttcggaggattccacggatgcggtacccagcaggaccggctggcccttcttgtggcgcttggccacatcacggacgatggcggcgagcttttccttcttggtacggaagatcagatcgtccttatcctcgcggatcatcggcttgttggtcggaatcggcagcacgcccagcttgtaggtgcccatgaattcggcggcttcggtctctgcggtaccggtcatgcctgccagcttgtcgtacatgcggaagtagttctgcagggtgatggtggcgaaggtctggttttcggccttgacctccacgccttccttggcttcgatggcttggtgcagaccctcgttgtaacggcggcccggcaggatacgtccggtgtgctcgtcgacgatgagcacttcgccgccggtcacgacgtagtcgcggtcacgcaggaacagctccttggccttgatggcgttgttcagatagccgatcaatgcggtgttgttcggttcgtacaggttgtcgatgccgagatagtcctcgaccttggtgatgcccggatcaaggatgccgacgaccttcttcttctcgtcgacctcatagtcctcgtcacggttgagcttcagaaccaggcgcgcgaactggcggtaccagcgggtcacgtcgccctcggccggaccggagatgatcaacggggtacgagcctcatcgataagaatggagtcgacctcatcgacgatggcgtagtggtggccacgctgtacgagatcggatttctcccatgccatgttgtcgcgcaggtaatcaaaaccgaattcgttgttggtgccgtaggtgatgtcggcgttgtactgcttgcgacgctccggcggcttctggttggtgatgatgcagccggtgctcatgccgaggaagcggtagacacggcccatcagctcggcctggtagctggccagatagtcgttgacggtgacgacgtggacgccctgaccgtcgagtgcgttcaggtaggccggcagcgtggccacaagggtcttgccttcaccggtcttcatttcggcgatgttgccccagtgcagagcggcgccgcccatgagctgcacgtcgaagtggcgcaggcccaaggttcgcttggaagcttcacgcacggtggcgaaggcttccggcatgagcttgtcaagggactcgccgttttcgatacgctgcttgaacttggcggtctggcccttgagctcctcgtcgtcaagcgccgcgatctcgtcctccaaggcgttcgtcgctttggccacgttctcaagcttcttgatctgtcggccttcacccatgcgtagggctttgtcaacgatatctaccacaatcactccctttgtgtatggtgactttcctcgattgaggatagtcgctttctcgcgatttccgaaaagctccgtccattttacgtaagttttgacgtatcttgtttttcgcataagaaaagaggcccgcatgtatgacatgcgagcctcttatcgttcagttttcagccattagccattacttcttggccacattctccggagtgtcgatttcgaagacgccgtagctccaaccgtgacggtggtagacgacggacggacgaccggtttccttgttgacgaacaggaagaagtcgtgaccgatcagctccatctcgtacagggcctcgtcaatggtcatcggctcggcgatgtgcagcttgcggcggatgacgattggggtgtcgccgacctggacctcgacggattcgccagggccgagatcagcggaaacggcgtcggccgggctattgttcggcgcttccggctccggctcctcgacgacgaccggctcgaccgggcccagatcgaccgggaccggatcggtgtagccacgacgatggtccttgcggcggtcgcgggtacggcgcagacgaagcgtcagcttgtcgagagccaaatcgagcgcgctgaactcatcggcgctggaggcttcggcacgcaccacggtacgacctgcgatgacggtgatctcaacgcgcttggcggtgtcggcctgacgcggattgccctcgtgggacagcacaatctggacacgctgcgcatccggggcgatagcggtcacacgattcatcttgctttcgacaacgtcacggaacctttgcttgatctgcgtatgacgtccggtaacgacgatttccatgtggacctccctagactcaagcggtgttaaccgctatatacggaccaaccagctgcatcgctgcttggtagtcatcattgtatccataagattggtgatttgctggaaaactccccgagaaaacaaaagtttttttacgctttgctttcgacgattctcttgctatagttgtgcgtttgagacctcttgatggccgcgaccgattttgtcggttgaggaacttccgggctccatagagcacgatggcggataacgtccgcccagggcgacctgagagatagcgcagcagagaatagaccgccttaccggtttcggccggtgggtaagggtgaaacggcggtgtaagagaccaccgggccgctggtgacagttggccgcatggcaagcctcatcgggagcaaggccaagcagaaggcgttcgaggactgctcgtccgaagccttcgggtaggctgctagagcctgacggcaacgccaggtcgagatggatggccatccgtgccgttggcacgacagaacccggggtataagaggtctcactctccactctttatgttttgaggatttctttacaccagcctctttatgaaactgacgtcacgcccttggccaacggtcgccgtcaatcaaacagttcctgtgcgatttggcgcagaatctcaggattatggccttttctgccgcccgcgctccagaagcggcgcctacgtgcatcgcgttccagaccggcggtttttctcgcggttctacggcctaattcccatgcggcttcagtaaacacgccgtaggattccgcctcatcacaaacctgttgggccagcctacggtcgacgcctttccgtgtaagctcagcgaccgcgcccctacatcccataagacgggtcgcacagtagcgcaccgcggattgcgcgtaggcttcatcgtcaatcagttgaacccttgtcagtctttcgatgacgtcgtcaaccacttcagaggtatagcccttaccaatcaggcgctcacgcagtgcgccggaaggtcgaggcgcagcgtccagcaatcgcaatgcggcttccctgcatgcgtcaagatcatttggatcctttgcggcagtagaatcgccgttcccgacacgcccagcgtgtcgcgcgtgtcgtggcgttttcgtcgcatttgcgcttccagcgaacaaactggaacggtcaggtttcgttcgacggttccacctctgaacgttcgtgcgttctggatcctctgaagaaagggcaaggcccccagtatcggccgacgccggctgaaggccctgttccttaaggaaacgttcggcgctgatcatatgtcaggctttggcggcttttgaagttttggacgtcttaccatcatccggcgcgcccgcggcgtcctccgccccatcgtcctcggcgaactggtcggtaggtttgatcagaccgaatgccgccttgaccttgttctcgatttcctctgtgagttccggattgtccttgaggaactgacgcacgttttcgcgtccttgccccagctggtcgccctcataggtgaaccacgagccagactttttgacgacgttggcctgcaacgccatatcaagcacggaaccttccttggagatgccctcgccgtacagcacatcgaattcggcggtcttgaacggcggagccatcttgttcttaacaaccttgaccttagtacggttgccgacagcctcatcaccgttcttaatggtctggatacggcggatgtccatacgtacggacgcgtagaacttcaatgccttgccgccggtggtggtctccggattaccgaagaacacgccaattttctcacgcaactggttgatgaagatggcggtggtaccggcttgcgccagcgcaccggtcatcttacgcaacgcctgactcatcaggcgcgcctgcaggccgacatggctgtctcccatctcgccttcgatttccgctttcggcaccaaggccgcgacggaatcgatgacaatcacgtcaagcgcgccggaacgaatcagcatgtcggcgatttccaatgcctgctcgccattgtccggctgagagacgatcaacgaatcggtgtcgacgcccagcttacgggcatagaccggatcgagcgcatgctcggcatcgatgaatgcggccacaccgccggccttctgggcattggccaccacatgcagcgccaatgtggtcttaccagaggattccggtccgtaaatctccacaatacggcctttaggcaggccgccgatgcctaatgccatatccaaagccaaggatccggtcggaatgacctcgacatcctgttccgggcggtcgccaagtctcatggccgatcccttgccgaagcttttctcgacctgcgcgagcgctgtgtcgagcgcggcctgacggcgcggatcgattccattcgcggacttgttctgtgcggcgttctttgccgcgctcgtctgtgccatgactactccttgttgttgaccgagacgaatgaatggattcaccgtaaaaccgcatcatccatctgcgcaagttcaatcggccattgtggtcgaagaacatgcatttcgacacgccgaagaccgctttcccttgaaattccagcattctgaaacttcgcggcgagccgttgacgacctgcccaatccgtgcttctgtggataactataccccattatccgaacatctgttcgaaatcggtgttttgcgatagccgaactccgcctaacgcaccggcattggtggcgcgttatggtcctttccccaacgtttgcagtcaggaatgttcatctggtcgcacagaacgttccataccacgcggggctcctcccccatttcaagcgcttcgacggctgtcagaccgttcaatcgatcaagcacttggtcgcgtgcgagcgcgcggccatagctacggccgagtacctcttcaagcaactgccaaaattcacgttcctgcacgcgctcaagtgtacacagcaagcgcaaccaaaagaaaacgcccgacggaacaagccgccgggcgttagacgtccaacaggaatcagattgcgacggaatcgagataatcggcgaccatgcgcagcatctgcgccgtggagacgcccaacgattgcgcaatcgagctcagcagctcggagctggcctctttttggccacgctccacttcggagaggtagcccaacgacactccggccttttcgctcacctcacgcaacgttttgtggtcatgggtgcgcagatcgcgcagtacatggccgatggcctcgcgaagcgatacctctctgggttcgtcggtggtttccgtggctgccgacatggatcgtgcggaaacgcgttccgcgtcttcctcccgccatatgcgggtcaatgcggcctggcgctcgtctttggcctttttggccgcgcgggcacgcagcacctgctgctgggcgaacatcaccgcgcggcgctgggctggggtgagttccctgacgcgggcgttgccgctttgcaccgtgggaaccatcgccttgagttccatctgttccttggtgagtgtcatcgtgtccatgccgccagcccctttcgcttttcatacgtacgtccactatggtcaacacccatattcgtggattattcctgtgaaagtgctgaaagagtcctcagtttttccagaatacattgcacggtttcgtgccgcacggcttcccgatcacccttcagacgcagctcataagcagctgtttgacgcgcacgaatgccattgaagccacagggcagggagcagccgatgtacaccaggccggcaggtttgtcaccatccggtcctggccctgcaacaccggtagtggccaagccgatgacacagtctccatcctcggtctgtcggtatagttgcgcggttcccgcagccatctgccgcgccacttcggggtggaccgccccttctcgggccagcaggtcggcattcacgccgagaatcttcgctttggcgcgaatgtcgtaggtcaccgccgagccgaggaacactttcgatgcgcctggtatgcgtacgaaggcgtcggcgagtagacctcccgtcagtgattcggcggcggcgattttgaaatggttggcttcgcaatagcgtaaaacggctgcggccagctcatcgcattgcgattggctggccgcggtcgacgaattttcggattcgctcatcgggatttacttggtttccttttcggattttgcggtcttcttacgtccgccgaacgtgttgacgaggtattcgccgcccgaatacaggcatagaatcaacgccaggtaaatcagggcgtacgtgatcgtgtaataaacggtcatccacagcggagtggtgttcatgccatcagcgaggctccacatcggcagcatgagcatggcaaggccgatgcactggcacagggtcttgtacttgccggcttgggatgcggcgatgaccttgccgccggtgtcgatgacgaagaaacgcatgatggtgatgccgatctcacggatgaggaacagcgcggtcacgacccagccgagcactgcgttgccgaattcgttgaagatggcggcgacgatcagcgtgccgcaggtgagcagcttatctgcgattgggtccatgagcttgcccagttcggtaacctggttatatttgcgggccatccaaccgtcgagcttatcggtgcaggcggcgatgatgaagataatcgccgccacccagcgcatagtcgtgtttttggtaccccatgcgcctgccatgacgtacaacgccaggaagatgacgaccaggacgatacgagagaaagtgacgatgttcggcggggcgttccacccgtcaagcagggacgatttgcgttcttcttgcttttccataccgttcacgttaccccgataccactacttggcgcaatgcgtgcggttgtcgcgttccatcatcgcgtgtccgcagcgtcggccggctgggtagaacctgcggtaagcgatgaggtttcgcccttgatgaaggcgagcacctgcggcagatcctgcggttggacgagcacttcgcgagctttggagccttcggacggaccgaccacaccacgcgattcaagcagatccatgagtcggccggctttggcgaatccgacacgcaatttgcgctgcagcatggaggttgagccgaactgcgtgctgaccaccagttccgccgcctgcaacagcacgtccatgtcgttgccgatgtcctcatccggctcgatggccttcttttcggcctccttggccatctcctcgatatcctcgcgataatgcggcttgcgctgggttcgcacgaactccaccgcgcgacggatttcggactcgtcgacccatgcgccctgcacgcggatcggcttggcctggcccatcggcaggaacaacgcgtcaccttggccgatcagcgtttccgcaccggtggcgtcgaggatgactcgcgaatcggtggcggatgaggtggcaaaagcaagtcgggacgggatgttggccttgatcaagcccgtgaccacgtcaacggacgggcgctgcgtggcgagcaccagatgcacgccggcggctcgcgcgagctgcgtgatgcgctggatggagctctccacgtcgttcttggccaccatcataaggtcggccatttcatcgacgaccacgaggatatacgggtatggtgcgaccttgcgtttggagcctgcgggcgcatgcaccttgccagcgcgcacggcagcgttgaagtccttgatgtggcggaatccgaagaattcgaggtcgctgtatcgtgcgtccatctccttgaccacccattccaaagcctgcgcggccttcttcggatcggtgatgatcggggtgagcaaatgtggaatgcccgcataggcggacagttcgactcgtttaggatcgaccatgatcatgcggacctggtcaggcgtggcgcgcatgatcacggaggtgagcatggagttgatgaagctcgacttgccggagccggtggcgccagccaccaacaggtggggcatcttggtcaggtcggcggtcacgaaatggccttccacatccttgccgacgccggtgagcatcggattcggatcgttccgggccttgtcggagcgcagcacgtcgcccagcaccacggtttcgcggtcggagttcggaatttcgatgccgatggcggatttgccttcgatcaccgacaggatgcgcacgtcggagctggccaccgcgtaggcgatgttcttctgcaggttggtgaccttctcgaccttgacgccagggccaagctccacctcatacatggtgacggatggtccgcgcaggaagccgatgaccttcgcatcgacgttgaactgttggaaggtaccggtcagcgcgcggatcacacgatcgttctccggagtgtgcgcggcgtgcggcgcgcccttcttcagaatgttgaggtcaggcagatgatacggtccctcgggaatgtcatccgccgcttccccgtcaacggcagcagccggcatatcgtcaaggacctcgccggtcgcggcatccaccatgacttccttgccgttggaggtgccgtcctcgtcgatgacggcccatgggtcgctcggagcgacgccaaccggcttgatttcactggacggcaccggctcggcgacgctgggcatggtgccgctcgcggtgccgatcggcgcggacgagaaggagcgtctgcgaccgttctgtggcatggccgtggtgccggacggcgcagcggcggaataatcatctgaatcataatcatcggcacgataatcgtccgaagaaatgctgcgtggcgaatcgacctgttggtacggctcgtcgacgatggtttccgcggtctgtccgtgccgttcggcggcattaagaaacgcttcgtcgccggcgtaatggtcaaggtcgccatcatcgacgttcttgctcttatgggatgcgaagcgttgcttcatacgcgtaaggaagcccagcctatcgtcgttttctccatccgcatcggtgccgtcgtgggcgggaacgccttcggcgaaggcgagtgtcatgtccccaacgcgtacttcgttcgggaactgttcggcctcatcgtcaatgtcatcacggtttttcggcgttccaacaaacttggccgccagagccttcgccttgtccggtatctgcgtgacccgggtatgggtgatcaacagcaacgaaaacaggatgacgactacgaaaatcgcaatggaaaagcctttggaaagcccccacgccaacggacagccaagcacatagccaagcaggccgcctgcccgctgcagcaaagacatatcgaacttctgggagtcggaggcaatcgccgcgtcaagaatagagcagacggaccagaggatcatgaaccatccaagggccatatggaggttctcatccttgttttgcgtcttgcgcatcagactgaacaccacaagcgccaggaataccggcagaatcacgctggtcaatccgaacagtccggaggccatggcatgcaggacctgtccgaaagcgccctggacacggaaccattcggatgcgcagaacagcaccgcgagaatggccatgatgaaacatgcgatgtcgcggcgatatttacgcagtatgccggcgatcggagaggaatcgacctcgtccatgactttggtatcgccggaacgcgatttgcctgcggaacccttgccgcctgatttcgggttggaagatgctgttcgtgccataacagaacttgattttaccgatgtccgacgtcatgacacggcattaaccaaatcgaacaattattcgaacttaatcgaacatgctttttcagcgaatcaaacattgttaagcgtttattcagcgctgtaactgaaatataagcaattccggcggaacacgccctcgtgcacttaaacgattaaataactagcgcggatattaacgcgcttaatcccaatgttggggtgcgcgtggaacatcaaggaagataagtgaaggaaccatgaaaaccacagtcaccaaactgctggcaacggttgcggcggcatcgaccatttttggcatgagcaccctcccagcctttgctgcagaaggaaaatcggcatccaatggcaactccgtgaacatcagcgacgtcaacgccacagcagaaacccgcgccttgttcgacaagttgaaaaacagcggaaaaggagatcttcgtttcggacagcagcacgccaccgacgagaacataagctcaagcgcttcacagggagacgtctatgagacgaccggaaaatacccggccgtcttcggttgggacgccggtcttgcgctgcgcggcgcggagaagcctggatcaggtgccgacaagaacgccaacgccaaggctctcgcccagaacatcaccgatgcggacagcaaaggcgccatcgtgacactgtccgcacactggtgcaacccaggcaccggcaaggatttcaacgacaccactgccgtcgcttccgaactgcttcccggcggcaaatactccggcaccttcaacaaggagctcgacgccatcgccgccaccgcgcagcgggccaaacgcagcgacggcacattgattccaatcatcttccgtccactgcacgagaacaatggcagctggttctggtggggcgccacgcatgcttccgctagtgaatacaaggaactgtaccgctacatcgttgactatctgcgtgacgtcaaagatgtgcacaatctgctttatgcctactcccccggcggcgtattcaacggtgattccactgattatctcgccacctacccgggcgaccagtgggtggacgtactcggttatgacgaatacgactccgatgattccgcagacgattccagcgcatggatcaacactgtggtcaaggatatgaagatggtttccgaccaagcttcgcagcgtggcaaaatcgtggcgctcaccgaattcggacgttccggcgaccgcaagttcaaggaatccggcaccggagacaaggacaccaagttcttctccgaacttgccgaagcacttgccgaaaacgtgccaagcaccgcatatatgatgacttgggccaacttcggtggaggtggagacaatttccaggcgtatacgtcgtggaagggctccgacggcgaagccgatttcaaggcgttcgcggacagcaacaagaacctcatggcctccaaggacaacgtcgactattcgaacgccccggcagccgccatgcaaaatggctccgcgcgtatcgtcactccagtggacggcaatcgtgtgaccgacaccaaggtggtcgtccgggtcaagaccgaaggtgtgaaatactccgaccttgatcttaattccgccatcgtgaccaccgatcgaggccagaacgtcaaactcaagtattcctgcaatggatatttcacgggcatactggatttgaacgcggccggtatcaatcttgaccagtccaaactcactttgactccgcaggtcaagaccaaggacggcaagacactcgcagcggccgacggcaacggttccgtcacagtaaaactgggtgccaaaccagagcagacggtagacaacgtggaggacttcgactcctatgacaacgaagccgaattacagtccgtctattcgccgagccacagcacgaaatcgaatctcacgctggtggacagccccgaggacaatggcaccaaggccggtaacatccactatgatttcgtgagctatccggagtataacggcttccagcgttcccatacgccgaagcaggactggtccggcttctccaagctgaacatgttcctcaaggccgacggttcggatcacaagtttgtggtgcaggtcaatgccggcggcgtgaccttcgaagcctatccgaagatcgatggcacggacggacacgtcgtctcactgaacttcggtgacgccgacggcaacggaggcgacttcgcaccggcatcctgggacaccgcgcatgcgggcatgaaactctcgcagaagctgctgtccaaagtcggttcgttcgccctgtacatcaacgacaatggcggcaaccgtccgaagagcggcgatttgacgctcgactccatcaagctcgacggcaaacgcgacgcttacgcgccgaacaccaatccgacgccgggcaacaccgccaaagcgcaatccgtggatgatttctcaggctattcggatgatgccgcagcacaatcggcttggggcaaccgcggacatacggaagtcctatccctcgatgaaggcccgaccgatgggtccaaggcgcttcgcttcaagtacgacttctccaatggaggctggtacgatgtggcgaaatatcttgacggcgcgaactggtccggcgaatccgtattggctttccaagtcaagggggatggttccggcaacgccatcggcctgcagatcggcacaagcgatggcaaatacttcctcgccagcgtcaaacttgacttcaccggctggaagcagattgagattccattggtcgataacgccaatctgacccaatcctggccggaggacgccaataaagacaatccgatgaccgaagatgatctggcctccatcaaggaactggtgttcgcctcccagcaatggaatagcgaaagcgatgggcttgattcctccatcgccgatatcaaggtcgagcccgccgagaatacgtccaacgagcaaaccccgaaggacgaaagcaaaaccgaggtcaaggccgacaaggagcaggaacagtccgaggacacctccgcggatgtgaccgcccaagatccggccacttgcccgatttcagacgaagattccaagggctcgaccggcaatacgacggttacggtcaagcccacgcccgacaccaaggaaccggccgacaacaccggcaaagatggcctgtcccgcaccggttcaaacataatctctgccattgctgccgtggccgtactgctgctgggcggctgcgccgtgctgatcgcacgcaagcggaagggaggcgatatcgaatagtccaataggaatgaactttctcacgtaggacattacaaaacgggggtcccgcaatccaactggttgcgggacccccgcccgtatttccgcagaaccctgcaaaaagaggctccgcagtgatgaatcatttaggcgatatcgccaagatgatgctgcgtgtacgcatccgcctgcgcgtcgatcgcgtcgtaatcgccggcgtcggcatgctcgatgatggccatggcattgcccagcagcgcggggttgagagcctgcagccagtggatacgcggatcgcggccaaaccatcccatctgtttgcgtgccagacgcttcgtcttctgcgcgatgctcatgaacgtgtcatttaaatcgcacaggccatccaaatagtcgacaacctgctggtatccaagagccttgcctgcggtgatgccaagccggggacggatacgctccacttcctcgacgaaaccgttctccagcatctgcttggtacggatgtcgatgcggcggtcaagttcctcacgcggcaaatcaaggccgatctgcacggtgggaatcacataccggtaatgcggcaggctcgccgaatacggccggcccgtcacttcgatgacctcaagcgcgcggatggtgcgtcgaggattgtgcggatccatgcgggccgcggcttcgggatcctttgtcttgagctcgtcgaacagcgcaccggcgccttcgaccttttcacgttcctcgaggcgtttgcgcacctctgggtcagtgccaggaaaggaaatgtcgtcgatggcggcacgggcgtacagaccggaaccgcccacgaggatagggcgcacttccctggcctgcagttcggcgattttggcgcgggcgatctcctggaaacgtgccacggacatggcgtcgtccggttcgatgatgtcgatcaggtggtgcctgacctcggcctgttcctcaggactcgccttggcggtgccgatatccatgcccttgtacatctggtaggcatcggcgttgacgatttccgcctgctcgcccttggcctccaacgccttggcaatggcgatgccaagccccgtcttgccggacgcagtgggaccgacgatggacacgaccttacgggtttcgggcttgctttcagtggcggacggcataggtttgccccgcttccggattcggatcggcgatgagattgtggcgtcccgcatgggtgacggtggcggtcacgaaatcacccacctgcggcatcggctcgccttccggcacgccgacatgcacgagcacgccggttttctcacgtccggtaacacgatgggtggcggcatccttcttgccggatgcgccggtgaccatcacctcgacgtcacggccttcgaaagtcttgagattctcttcggtgatacgttcctgcagcgccacaagacgttcgaacctgtcctgcaccacgtcatgcggaacctgctccatctcagccgccggcgtgccgggacgcggcgagtagatgaacgtgaacgcggaagcgaatcgtgcctcctccaccacgcgcagggtttcctggaagtcctcctccgtttcgccggggaagccgacgatgatgtcggtggagatctgcgcgtccggcatggcctcgcgaatcttgcgcagaatgtcgaggaacttggcggaacggtaggagcggcgcatcgcacgaagaatcctgtcggaacccgactgcaacgggaaatgcagctggtgcatgacgttcggcgtctcggccattgctgcgatcacgtcgtcggtgaaggccgcgggatgcggcgaggtgaatcgtacacgttccaaaccgtcaatctcgccgcacgcgcgcagcagcttggagaaggcaaaccggtcgccgatgccgtagccgaaggagttcacattctggcccagcaacgtgacttccttggcgccttcgtccacacattggcggatttcggcgaggatgtctccgggacgacggtcatgttccttgccgcgcgtggtcggcacgatgcagaaggtgcaggtgttgttgcagcctacggagatggccacccagctcgacaccttcgacgcacggtcggtaggcagttggcttgggaagtagttgagttcctcctgcaccttcacctgcgcgtggccttcgatgcgggcctggtcgagcagctgaggcagggatccgatgttcttggtaccgaacacggcgtcgacccacggggcttttttcgcgatcttctcacggtcgagctgcgccatgcagccgccgaccgcgatctgcaggttcgggcgttccctcttcaattcggcccacagtccgatggtgccgtacatgcgttcggcggcgttttcgcgcaccgcgcaggtgttcatgacgatcaggtcgatgtcatggttgagatactgttcctcggtggcgggcacgtagccgtcggcctcaagcacgccggcgatgcgttcggaatcatgcacattcatctggcatccgagcgtatgcacgtagaacacgcccttgccgcgcgtgggggtatcgttcgccgccggttcggccagtttcgaggcgcgctccgcctcggtcatcatgtcttcgttcataacgcaccatgctatcggcagggcggcacaggcgtttcggaacgcgggaacgccccgttctcggcgcaatcgcagggcattgaccctcttcgatacacagcatacgttcagttttgcggaaaacgaggcggtacactgttcttccgtgatacttgacaggcaaaatcgaattaacaccaccgaattgcagatgcgtctgaagaacgtcgacgtcggcgagggatccctttcccccgaacagatcaccgagttcatcgaccagatgcaggtgtatgagggtgcgatgtacgagatcagcaccaaattggaaattcttgactcggaattccaggtgcgcttctcccataatccaattcaccatatggaacgccgtctcaaatcgcttaactcgatcctcggcaagctgcagcgccgcaacctgccgttgaccgtcgacgccatcaaggacaacctgttcgacgtggcgggcgtacgcgtgatctgcaactaccgcgacgacgtgtattccgtggcgaattatctgtccgcgcaaagcgacatccaagtgctgcgtgtcaaggattacatcaagaacccgaagcagaacggttaccgttcgctgcatgtcatctacgcggtgccggtgttcctgtcatccggaccgcactacacgccggtagaggttcagctacgcaccatcgccatggattattgggcgagcctggagcatgcgctgcggtataagacggatctgccggacgcgaagcttgccgagcattcgcagacgctgttggattgcgcgcgcagcctgcagaacatcgagacgcagatgcagaacatccatcgcgacatcaacagcgccccgcgtgtgggtgaggcgccgcaggcggactgatgttttcggaaaatggcgattgacggacaaatcattgcctgtcaatcgccatttttcgacgatatcgaacgttattcgcgcttacgcagcaatcgtggtattttcaccggaacctgtgcgagcacggtgccgatgaagatcagcgcgcagccgatgtaggctcgtgtggtcatgacttcgccgagcagcaacgcgccgcccaccgcggagaagaacgattcgagcgacatgatcacggccgcgcgcgacggcggcaccagctgctgtccgaccacctgcaacgtgtatgccacgccggccgagccgatgccggcgtacacgatgggaaaccagctttgcatggcgccggcccagtcgatggagccttcgcatagggagccgatccagctcagcagcgcggtggtggaaatttgtccgaaggacagcagaatcggatccatcttctgtccgaacgtgtcgatgacgagaatatggcctgcgaatagaaccgcagtggacaacagcaccacgtcggcaagggtgatcgagccgaatccgtcggtgatgcacagcagatagaagccgaccacggcgatggcaacgctgacgatgacgttcatggtcacgcggcggcgcagaataaggaaggcgagcagcggcgtcatgacgatgtagagcgccgtgatgaagccggaacggcctgcggaaccggaatagaggatgccgtattgttggacggtgctggcggtgaacaatacgatgccgcagatgacgctgatgaccacgggattgcccaggcatttcggcatggccacggttataccgttgccaagcgtgacggttggacactcattcgattcacggcgtcggcgttcctgttcggcgatgcctcgacggcggaaccacagcaacggtattaatgacagcgcgcccaatgtgaatcgtgtggccccgaagaacagggggctcatggaggccatgccctgcacttgggatacgaatgcgaagccccagatcatggccgtcagaacaaggcaggccatgccgccaatctctttcctctgcatgacccactaccctatggcacgtttttcgccgacagaaaagcctgaccatattctggtcaggctttgtttgagggttcagcgcagaggacgtcgcgggatttttcagtcgcgatcgccgaagagctggagaatatacaggaacatgttgatgaagtccagatacaggttcagcgcgcagatgatggagaccttcttgaccatgtcctcaccctggcctgcgtactgggcgaacagcgcgcgagtagcttgggcgtcgtagacggtcatgccggcgaacagcacgaggccgatggcggagataaccatcagcatggtctgtccgggagcgaagatcataagcagcacttcggcgacgatcagcacgatgaggccgaccagcagaatcggaccggctttgagcatgttgaccttggtggtcatgcccagcatggtgagcgcgaagaagaagccggcgcacaacgccagggagatgccgatggtgccaagatcatacgccatgaaaatggtacttagcgagaagcccatgatcgcggcatacacgtagaacatgacgcgtgcggtgctcggcttgatcttttcaatgcgggcgccaagatagatggcgatcacgatttcgacgacgaacggcgcccaagcgccaatgacgccaagcgactggatgagcgcgatgtaggcaccggtggcttgggtgaggatggccacagccgcggtgacgagcaggccgatggtcatctcaccgtaggcacgggtgacggaagcatgttcggcacgctcataggagtatgtcgcctgagccggaatggtggccgccggagcgccctgcgcatacatgttctgcggcgcgtactggtattggttctgaccgtacggattctggctgtactgcccgtacgaattctggttcggattgtattggttctgcccatacggctggccgttgaatccattagcgttgttgccttggggctgctgaccgaatgtcataatcgctccttaactcgattacgcatcacagtacggtacttttctgactatttcatgagagcccacgtcttacggtgccgagctgaaactaccggcaccgtatatccaatgcgcaatcagaccgtgaacttgtgcaccactttcgcgctatcgttcaggtcgaacaaatcagtgacgtcgaccgtcacttcggaatcgtctttcaaggtatatccaatcgtcacggttccggtggctccgggctggacttcggcgaaatcagaattggaatcgtatccggcagggttctcgctgtaaatggcggtgtcgagagcttgcccattttggaacacttgcgggctggcgaggactgcaaacgaactgtttttatccgtgttgttggtccattcgaatgtgaccaacaccgtgggctgattgttatagtcgttgttgctacgtaccgcggagacgattttcacatgcatggtcttcaaatcgccttccatatcctgatcgcccttcggctgattttttgcggagtcttttgcggatgattgtgagcttgacacgccggtggcctcgtctatggccttgcttgctgcggactgcatggccagagtaatgacgatggccaacaccgacagcaccgcagcgacaatcgccaatgccttgccgcgctttttaccgcggaacgtgccgaccaatgccacaatcgcaagaatcacgccaatgaaaccgaaaatcgcagcaatgttgttgataatcggaatgaagctcagcacgaagccaagcgcgccgaacaccacgccgacaatgccgcacacagtcagtcccttctcttcctgatagaccggctgcagcgggggttggggttggatgggctgctgcggggcgatgtaaccactcatgatcgttccttcttctcgaatcggttgagacactttcgagggtacggaattccgcgctggaccggtattggacgaaaggtcattcccgtctgcactttggggcgtgcgaaacgcacggaagaacaatggcgtctttcggggacgggcccaataatggtaggtatgagcgagacgacgaattccccgacccccatcgaagtgccggtacgtaccagaggctggcaaagcatggtgatggtggtctgcgcgggcttcatgtgcttggcgcagaccgcgttcgccgcgcaacggttcggccaggattccgccgtatacgtatggatggtgttctgcatgctggtggcgttcgccatcgggtttctgctgctcgcccgttcccgttatccgcgtgccacattcgtcgccgcgtgtgtggtcgtgctggttttcccatacgatcccattctcgctttgatggcgttgaccgcgctattggcccgccgtaatgacatgaagaccacggttcgcgcgatcgtggcgggcggtttcgtcacgcttgccgcgcaggtacgcgacgcgttgcggccgccggaggcatccatctggcatatggtgttcgccaaaccggataccggcagccaatatggcaccgacctaatcatgcttgccgatgaccgcaccatcgtcatcaccgcgatagttgcggcattgttggagctggccatcgcgactttggcggggttgcatatccgttctcgcgccttggcatcgctggccacggccaaggcggacgcggcggacgcgcaggtggcgcagctcaagaccacgatcgacagtcagcagctggccgacgcgatcgctgccgaagcgcatgacacgcttgcccattcgctttccctgctggcgttgaatgcgagcgcgctgcaagccgagtcgaagaagctcgcggtcgaagcgggaagtctggacgccggccaactggccgggcaggccagccgaatcgcggacaaaaccgaggagattcgcaaacaggcggcaggagcgttggacgaggcgcacagtgtcatcgacatgctgcgtcatccggagcaggcgaaggcgcaactggcgccgtccgatgagacgtcgttgacccgtgaatcgttggatgcgcttctcggagacgcacgtgccgccggcatgcggctcaacacatggattgacatccaacaattgggccaactcaacagggaaaccggcaaaatcgcctatcgagtccttcaggaggggctgaccaatgcgagccgtcacgcgccgggagccccggtatcggtggaactcaccgtgaaccccaccgtaggcgtgcacgcgcatgtgtccaatccaactaatccgtccgttccggcagcatcggcggatgccacgcgtcccgccatggattccaaaaacgctttccgtaccggtgccggattgccgggattggccgagcgcgtccggcaggccggaggaacatgtcgattcggttttgacgcacgacacgcgttccatgttgatgtgcagctaccatgggttgagtgagcagcgaagagaacagcgatgacaggccgataacggttggcgtgattgatgacgatccgatgatttgccagaccatgcggctgattctcgaagattattccaccggcaggctcaatgtcgttttcacctgcaccgatggcggtcaagcggtcgacgaggccgacaggcatcatccggatgtggtgttgatggatatagccatgcccggcatggacggcatcgaggcgacacgaagactgcgcgcacttccgcagccgccgcatgtgctgatactgacgtccttgagtccgagcgggaccgtggagcgggccgtcgaggcaggcgccgagggttttgtctccaaaaccgatgcaccggaggacatcatccgccgcatcaccgatgtgtgcgacggtctgccgcaattcaatccatccagccaacggcagctcatcaacgatctgaacatgcagcaaccgcaatcgcgccgggacgaggctcgcgccatgctcgacgctctgcctgagcgggaacgcgaggcggtggttcttgcagccgacgggtacaccaatgccgaaatcgcggaacgaatgttcatttcggaacgtaccgtcaaggcgcacatctcatccgcgggagacagattatgcatgggccgggtacagatggcgcgtttggttgaacgtgcggatctgccggaccaattatgaggcgaaggattctacggcagtggagactccgttacgtccatgaaacgccggtgcaccccctcccataaactagaaaacagtatgccgcacctgcggtgcaaacgttatcaatgagggatggcggtcgatatggcgatcagcgcgacggaaaaacccctgggcaaagtgttcacttccgattaccaactcaccatcccttcgttccaacgcgcgtacacgtggcaggcggagaacatcgaacagctcgtcaacgaccttcaggacgcctgcgccgacccggacacgccttacttcctcggctcgctcatcctcgtcaaggacggccccacccaataccaggtcatcgacggccaacagcgcctcatctccctgtcaatcatcatctccgtgctgcgcgaactggaagacgaccccgacctcatcgacagcctcaacgacctcattttggaaccaggcgacaaactccgcggcatcaaagccgagccacgactcaccctgcgagaacgcgacaccgacttcttccgcatgtacgtgcaggaaggcgatttggaaggcctgttcgatctgagggacaacgacatcgcctcgcacgcgcaacgcaacatcgccgtcaacacccgccgcacattcgacctgctcgccgccatggacgccaaagaccgccgccgattcgcctcatacctggtcaacggcgtcaccctcgtcatcgtcaccaccgacgacctcgccggcgcgcaccgcatcttcgacgtgatgaacatgcgcggcgtgccactgaccgcatccgacgtgttcaaagcgaaaaccatcgcggaaatatcccccgccgcgcgtaacgcctacgccacacgatgggacgacatcatggacccgctcggcgatgactcgcacacgctcgaagagttcttctccgacctgcacctgatcgtctcgcacaaggccgtctgcacacagctgcttgaggaattccgcaaagacgtgctcaaaccatacgtgaagaaacagaacgtcatctccttcatcgacgatctgctcgccccttatgccaacgcgtggctcatcctcaaccgtccgaccgacgccaacctgccagacgacatcgtggccatgctcgtctcactcgccgactaccagaccaccgactggaaacccgtggccatgtgggcgctcgtcaactccatccgcaacctcggcagcgccaacgcacaagtgttctccacacccggaaatatcggaaacgaaaccacgaacgcgcacgacgaacgcctccaattacacgacatcgacagactccacgacgttctcgccgcactcgaacgcgtcaccggcgtcgacagcctcaaccggcaaagcccactcgcccgacgcacacgcgccgcaagcgccatccgagacctcaacaaaggccataccctccaacagatccgtggattcctcatcaccgacgaggaccgacgttccgcactcgcgcatctacgtggcgagttgcagaccagtcccgccatgaagaaacttctgctcatccgcgccaacgagcagaaggccggctaccgcatcacccgaccgcgcagtctcaaagcgttgccgatcatgcccgaacaggtcagcgcgaaatccgatttcgccgcttggccggagtcggtgcgtgaccattgggcaaaccgcatcggcaatttggtgcttagtcaggccaatgaaacccaagtcgcgccactcgccacgtatgcgcagcggcgcgaccgcatgctgttgtcggcaagctccagacgttttccgctgacagccgaactcgccaatatcgccgaatgcacaccacagacgctgcaataccggcaggatgagatggttcggctcatcgccgaccattggaatattcgttacgatgccgacgatacggatttgtcgacgttgaacgaggagacgctcaatgtgaaagctacggcctcctcccccacgtccaaacgcgtcagcattgcccaagtgctggaagccgggctgcttatcgccggagagaccttggtatgggagcgtccccgcaagggcgaacgttgggtagcgaccgtcacttccgaaggcaagctgcgcatggatgacggcagggagtatgccacgcctactgccgcggcgcgtgccgttggcggctcatcagcgggtcttaccgtgtggaaacgcacgtcgaatggccagaaactgagtgacgtttggaaggcgtatcgtctgcgcaagcactgaggacgccgaacgaccagatggtcagtctcaaccagccggattcaatcaaccggattcagccggtcaatgccaggccagccattcgacggcgagtttggtgcgattggagatgttggttttggcaagtatgtcgctgatgcggttgcggaccgtgccttcgctgagaaacagccgtgacgcgatctcacgattgtccaatccctcggccacaagttccagcacgtccaattcgcgttcggtaaggccggcgaaacgttcggatggtccgctggaatcggggttccgagatccttgaactgcctgcgcatcatcatgcgacacaacgcgatcgactgatgaggattcgtctgatgtcgtggattgcggactgacccgcagcttgctcaacacttcggcgcccatgaccacttgtccggccatgacggcttgcaccgcgggtatgacggacgaaacgtcctgtttgatcaagtagcctttcgtgcctatttccaacgctttggcgatgtatgactcgtcggcgaatgtggtgaggataaggattcgcgcgttcggatgcgcgtcaagaatcgcctccgacgcttgcaatccgtccattcccggcatctgcacgtcgaccagcaacacatcgggggcatccatctcatattgggtcaccgcatccgtgccggtgttggcggtccatgccacatcggcggtgccggtggcttcgagaatcgtggataatgacgagcagacgattggatcatcgtctgcgatcgcgacacgcattaatgcgctcctttctccggttgcgtcgtttccgaaccactcgccggcttggggatggatacgaacacgcgccaaccctcatgatacggcccgcaaatcgcggagcctcccaacgcacgagcccgttcctcaatgtccgaaatgccgatgcctgtggaatcgttcggtcgaatgaactgcatggcgacggcttcagcagacgatcttctcacggttccatcatcctgcacgcacagctgccacaatgccgggaaatcgcgcagggtgattgaaacgttccttgcctgactgtgtttgaccgtattgttcaacgcctcgcgaatcgcagtggcgaagcagcgggacacggccgccggcgctgaatcgatgccgttgaccagcctcacccgcaaggggccggcgccgtccatgctgtgtgcggccgtctcaatctgcgaagcgaaatccgtaccttcgtctttcaaatcatgcacggctttacgcaccaaagtcatagcctcgctcaccgtgtcatgaatttcacagaaacgttgggcggattgttcctgtccggcaacctgggccaccacgtgcgccgcctcggtctgcatgatggctcgggtcagcatgtggccgacattgtcatggatctcacgtgcgatgcgtgtgcgttcggcaagcgtcgccgtgcgtacggccaacgcacgatcctcgtcgttttcggcgatctgcgagcgcaggcggcgaatctggtcgcggcgggaatcctgcaatcgccgcacttcgcgggcgaggttcgcgcagcgcgcgcaaagcagaccggcagcgaatcccagaaccgtttggagcaccatcaatatgatgatggacaagtcggatggaacgtgcgagccaatcgaacagaaaatcactatcgtcatgggaagaagccacagccatcgcggcaccaacgcttgcaagaagcggctgccatcgacaccagcggacgatgatgccgcgttgaatgctgcgatgggaagcatcagataccacgccggcaccaggcatgcgccgcagtcaagcatgacaatcaacgtcatcgcaagccacgaacccgacgcgtattcccccaccgcggcacaacacaccgccacaagcgcgccgcacatcaggtcaaggccgacatctccggatgcgtatacgcccatgatcatgcccatggccaggaacacggcttggaacaacaaccgtttcatgccgcctcccgtccgccgattcgtgtctgattggttcgcttgcttccagagtaatgcacatggcgcatggcacagccggcggcatcaacgaaggtgacatttgtcatgttcgaaagtgacaccattccggcaattgtgactacgcgcaccatgtcgggggcatccggcggcacgacaatggaatcagaggcatggagcacgagaaaggagctcgtcatgggtggacgcatgaatgacgctgccgatgcggtcagcgcggtcaaggtctcgaaactggtgaaacgttacggagacatgctggcgctcgactatttcgatctcgacgtgcatcagggggaaatcttcggcctgctggggcctaacggctcaggcaagaccacggcgatcaactgcatacttgcgttgctcacgttcgatgagggcactgtgcgcgtgttcggcgagccgatcagccctaccagctatgcgttgaagcggcgtatcggcattgtgccgcagaacgtggccgtgttcaacgaattgaccgtcgaggagaacatcgattatttctgctcgctgtatgtttccgacaaggcaaaacgtcgcatgctcgtggacgaggcgttggatttcgtaggattgcgcgattaccgtacctatcgtccggcgaaactgtccggcggtctgctgcgtcgtcttaatatcgcctgcggcatcgcccacaagccggatctgatctttttcgacgagccgaccgtggccgtcgatccacaaagccgcaatgcgattctcgaaggtatccaacgacttaaccgcgaaggcgcgacggtgatctacaccagccattacatggaggaggtcgagcagatctgcgaccgcatcctcatcatggatcatggccggcatctggctcttggcaccgcggaggaacttaaggcgatgatcagcaccggcgaacgcatcagcatcgaaaccgatgatctgggagggcgctcagattcggccgatacgacgcttgcgcgattgcgcgcattgccgttcgtgaccaacgccgactatgacggccatgagctgacggtgaactgccgccagggcgatcacaatctcatcgacgtactgcagctgttggagcacgagggcacgaatatcgggcatctctccagtcgccagccgacgctcaatgatgtgttcctggaactgaccggcaccgcgttacgcgactgacttggcttgcaaggcttgtggcaaatcgaaaggcatgtgacatcatgtggcagacgttactgatcaatctcaaactgcatttgcgggagaaaacgcaactgttctggctgttcgccttccccatcatcctggccaccatgttcaacggcatgttcggcaacatcgcggaaagtttcgagctgcacacacttgacgtggccgtggtcgaagacaacgcgtggaagacgtcctatggggcgcagacgctgatcgaaggcatttcatccgaatcgtctgcattatcggacaatcacgtgaaagtgagtgccgatggcaagaatggaacgggactcatcaacacgaccaaggtggaatcgattgcgcaggcggaacagctgctggccgacggcaccgcgcaaggcatgctgcgaatcgatgacggcagattgcgattctccgtctcacagtcgacgcaatcgtccgtgtccgatgtgatggcgtcgagcagcggcttggatatttcgctgacggtgctgggcaacatcgtggacctgtacaaccgcaacaccgatgtggtggtggacattgcgaagcacaaccccgaagctctgatgaatggcaaggtgaccggcagcatcggttcggcgaatggctatacaaaggaaatccagctgacgaattttaaaccgagcggtacggcacgatattactatgcactgctgggattggccgcgttgatggccatgagcttcgccatcaacgtagtgacgatgacgcaggcgaatctttcggctttgggtgtccgccgttccgtttcgccgcttccgaaatcgcagcaactgctggctggattcctgtccagttggctgtgttcgttcctgagcctgaccgtggccatgctgtatatccggttcgtctgtcatatttcgttgggcggacgtgaatgggctggtgtgggagcatgtctcatggcttcgttcgcggcgagcgcattcggcacgttgcttggcgcgctgccgaagattccaaccggcgccaagcaggggctgtgcacggcgatcgcctgcacgttgtcattgttctccggactgtacggttcgttcgccatgcagttgagcgacttgatcgcccagcgcacaccggtgctgagtctgctcaatccggcgcagcagatcacgaacctgttctacgacatcctctattacgacaatttcaaaccgttcttcaccaccgccggcatccttgccgcgatgagcctggtctgccttgctgcggcgaccgttctgttgaggaggcaacgctatgaatacctgtaagacggcgctgagaattctcaaatcacgcaagatgtacctggtcatctatttggggttcatcggcatcatgatgttcgccatcagctggcagatcatgcgtggctcgatgacgggtggcgatgaggtgttccatcccgatacggcacgtgtggcggtgatcgaccgcgatggcgatgccgatggtatttcatccgcgctgcgttcctatcttgcgttggatggcgagatggtggaccttgccgacgattccgaagcgttgcagcaggccgtcgcttcgaactatgtcgatttgatcgcaattgtgccgcacggcttcgcttcggattatcagaaatatctggatggttcgtcaaatgaccaaccgactgtcgaaaccgttgtcagctacacttccggagcaggctccctttcgcagctggaagtcaacgaattcctgtcattgacacgcaccgcgtacttgggtcaagccgggaagcagcagtcgatggaaacggccatgcggacggcgttggataccgcgaaagcagatgccaagacgtcgaaaatagcggtggtgcaatcgccatccgcagatactgataataccaagccggcggcatccgcattcgccggcaccatcaaaacgggactctatccgttgctgctggtcatgccgatctgcacgttcctggtgattggcaccttcaatgacagtgagattcgtcgccgcctgtattcgtcgccgacgcgtctggtgtcgttgcagatgcaggagatgctcacctgcgccgccttcggcttggtggtgtgcgtgggttacacggcggcgacattggtcttgatggtggccgcaggagtgccgttcgacgggattacatccacgaatgtggctttgacgttcgtgtcgctgctggcgtacacgttgatggcaatcgcctgcggtttccttctggggtcggttggtttctcggaaatggcggtcaatgcgttcgccaacgtattcggtctgctgtgcatgttcacgtcgggtatggcattccccatcgatatgatgcccgaaccgatgatcatgatcggcaagctgctgccgggatggtggctgtgcgtgtccatcgacaacgtgttcgggcttggcacggcggctgcaaccggtgtggattatggttcttgggcatcgtcggtcggcttggtggcattgtttgcagtggcgttcatctgccttggtctggcattggggcgtatccgtcgcacacgcccgtccttggcctcccccaccaccacgcagttggccaagtaaatccccaagtgttccgttccatcggccgagtcccgatggaacggaacatccgcctttgccgtaggctctcaatcaaatcggatggaaccggacgaaatcggactaggctgaaagcatgatcgaccacattacacttcatgtttcgaacgcggaacgcagcatcgcattctatacgaaagctctgtctccgctcggatacattcccaaagcccatcacgaaccgaccatcggtttcggcgtggatgacggcacgccccgttcggatttctacatctccccgatggacgatccggcgcaacagccgattcccacgcatatcgccttccgcgcaacgaacgaacaagcggtacgcgacttttatgaagccgcgatcacggcaggcggaatggataacggcagacccggaccacgtgcctaccattccgggtattacgcggccttcgtgctcgaccccgacggcaataacatcgaagctgtcacagactggtcgcacacaagccaatcatgaaatcggccgccgaatcgcaaaaagtcatcgggtgacattgcgcagccaacggtacttgcggtagtgcaacaacgcgggaaccattttgatgcattcgtcggtgttgagcagcgcatacaccaccaacacgggcagtttgaacacgaacgcggccaacagcccgaccggcaccacaatcagccacatgacgatggcatcgcacatgagaccgaacttcgcatcgccgccggctggaaaaagaccggcgatcgtcagattcgtcatgcatccgcatgccgcgtaatatgcgcagacgaacagcatgaccgacaggtaccgtgtggcttcgggcgtaaggttcgcccattgcaaagccagcggacgcgccgcgacaatcaacagtcccgtcgcggtaccgaccacggccaccagcacgcacatcctgtcgcccatcaccttcgcctgtcggaaatctccacgtcccagcagattgccgaccaaaatgccgccggcattgcccagaccaagggacaggcacaccagcagatccttgacgatattggcgatggaattggcggcgacggcgtccgcacccaaatgtcccatgatcacggtgtacatggtgaaaccacatccccacaccaattcattgccaagcaccggcaggctgtatttccagaaatccttctgcaacggcccatcgggatgcagcacatggccaagtcgcaggtgggggccacgacgggtcgccacgaccgaccatgccagctcaatcgcacgcgaaatcaccgtggatatagccgcgccgaaaatgccaagcgcgggaatgccgaggctgccgataccgtaaatcagcgccgcgttcaacacgacgtgcacgatcacgccaaccgtgctgaccgtcatgcccatcaccgcggaaccggtgttcttcatcagacacaggtacatctgggacaggccgatgaacaagtacgacaatgacgaaatccgcagatatcgcgcgccaagcatgatcagcgtgccgtcattggtcatgatggacatcaactgttccggcacgagcagtgccgccaggaagaacgccgtcgacagcattccggcatacagcatgacgaatcccagcacgcgttccaccgcgtcacggttgccggcaccccaatactgcgccacgagaatgctcatgcccagggtcagggccgcagtgaacaggctgaacaggaactggaactgcgtggcgagcgagacggcggccaactcgttttgccctacccccgacaacatcagcgtgtcggcgcaggacgacaacgacagcatgagctgttggaaagcgataggcaaagccaatttgaatacatggccgaggaattcccggtccggcatgatggtgcgcacgatagtctccattggaatacaagcccgtttcagacgacgggcaaacgaaaacgtcgggatatgtaggccgaccagccttatcccgacgttgggccgaatattgggcgaggttttacagcgaatccttccatgcgcggtattcggcggccttgccctcccagtattcacggtccgcatcagtgatcttgcgaatcacatggcacgggttgcccacggccaccgaatgggatgggatatccttggtcaccacggagcctgcaccgatcaccacatcatcgccgatggtaacgcccggacagaccaccacgctgccgccgaaccacacgtcattgccgatggtgatcggacgggcgccttccggaccggaagcgcgtacggccgcatcgattggatggtatggcgtgtacaggccgacgcgcgggccgaagaagacacggtcgccgatggtgattctcgccacgtcgaggaagatgcagtccatattggcatagaagttgtcgccgatatacgtgttgcagccgtaatcgcagttgaatggcggttcaaggaacgcgcctttgccgagtgaaccgaacagttcgcggaacagcctgtcacgttcctcgaacgcgtcgtatgcggacgtgttgatggcgtgcaccaagcggcgtttacgcatgttcgcttcacgctgcatatcaccgcaaatatacaattcgccggaaagcatgcgttcccactcgttcgtaggcaccgccgcattatccacggcaacggccgcaccttcattctccgccattgaaagctccttgtgaatctgtttgtcaatcgtttgacgtcctttgacaccattcaacaccaccaacatcgacggtagcactcgcaatgttgtagaatcatccttgttctttgcattatctaccgtttattagagtagtcatgaacactgccgatgaagacgcacagatggaacgggacgaatgggcctcccgtgaggtgatgcccatcactaattggggtcgccgacccgatggttcggagatagtgcagtatgacgcgccgatgttcttctccttcaccgagcattcgctgctccaccagtacccccatatgcgtgcggaatgccattggcatgtcgaccttgaactcacctacatcatccatgggcatatgtggtatttcgtcaacggagaaacagtccggctcgatgaggggcaggcgattttcgtcaactcacgtcagctgcattacggtttcaccaaggacggttccgattgcgaattctcctgcacgttgctcaatccggctaaaatgtgcgcctcattcgaagtgtacgaccgtttcatcgcgccgttgatggcggagaacacgatgccatatgccgtcatcaccgacgacacggcccccggtcggcggctgctcgccaccatccgacagcttcatgcggcgaaattcggtccgctggagcggtcagagcggtcagccgaaccgttgcccgccgacgatatgacgctaaccgacaataccgaggcgttgacggtgctcagctgtttctatgcggtcgtccgcgacatactggcgatcgccggcagtcattgcgcgacttccacagcgccgcacccccgcatcgtgacgctacgcaagatgatcgattacgtgcagagatattacgtgcgtccgatcaccttgaagcaaatcgcatcggccggatcggtgggacgcaccacttgcgcatcgatattccgcgaatcgctcaaccagtcgccaatcgaattcgtcaacgacgtgcgcgtgcgcgccgcagccaacctgctggtaacgagctcgctgcctatcgccacggtcgccaaacagaccggtttctcatccgccagtttcttctcccgcaccttccaccggttcatgggcgtcacccccatcacgtaccgaaccacgcataccaagcggaaatccgaggaataaaaacaatcggctgcgtgccccacgccgtcacgcataaggacacgcagccgattgcgtcacatcaagccggaaacggacacgttcacttcctcttcagtccgcgggcgatggaggcgttgcgcacctcgaccgtgccgtcggtggcgaagacgcccaacgactcgcccggacgctcgtacatgcgcacgttcaacgccaccccatccacgtacaacgtgccgatggtgtcgtcgacgacgagacggatgtggtacgtatgccccgcctcgaggccgatgttcataccctggattggcaacggtgtgttggacggtttcctagaggacgagtccctgtccggtgaattccttcggactccggtatccaagggtggagtggagccgccggtcgtcggaccaccacacgtagtcgtcggggccgcgcctcggctgctcgatcgtggtgtagtggttccggtacacgagctccttcctcagcagcctgtccgtcgattcgaccacggcgctgtcgtagaggtcgcccttgcgcgacagcgatcttttgatgccgaacacgtcgagcggctcgtcgatccccgtgtcgtcgaacccgccgccccggtccgtgcggaacacctggacgtccgccggcgggaagtcgggggtggcgaacgcgcccaataccaggcccgcgtcccgggcccgcccggcggaatggccgacgatgcccctgtccgccaggccggccagcaggcacacgtacgcccatccgctccctaccctcacatacgtcaggtcgctcgccggacgcgtgtgaggggcgtagccgtcggacccgcggtccggcaggttcgcgagcctggcctcgtcggcccgcgtcccgtgcggttcggaccgtccgcgcgcgtacgcgcccgcatgccctgttcacgcatgatgctgccgatgcgtctcctggacgcggtgacgcccccttcccttccagggcggccttgatcttcccggcgccgtagcgtccgcggccgtcgcgccggaccgcgcgcacgtcgccggcgaccggatccgcacgctccgtcccgggacgcccggtcatccagtaacaggtggggcggggaacgcccggtatcccgcatcgcgccgatatcgggcagcgggcggcgttggcccgtatcacgcctgccttcgtgcgaataccggcgccgcttgttctgaaacgtccacctccatctccaactgtcggtcgcgcctccccggctcgaccggctcgttccgcccgggcgtgcggttgtccgcggcccgggtggagccgctgtcgcggatgccttggacccagcgccgcggggtcgatcgcgcgatgtcgtgcctggccctgatctcccgggatggcttgccgctctcgcacgactgcgcgatctgccgtttgaacgcctcgtcgtggtggcggggatgcttcgggtcggccatcgtcggcctccaatcccatgtcattcgtccctcatcggactgtctaatacattgtagccaatccaatgatgccctcgacctggtgttcgaacatgaacgagaaggttctgcgctccacgtcttttctgccgtcggtatccaccaccagcagaattttcccattacgccaggcttcatcctgcgcgccttggatcacctggccggcgaagggcgatgtggccactccgtcgctgatgaagccgatgatgtcggagcggcctcgggccaatccgcgggcgagcgcgttgtgatggtagccgagttcgtcagcggccctgcgcaccttgcggcgtgtggattccgtgatccgcacgtcccggttgtcgttcaccgcccatgaggcggttgcgatggagatcggccacgtcccgcaatgtcactttcgccatgcccgcgtatcagccccgtccgacgcctagcgcatcaggttgcgcaggacgtactggagaatacctccgttgcggtagtagtccgcttcgcctggcgtatcgatgcgaacgacggtatcgaattcggtcgtggaaccgtccgcgtgggtggcggtgacgtggaccgtcttcggggtgacgcccttgttgagttcctcgacaccggagatgtcgtaggtttcggtgccgttcaggccgaggctctcatacgattcgccttcggggaactgcaatggcagcacgcccatgccgatgaggttggaacggtggatgcgttcgaagctttcggtgatgacggctttgacgcccagcatgacggtgcccttggcggcccagtcacgggaggagccggtaccgtattccttgcctgcgagcacgacgagcggcacatcatggtcgatatagtcgcgagacgcttcgaagattgtggtcggcttcttgtcgaggaagtcgtaggtgtagccaccaggggtgatttcctcgccgacggaggcgagcaactggttgcgcaggcggatgttgccaaacgtgccacggaccatgacctcatggttgcctcgacgggaaccgtaggagttgaagttcttcggttcgacgccacggtcggtcaggtatttgcctgccgggctggaggccttgaacgcgcctgccggggagatgtggtcggtggtcacggagtcgccgagcagtgcgagcacgcgggcgccgtggatgtccttgaccggatccggggtggccttcatgccgtcgaagaaggtctgcttgcgcacgtaggtggagttctcatcccatgcgaacagttcgccttccggcacgtcaaggcccttccaacggcggtcgccttcgaacacggaggcgtaatccttgaggaacatctcgcggctgacggtgccatccaccactgcggcgacttcctcattggtaggccagatgtccttcaggtacacgtcgttgccgtcctggtccttgccgagcggctgggtttcgaaatcgaaatccatagtgccggcgagcgcgtaggcgatgacaagcggcggggacgcgaggtagttcatcttgacgtccgggctgatgcggccttcgaagttacggttgccggacagcacggaggtgacggtcaggtcgttggcgttgatggcctcggagatttccggcagcagcgggccggagttgccgatgcaggtggcgcagccgaagccgaccagctggtagccgagcgcgtcgagatcatcctgcagaccggcggccttcagatagtcggcgacgacctgggagcccggagcaagtgacgtcttgacccacggcttgggcttcagtcccttggcatgcgcgttgcgggcgatcaggccggcggcgatcatgacggacgggttggaggtgttggtgcacgacgtgatggacgcgatcgccacgtcgccgttcttgatatcgaagtcgccgcggaagtcagtggataccgcgatcggcttctgcacggttttgtcggtttcgtatgccggtagcgtggcttcgaacttctctttcgattcggacagcctgatgcggtcctgaggacgcttcgggcctgcgatggacggcacaacggttccgaggtcgagttccaggtattcggagtactgcggttctacgtagtccggatcggtggcgtcgccccagagcttgttggctttcgcgtaggcttcgacgagagcgatctgctcttcggaacggccggtcagacgcaggtagtcgagggtgacgttgtcgatcggaaagatgccacaggtggagccgaattccggtcccatgttgccgatggtggcgcggttggccagcggcacggaagcgatgccttcgccgtagaattccacgaatttgccgaccacaccgtgctggcggagcatgtcggtgatggtgaggaccacgtcggtggcggtgacgccttccggaatggatccggtgagcttgaagccgacgacgcgcggcacgagcatggagatcggctggccgagcatggcggcttcggcttcgatgccgccgacgccccagccgagcacgcccagaccgttgacggtggtggtgtgcgaatcggtgcccacgcaggagtcgaggtaggcgaggtcgcgaccgcgctcccccgccttggtcatgacgactttggcgaggtattcgatattgacctggtggatgatgccggttcccggcggcaccacgcggaagttgcggaaggcctgctgtccccagcgcaggaactggtagcgttcgccgttgcgctggtattcgatgtccatgttctgttcgaccgcgtcggccacgccgtacttgtcgatctgcacggaatggtcgatgaccatgtcggactggacctgcgggttgatgacttccggatctccgccaagctccttgacggcgtcacgcatggtggcgaggtcgacgatgcacggcacgccggtgaagtcctgcatgaccacgcgggacggggtgaactggatctcgtggctcggctgtgcggccggatcccaatccaacagagccttgacatgatcatccgtgatgttggcgccatcgatgttgcgcaccaggttctcaacgagaaccttcaacgaatacgggagatgatcgatgcccggcaaatccgcgatacggtaaaagtcgtaatccttgccgcccaccttcagggtgtcgagctggtcgtcgcgcacagacatgctacctccgagcttttgtggctggttgaaactttccagcagccgattatccgttgccaacgatacagccacgttacttcagcactggcgtgtcttcttgaaacgtgagaaaatggcgactattttcggcacgcaccacaggcacagcacgaaaacgatggcggacaccacaagcgcgacgcccgtcgccgcgagcatttcgccggacggtatcacgagcgcgaagaaacgcgcgacgggcggaatgaacatgccggccacgcccgccacggcgaacgccaataccagaccgcctctccacgagttgagtggacgggccacgcgcgccagtacgaagatgcccatcatcagcaggataatcgcgttgacgccacgaagcatgcccagctgcgcggcggaatgctgtgcgtcccagcccatgaacttcggcaacagccacgaatcggcgagaatcgacagagccgtggcgatgcctcccggcaatgcgaagtgcaccacgcgcctgaggaagcccggaatgtagcggcgcgtgttcggcgcaagcgcgaggatgaacgccggcatgccgatggtgagtgcgccgatgtaggtgatatggcggggcaggtatgggaatgggatctgcgtcagcaccacgccgagcgagatcagcgcggaatatacggttttgacgaggaacaggctggccacgcgttccatgttggccatgacctggcgtccacgtgccaccacatcgggcagatgcgagaatttcgaatcgacgagcaccacttgtgcgacggctttggtggcgggtgccgcgttgcccatcgcgatgcccaggtcggcctccttgatggcgagcgcgtcgttcacgccgtcgccggtcatcgccacgacatgatcgcctaggtgcagcgcctggacgatcgccttcttctggtcgggcaggacacggccgagcacgtccacgttctccagtactttcgccagttccgtgatgtcggcgggcagttctcgcgcgtccatgaaccgtggctcctcgtctccggtgagccgtacttttcttgcgatcgcaccgacggtgacgggattgtcgccggagatgatgcggcagcgcacgccctgttcgcggaaccaggcgagtgtggcttcggtgtcgtcgcgaatgtgctcggagcataataccagcgcgacgggccgcgatgcggggtcgatggcgggatcgctttcgtaatcggcgggcgccttgccgtcatgccgtgcgatcagcagcacgcggttgccgtcgtgtgcggaatcgttgaccagtcgaagaacgtcggcgtaatcgccatccaagtgggacagcacgacttccggcgcgcccatcgtccataccgcgccgtcatcggcaatcgagctccatttgcgtgccgacgagaacggaacgcgcgccgcgacgggaccggcggagaatccctgcttgcccagtccgttgagaatcgccaatccggtgccgttcggctgtccttcgttcgacaggtcgtacagcgcctgtttcacggcatgttcgtcaacggtattggctccgatgccatccagcatgcgtatttcgttgagcatgatgccgccgtcggtgacggtgccggttttgtcgaggttcaggcagtccacgcgtgcgagggtctccacggattcgagctcctgcacgagcgtgttcttgcgtgccaaacggatggcggcgagcgcgaagttgagcgaggtgagcagtacgaggccttcggggatcatgccgaccacgccagccacggcggacaccacggcggaacgccattggccggtggagatggctacgtcccaaccgccgaccgcgtgcacctgcgaccagatgagcagcacgcacagcggcacgacgaggaaggtcatgaatttgaggatggtgttgatgcccttgttgaggtcggacacggtctttttgtagaccttcgcctgcgcggtcaaggtggcggcatagctgtgcgcgccgaccgcgttgaccttgaccaaggccatgccggagaccgcggtggatccggaatagatgtcgtcgccttcgttcttgcgcacggtgcgcgattcgccagtgagcatggattcgtcgagttccaggccccaggtgcgcacgatctgcgcgtcggcgggaacctgttcgccggagcggatccacatgaggtcgccgagcacgatttcgttgtgcggcacttcgacgtccttgccgtcgcgtcgtacgagatagtcggaggctacgaggatggaaagcttgtcgagcgttcgtttggctttcagctcggtgacgatgccaatgccggtgttgatgaggatgacgaggccgaacacggcgtctctccatgatcccgtgaccaataccatgaccatggcggcgaagacgatgccgttgaacagggtgaacacgttggctcgcacgatgtcggcgaacgaacgtgacgtggacgatttgacggcgttgacctgcccgctttccgtaagggcggcgacttccgctgcggtgagccccttttcactggtttcaggcatggtttgactttcactcatgctgccagcctaccgcttggcgatgcgcacccgcaggcttttcccgtaaagctccggcaaaattcagggttttctcagggtgcgttcagcgccactcatccgaaccgattcgaactcacccgaatgcgtggagcggttcactgtttgccgccgtggctgatggtggtgacgaggattgttctgtcgtgcgggtcattgttggctatgccggctaccgcgtcggcaagcggcgtcgcatccgtcatgcggtcgttgattgtgagcgtcgcagcgaacagcgtgctgtcggtcggcgtggcgatcgggttgagcagtgccactggaatgcccgcctgtcttgcggttgtcagcgtgtcgtaccagccgtcatggttcacgccggacatgtcgattcccgaaatgacgatgatgctgaccatgcgttgcgccatatcctcgaccgcttgccgggcggtgtcctgcatgtcgaccgtgccggcgaccggcagatacaccggcctgagcccgcccgcctccatggcatccaacgccaggcgatcggtctgttcgtcttgggagccgatcatggccacgtcgagactgttgcggtccttcatgctgtgggcgaccgcatcgcctgcggactgcgtatctcccaccgcggcattgttcggcgtgcagccggccagcatggagatgccgaagacggctgcaaggagaccggctgcggcacgccgcgcgaaaccggtcatcgtgtggctttcctgaatagcgccaccgtttcgacatggtgggtggtcggatagatgtcgaatgcgcgaatatcggcaagatcgtatccgagcgaggccaatgtggcggtgtcgcgtgccagcgatgccgggtcgcaggcgatgtatacgacgcttcgcgcgccggattcggcgatctgcctgcataccttcgcacgtgcgccggcacgcggcggatcaagcaccacgatatcgggtttggccaaatcgttgcgtacgttggcaagcgtcttggccacatcgcccacacgggcgtcgacattgcccaaatggatggccctcagattgcgttgcgcgtgtttgacagcggtcttgccaccttccacgctcagcatgcgcgtgcggccggcgcttaacgtggccaacggcagcgtgaacaggccggaaccggaatacaaatcccacaggcatgcggaagtggcgccgtcaagctcgccatgcaccaaggacatcacatggccggtcaacgcgatcggcgcgtgacggtgcatctgccagaatccgccggcgtccacaccatattcgaattcacgtccgcacaccgtcaccttttcggtaagctcgcgattgcccgccgtcacctcgccatcgacgagcacggcgtagttgtcggcgatttcggcattgccgcgaggctcgggaacagacagacgaatctgcgatccgggagtgaatcccccatcccacacgtgttccttctcggccacgttaagcaacgcgcgactggccaacggcatggtgtcgatcggcacacgcacgtgggtgccgcgtctgcgcatggacggtcggccgttctcgtccgcgatcatctcgatgcgggtacgccagtgcagcccctgctccgcctcatcctcgggcatgcgctcgatcggcacgtcaacgtcgacatggccgagacgtctcatctgttcggcgatggacgtggatttccatttaagctgtccgggcagtgagacgtgcaccaaatcggcaccgccgacgccgccgcccatggcaagcggacccgccaacggccatacgggttcgacgcggtcctcgctggcttccagcacttccgtcacttcgccagtccaaaaacggtcctcgcgatcatgtggctcgtccaacacgacgcgtaccagctcgcccggcaacgcgaatcgcacgaacacgacgcgtccgtcgatgtggccgacgcaacggccttggtcggcatatcgttcgatgcggatggtcgattccatcagtgctgttcctccgtttcgttgttgtcgtccatcgcgtcggcgtttggttcggccaacgtcttatgccgatgcatgggggtggccacgatgaggtacgacacccagatggccaacgcccagaacggaatgcccatgagcagacgtgcagtgccgagccagccgacctggttggacaggtacaacggcacctgcaccaccagtcgcagtgagaacacaccgatccacaacgcggtgatgatggtgtacgcgcggttcaatgccttgtcgccacgccaatcggcaagccatgcgcgcagatgctcggttggcagtgtccggatgaattcgatcaccaagccaagtcccggtacacgtaccatcaacgaaatggcgagcagcacgatgtagaaggcgttggtcaggaatccgaacatgtagtagttgcgcgcctcgtggctgttccatgcccagatcaggcagatgccgactgccagaaggccggagacggcgcccatgacggattggcgttggcataggcggacgatcacctgcagtacggcgagggctgcggatacgccgatggtcagatgcaggtcggaggtaatgacgaacatcaccacgaacaccacgcccggcagcatcgattcgacgacgccgcgcggaccgccgatcgcgtcaatgacggagaaatcgtcggcatcgccggcgtcggcgagcgcgccgaggccggttcttttcttgatttcggtttcagccatgcgtttgtgttttcgtggtcgtcgttcgctcagcgcacttcggagaacatcggtccacgcgacaacgtggtcttgacctcgacctgctggtcggagtcaaacggtcccttcggctggcctggaatgtccatcgtcctgcctgcctgttcggcttcggcggcttccttggcggccttgcgttcggccggggcgaccggcggatgcatcgggatgaggtcacgcggggccagcgggtcctcgccgcgttccacgacgatgttggagaaaagctggttcagcgccttggtttcggcgtggtccggatcggtggcggctttgccggagaagatgccgcgcagcatccaccgcggtccgtccacaccgacgatgcgggtgacgaccttgcgtccgcccttgaccacgaccggcagtgtcagttcggtgccgaacacgccgtcggtctccttggcgtctttgttggcctcaaccaagtcggcgcgcacgtcatcccacagtcccatggtcttcggcgcggcgaaggcttcgatctccacgctggaggatccgtaggtgatggtggtgccgagcacctgctgggtggcgcggttggccttcacgcgcagttcgatgccttggaggaacggcagatagtaggcacccatgtcgaggtattcgtcatagtcgggcacgttctcgtcgtcgacgtcccacggaccgtgctcatcgccacggccgtcgtactcatcggacggttccggaaggatggtttcctgaattccaccggcgggcgcctcggcggtttcggagatggcctcatcggccttgtcgttctcttcggcggcggcttcagcggcttcctcgctctgacgcttcttcttgccgaatccaaacagtcccatgatgttcctcatttcattacggttgcaaccgtgactagcctagcacccatgcttaatacgggctgggaatcggagtgtgtcctcccgttgcccggcattggccggatgacggccgcaaaaactcacacgtcgtaggtgatgctcagcggcgcatgatccgaccatcgcaggtcgtaggtcggagctttgtcgatgacgaatccgcgggccgtttcggcgagttcgggtgtggcgaactggtagtcgatcctccagccgacgttgttgtcgaaggcgcggccccgctggctccaccaggtgtacggtccttggatgtctccgcacagggaacgcatcacatccacgaattccaactcccccagccatttgtccacgtaggcgcgttcctcgggcaggaagccggcgtgcttctcgttggctttcgcgttcttgatgtcgagcggcgtgtgcgcgatgttgaaatcgccgcacaataccgcctgcttgccgccgtgcgccgcttcatcgcgcagttgtcccatacgtaccagcatggtgtcgaggaaacggtatttctgcttcattttctccggatcgtcagtgttgccggcgtgcacgtacacgcatacgacagtgacggtgtacccttgcggggtcttcacatccgcttcgatccaacggccggaatcgacgtcctcggcaagtcccggcagtccgtagcgcttgtcgatgacgggcagcgcggagagcagaccgacgccggcgcgtcccttgatacggcagatctcgttcatgcgatcaagcccgctttggtcggcgatgcgtccggcggtcgcgtattcgaagccgaattcgtcgaagatggggtcgatttcgttttgcggggcgcgtacttcctgcatgcaccacacgtccggcgtgttcttcgcggcccattgctcgatgcctttgcgtttcgccgcgcggattccattcacattcgatgtcgtgattgtgatcgtcatagcgccttagcctagccggaatacaagaaaacctcccttgtgggaagggaggttttccagatggctgacgcgatcagtcgagtccgagctgcagcttgccgcctgggatggcgtccagcaggtcgcgggtgtactgcttcttcggatggtcgaagacctcgtcggtggtggcatgctccaccagcttgccgtgctgcatcaccacgacctcatcggcgatctgacgcaccaccgccagatcatgggtgatgaacaggtagctcagtcccttttccgcctgcaggtcgttgagcaggcgaagcacctggtcctgcaccagcacgtccaatgcggagacggcctcgtcgcagacgatcacatccggatcgagggccatggcgcgcgcgatggcgatgcgctgcctttggccgccggaaagctcgttcggataacggctcatcaccgattccggcaattccaccatgtcgatgagctcgcgcacacgcttggcacggctcttcttgtctccgatgccgtggatgcgcagcggctcctcgatggaccggtagatggagtacatggggtcgagcgatccgtacgggttctggaacaccggctgcacatgacgtcggaagtcaagcaactccttgcccttgaatccggagacgtctttgccgtcgtaggtgacggtgccggcggtcggctcaagcagtttcagcaccatgttggccacggtggatttgccggaaccggattcgccgacgatggccaatgtggtgcccttcttgatggagaagctcacatcgtcgaccgccttgaacatctccttcttgcgcggcagtttaaattccttggtcaggtgatccaccgtgatgatggcttcgcccttcttcagggaatcctcgttcaccgcgtgctccatgaccgcggtggcgtcgccgccatgctccttgacggagatgatgcgctgcgatgccaaggacggcgcagcggcgaccaaacgcttggtgtacggatgctgcggatgctgcagcacttccagtgaaggaccggattccacgacctggcccttgtacatgaccacgatatgctgggcgcgttccgcggccagaccgagatcgtgggtgatgaacagcaccgcggttcccagggaatcggtcagcatgtgcagatggtcgaggatcttcttctgcacggtcacgtcaagcgcggaggtcggctcgtcggcgatgagcagttccggacggcaggccagaccgatggcgatcagcgcacgctgacgcatgccgccggagaattcgtgcgggaactggcgggcacgggtggcggcgtcaggcagaccggcctcggacagcagaccggcgatgcggtcgtccatggtggagccgaccacatacttcttggcgatgtaccatgcgtcatcgtccttcaccccggccttgatcaggccatcggccacacgccagcgggtttcggatcccggaacccattcctcggcgaaccgggccatgatcttgtcaagctcgtcaccgctcttgccgatcttgacaagagcctccttggccgcggcgatcagatcaggcagttccttggaaccaaggaaggtctcatcgtcattgcccttgagctccacttcgtcaccggccagggccttggcgaattcggaacgcttttcgtggtcgatgtccatgttgttggccaccaacgcttccttgacctgggtgccgatgcgccacaccgggttcaggttgctcatcggatcctgcgggacaagacccatcttgctaccacggagcttgtcgaaatccttctgcttgaagccggagatctcctggccatcaagcttgatggagccgccgaccacatggccggttcccggaagcaggccaagcacggccatggcggaagtggatttgccggaaccggattcgccgacgatggccacccactggccgggatacacgctgaaggacgagttgcgcacggcatgcacggccttgccttcatcggtggtgaagtcgacctggaggttcttgacctccaacagcggcccgtgggcgcgctgcatggcctcgaggttgttctcggtattcatttcagtcatcgaatatcccttcacttacactcaggccgtacggctcttcggatcgagcgcgtccttgacggcgtcgcccatcatgatgaatgccagcacggtgatggccagcgcggcggacgggtagaacagcaccatcgggtcagtacgcaggatggactgcgcgttggagatgtctccgccccagctgaccgtggtggtgggcaggccgacgcccaggaagctcagcgtggcctcgagcacgatgtaggtggccagcgaggtggtgccgaccacgatgatcggagccagcgaattcggcaggatgtggcggaacaggttgcggatcggggtggatcccagagcggtggacgccgtgttgaattcaaggttcttggcttccatcacagcacctcgcgcgattcgtgccacggaggtccagccgaacagcgtcatcaccagaatgatcttccagatggagctgctcgttttgaacatctggagcaccacgatggcgccaagcagaatcggcagcgcgaggaagatatcggtcagtcggctcagcacggcgtcgacccatcctccgaagaagccggcgattgcgccgatcagcgttccgagcagcaccaccagcagtgtggcgaacacgccgacgctcagcgaggtgcgggtgccgtagaccacacgggagtatacgtcgcaaccttgcaggtcgaagccgaacggatggcctgaggaagccggctcaagggaattgtcgagcgtgcagtagttcgggttctgcttggtcaacacgctcgggaacagcgccacgaacacgatgaagatgatcagcagtccggagatgatgaacagcgggttcttacgcagggttcgccatgcgtcggcccacatgttcgaagccggtgcggattcgtccatcgagtcgacggccttcaggggcgtctcatcgagcggtgccacatagcgttcctgtcccggaagcacggtggaaggattggtctcattcatttcggtcatttcttgttccctccctcgactcacgcgtaacggattcgcggatcaagcgcggcgtacagcatgtcgaccagcagattgcaaaccacgaagatcagcatgagcagcgtcacgatggacaccaccaggttgccttctcccttgaggatgctctgataggtcaggtagccgatgccatgcacgttgaagatggtttcggagatcatcgcgccgcccatcagtgcgccaagatcctggcccagataggtgacgacggggatcatggagttgcgcagcacgtggcgcagcatgacggatttgttgtccatgcccttggcgcgcgcggtgcgcacatagtcgagggcgatgttggacgaaatctccgtacggctcagacggatgatgtacgccatcgatacagagccaagcaccatggccggcatcagcagatcaaggaatcctggattcgttccggcggtgaccggcagcagatgccacttcacaccgaggaagtactggcagaggaagccggtgacgaaggtcggcacggagatgagcagcagggagaagatcaggatgacggtatcgcaccacttgcccttcttcaggccggagatcacaccgaagatcacgccgaaaaccgcttcgaacacgaaggccatcagggcgagcttgatggtcacggggaaggcgcggccgatcacgtcgatgacaagctgtccggagaaggtcttgccgaagtcgagggtcagcgcgttcttcaggaacagcagatactggacgatgaacggcttgtccagattgtattcggcacggatctgggccgcgaccgcttcgttgaccggcttgtcgccgaacatcgccttgaccgggtcgcccggcaacgcgaacaccagggcatacaccagaagcgtcgtgccgagaaccacagggatcatctgcagaatgcgtcgcagaagatacttgcccattggtttctccttttgattactcactcgttcgccagccgtttgcggcttcgtcccctacgctcacgcgtataggacatgaggcccggggcggccggcgcttgccccattacgtatcagtgatactgcaccacaatgctttatattgcagtttcatgaaagacagctgaaaatataccccacgcgcggacatcttctgttgatgtcgcatgtccagccgtcatggacctccgatggaagccccgtttattacgcggaaaggaaggaacggatattcgaatccgttccttccttcatgtcgatcctacgaaatcaaaatcagagaacggctcacttgccggacttggtcatgttctcgtagaccggcaggttctgccagttcatctcgaagccggagacaccggtcgaggccacaccataggcattggcgtagtacagcggaacggccggcaggtcgttgagcagcacttcctgtgcctgctggtacagcttgttggcgtctgcgacggacttggaggcagcggccttgtcgcacagcgcatcgaactccgggttcttgtagtcgccatcgttggagccgttgccatcggcagcggcggaggcgaagttctgcaccaggtagttttcggcggacgggtaatccggctgccagccgctacggaacgcgccgttcaccttgcggtcggacacggcggtgcggaaatcgttgaaggtcgggtacgggttggtggcggccacgccggcgcccagcacgttgttgatggagttgaccacggcggtgtagatgacttcgtggccaccatcggcgttgtaggcgaaggtgagcttgtcatcggaggtccacgggctgatggcgttggccttcgcccacagttccttggctttcttctcgttgtacttcaggttgccggaacccttgagggaatcggagtagcccggggtcagcggggaggtgaagtcggcggccggggtgccggtgccgttgagcaccttcttgcagatgttctcgcggttgatggccatggagacggcctggcgacgcagggtgccttcctcggtgtcggcttcgaagtgcttcagcttggccgggatggtgaactgctggatgacggagccggccttgttgtaggcctgtacggtggagtccttctggaaggtcttggtggcggaggccgggacggactccatcacgtcgagggaaccggactggatgtcggcgtaggcggcctcatccttggtgtagaccttgaaggtcacgccgtcgttcttggcgacgcggttgcccttgtagtcggggttcttcaccagcacgatctggttgtcgtggtcccaggactggaacttgtacgggccgttgccgaccggcttctcgccgaaggccttcggatccttgaagaaggattccggcagcggagcgaatgcggtgtagccgaccttgatggcgaacacggagtcggaacggttcaggtcgacggtgaattcatggtcgttgacgaccttcaggccctcgagctgttcgtcgcccttgagcttgtctccatcctggagcttgtcgtagcccttgatggtggagaagaaggaggagccgagctgtgcgttcttggcgttggccgtgtagctccatgccttggtgaaggattcggcggtcaccggggtgccgtcggtgaacttccaaccatccttgagcttgatggtgtactgggtggcgtcatcgttggacttgatggactccgccacttcgttggaggcgttgcccttggcgtcgaaggaaatcagacgtgcgaacagcaggtcgagcggcttgccgccgccggtctcgttgcagtcgcccgggatgagcgggttctgcggttcggaattgtatgcggtgatgacgttggaacccttgtcagcggtggagtcaccgttggaagagccgcaaccgctgagcagcatgccgaatgcgcatgcggccgcagcgaaagccagagctttcttcttcatggaattcatattctccttatccattatttccagagccgtaagaccctgctcaaaaagaaggcgggcgtcaataccgtggcatcaacgtccgtcttcgttctgatggtgggttcattatcgctcgattgagggacaaccgctccatatccgagggaggcccatgcaaaatagccaaatcaaaactcatcatctgataaaacaatccgtttttccctcttatcgccgggacaacttatccgcatcgtgtgtatggacggacgcggacatatccgttcgctgtcagcgtactttgccaatccgcgtcacgcccgtggaaacgcctgcccgtatcgtgccttcaactgttcgatggacacgtgtgtgtaacgctgcgtggtcttcagcgaggaatgccccagcatctcctgcacctcacgcaggtccgctcccccgtcgagcatatgggtcgccgcactgtggcgcaacgcatgcggactgatgtctggcacgccggcctcccgtgcccggtcgtgcaccaccttgcgcaccatacgttgatcgatccgcccgccctgcgatcccaaaaagaacgcgtcgtccgacatgtcaccgcatagtacgggacggccatgttccagccaatcgcgcaaggccttgtcggctggtgcgccgaatggcatgacacgctgcttgtcgcctttgccggtcactttcaccgtgcggttgccgaatgtcacgtcggccacgtcgagtccgaccagttccgccacacgcatgccggtggcatagagcagttccagcatggccgcgtcacgcagcgcgatcgcctgttttttcatattcggttcctgcgatcgcgcctccatgccgtcctcatcaacgcggtccatcagctgctgcgcctgcgtttcgttcaataccgccggcagcgtatcggggattttcggcgtctgcaacgaagccgccgggttggcggacgccatgtcatggtcgtacgcccatgcgaagaatccacgcacggcgacggttttgcgcgccatgctgctgcgtgcgtgatttttggacgattcggccatccacaggcgcaaatcctcgatggtcacctcattcagatccacgcaaccctgtttccgcaacgccaccaagcattcctcgacatcgctgcggtacgccctgcgggtgtttgcactcaatccacggttggctttcagataggcgtcgaatccgtccaacgcatcatcgaaacacatgcaaaccaccttccgcttcgtctgaaatgaacagacaccacgcagacaccgtataaatgccattccgcaacgcgatcgaatgtcatctcacgcgatggcacgattccattatgtccccataccgatagactgatgacgattaggcatcctacgaacaggcggtattatgactcgtcattccattcatgacgtacagcatccgacagccgaaaaccccgatgatgggattgtggcccgcgccatcgacctgaccaaggtctacggctcaaaagacaacgaagtgatggcgttggatcatgtgaatgtggaattcaagcgcggtgaaatgaccgccatcatgggcccttccggttccggcaagtccacgctcatgcattgcatggccggactcgacgccccttcgtccggcaaggtgatggtggagggcctcgaggtctcctccatgaaccagaagcagctgacggatctgcgccgcgaacagatcgggttcattttccagtcgttcaatctggtgccgacgctgtccgccgaggagaacatcctgctgccattgcagatagcgaaacgtccgatcgaccgcgactggttcaaccaagtggtcaaggtggtcggtctggagaagcggctcacgcaccgtccaagccagctgtccggcggccagcagcagcgtgtggcctgcgcccgcgccatcatggcacgaccgtccgtgatcttcgccgacgagccgaccggcaacctcgactcgcgttccagccgtgaagtgcttggcttcctgcgcgattcggtacgcgactacggccagtcgatcgtcatggtcacccacgatccgcgtgcggcctccttcgcggaccgtgtgctggtgctcgccgacggcaacatcacccgcgacatgcagcatccgacgtacaacgagattcttgaggtgttcgccggcgacgacgacatcgacgatgtttccaagtacgccgcctccaccgccgttccgaccgtgacggaggactcgcaggcatgattcgcataggattgcgcgacgcgcgcagccatttcggccgtttcatcatgtcgatcgtggccatcgcgctcggcgtgagtttcgtggtcggctcgttctgtttccgcgaaatgctcaacaaccaggtttcacagatgatgtccaccaatgcggaccatgacgtgtacgtgcgcggttcgcaggagaagaaaaaagattcgtcggcgatgtcgatgggatcgacgaaaaactacaacgatgtcgacgtcgatctggcgggtacgatagccaaggtcgacggtgtttcctcggcacgcgtcgtgcacatgctgtccggcgtagtgctgctcgacaagcatggcgatgcggtgaccaccatggggtctccgacgctcgccataggcatgggcaagtcgtcgccgtggcggtccgccaagttcacgaccggcacgtggccgaagaacggcgatgagatcgcccttcattccttcgccgccgaacagtcgggtctgaaggtcggcgataagacgaaaatcgtctatccggacggcgctcataaggtgaccgtcagcggcatcttcaccaccgatgccagccaggcaggcgccatcatcatcgccatcgatcccgcgacggccaaggaacaggcgaacaagcaatcggacgatccggacaagactgcgttgatcagcgtctacggcaataagaccacgccgcttgacgacaacgcgcagcagcagctggcggaccgtatcaacaaggcgctgccgagatcggcgaaggcacatgccatcaccggtgatgaataccgtgacgaatcaaccaaatccacgcaggacgcgctcggcttcatccaaccgcttattctgattttcgcggtgatcgcattgtttgtcggctcgttcatcatcgccaacacgttctccatgatcgtgcgcgagtcgatgcgcggctatgcgctgctgcgttccatcggcgcttctcccctgcaagtgttctccacggtgatcgtgcaagctctgttgctgggcctggtaggttcgctcgcaggcatcgggctcggctggggcatggtcaaactcatcgcatccggtttggcgaatatgggtatgccattgaccggcgccaccaatccgaccgtttccgacatgctcgtcggccttgtggtcggcattgtggtgacgttgatcggtgcggccctgccggcgcgaaatgcggcgcttgccccgccgattcaggcgatgaacgaaaccgtcaatccggaaaagtctgtcctcgcacgtggcatcctcggcaccgtcatggtgctgttgggcttcctgagctggggcttcacctacgctttggccgccgcggatggtgacggcggtccgacgccgtggaaggcgctcaacagtatcgctgtcggctggccgctcggtattggcgcggcgctggccgtgatcggcgtgattgtggcgggaccggcatacgtgtccaccgcgggcgcggtgctcggctggctgccatcgaaggtcttcaccgtgaccgggcgtctcgcgcaacgtaacatttctcgttcgaaacgtcgcacgtccaacaccgcagccgccctgttcgtgggagtggcgattgtcagctgtctgggcgtggtggccacgtcggcgaaggcttcggtcaattcgctggtggataccgggctcaaagccgatttcgccgtatcttcggcttcggccgggcagattcccgaccaggccatcaaagacatcaaaaaggtcgatggcgtgaatcatgtggtgtcgaaccgtgtggtgcttggtgtgaaatatgacggcaaagccatcaacgggttcacgttcgccacacagccggaactgttcaccaagatcttcgccgccgaaaccaccgaaggtgatgccgctgccgcgttgaaggatggcaagctgctcgtcggcaagaccattgccgacgatcgtggatggcatgtgggtcagaaggtcaaggccacggccgagaacatcgtggtagacaaggaggccacagccaaggcgcaggccgattaccaggccaaggtgcaggcgcatgtgcaggaattgcagtcgcaggcccagcaattggccgcatccggcgacttgacaggagcgcaggccaaggcttcggaaatcgaacagtacacgaacgacgccaagaacgtcgatccgaaaacgctggtcaagacgaagaaggtcaccaccggaaagacgctgaccatcggcgcgatcgtgtcgaattccgtataccgcgatttcgcgatcgtcaacgacgatttggccgagcaaatcggcaacaagcagaccatgttcgtcatgcaggcgttcgtcacggacaagcggggcgccgacacggcccaagtcaagaaggccctgaagaaaacaatcaagaaatactatacaatcgtcgtgttcgatcgtgacgagtacaagtccacgatgagctcgatgatcgatcagatgctcatggtcctgtacgcgttgctggctttgtccatcatcatcgccattttcggcatcgtgaacacgctggcgttgagcgtgtcggaacgcaccaaggagattggtctgctccgtgtcatcggcacgtcacgtggccaggtgcgtggcatgcttggcatcgaagcggcgatcatctccgtgttcggcacggtgttgggtttgatcgtcggcgtcgccgcgggagtggtgattcgtgcggtctacgcgtccgaaggtttggagacgctggcgattccgtggttgcagctgctcgtgttcctgctgctatcgattgtggtcggtctggtgtccagcatctcccccgcctcccgcgcgttgaagcagccggtccttgacgccgtggcgagcgagtgagacagttggagcggaacatcgaaaggaggcagcaatgcctattcccaatgagattccagtaggagcgcgcatcgtggtgcgcaccttggaaggcgtcgatcctaccgatcatcgtatgaagttccgcgattacgtaggccacgtgcgttcgtgggacggtcagaaactggagatgacgcgcgatgcggcggcgaacggctcacgtcccgagcagcgtgtcacgattcccgccgacgaaatcgtgacgatcaagccggtgccggaacgttccatgactcggccacgtccgtagtcgcatacctccccctaccgcgcgcaaagacaagagcgccgcaatcgcactgattttctgcgattgcggcgcttttgcatagcgatggcgtcagtcgtcagaccacggaacgcgcctgcgcgatcgcggtacgctcgccgtcgaatcgcacgatatgctcgcctctgcgggcggattccagcagcgtgcgctgccaatcgttttcgggaatcgacagttcgaccgtcgcgcaatgttcggcgtactccggctgcctgctggcggccttgtagtcgcggaacggttggccttgggcgaagaaacggtccatttgcttcacgtcgccttccgtagggcgcacgccggtatcggccatgtcatgcagcacgttggccaccaacgtcaatcggttggccatgttgcgtagcaaggtctccacgttggccgcgtcctcctccaccatggcacgtgtgcggttcggatcggtcagcgccacgcgcgtcatgtcacgccaggacccggctgcgagcgcggccgcgatgttgcggttcgggttggccaccagctcgttgatcatggcggtggcgatgacgtgaggcatatgtgagatgagcgcggcgcaacggtcatgggtggcgtcgtcaagtacgatgagccggttgccgcaacggttcacgatcatgtcggccacggcgcggaaccggcggtattcggtgtgttcgtcgacggtgatggcccagagcgcgtcgtcatagagtgtcgggtcggatgcctcccagccggacagttcgttgccggccatcgggtgtgctccgacgtagcagccgtcaagaccaatggctttgacttggtcgcggaccatgcctttgacgctgcccacgtcggtgagcgtggttgtttccgtgtcgatcaatggtttcaatgcgccgaggatttcgggcatggccttgagcgggttgcacagtacgagcacgttcggtttggtttcggcgagtgccgccaaggtgggtttgcagatgatgccgtcggcttcggcggtggcgtaggggcggtcgttgtggttccatgcggtcacttcgcagccggcgttgacgagtcggcgtgccagtgatcctccgatgaggccgagtcctacgattgcgatgcgtggcttcaccacatcagctcccttctgacggtttcgtcgttctgccaatcgtccggcaggtggctgtcgtcgagtcgtacgccgccttgcggcagcatccatgaggtgacgggcgggttggggtgttccctccgcgggtagacggcgagtgttttggcccagtcgccatgttctgcgatttccacaagcgcgtcgcggaaacgttccttccaaggggcggcgtcgagggtgacgatgaagctgtatgtgccggtgcgtcctttgatgggccgtgagatgaagctggtcatgttcagtcccgcgtcacggaacacgtcgagcaggttggcgagcacgcctgggccggtgacgagcgggatgagcgtcaataccgattcgtattcgacgttagcttcggcgcgtggtttggcgagcagccgtgcgacttcggcgcgtggcgagagcacgaggaagtcggtggcggctccttggtagtcctggatggcggtgccgatgcgggtgatgtcgtacagttcgccgcagatggcgggaccgaaggcgatttcacctgggataaggtcccggcaggccgccgcgttggatgtggccggctgtgtggagagccgatgttcggcgatgaatcgtttgcattgcgcgagaccgtgcggatgggctgtggcgatgcgcgcttcggctggatcggctccttgcgccacgtatgcgtcgaattcgacgttcacaccgacgcgtgcgaatccgacaaggtccttcgcgtcgatcagcgcgtcgaggttgggcaccacgtacccttcgacgttgttctcccaggccacgattccccagccgtcgccgtgctgtgcggcgtcgagaatctgcggcacatcgtccatgggcatcaggtcgaagccttgcggttcgaaccgtgccaactcttgggcggcattgacggccgcctgatgggtgaaggtgccttgtggccccagatagaacagcttgcgtgcgctcattgccgcctgtgcctccttgttgcgggtcatcctaagcaccttagcgcattcgcgaggctgtggaggggtctagtccaccggttgggcggtgtcatggtccggttcagacgattcgttctggtcatattccgtggagtcatcctcagtgcgcggcggcatcgtgaaccagctcttgggcagcgccagcatgatcaatggaatcagcaccacgccgtatagccagaaatagccggcgttgttgctgaaatacggcaacgtcgccgtctcgccgaatccgacgggaatcatggcgtccccgcccggaccgtaaccggccatgacggtccagaccaccagtgatgaactgatcagatgcaatgcgaggcccgacacgccatcacgtgaacgcgccgaccatgtcgagatgatgaccagagcatatgcgatcacaagaccgtagggaatattcgccgacgcgcccatgcggtgcgccatcgtgccgatcacgccgacgacggcaccggcgagcaggtcaaccaaaaaccgcgcccataccggtagacgatgcgaccacggcagcagcctgcggtcgatgccgtcctgtgattgcgattgcggttccggctgtgtttcctgcgtgcgttgcgtcatgtcctccactatgccctacgttccttacaaaacagcaagaaaggcaagagatacgcggaaaaccgccgacatctcttgcctttcttaagcgtttagctcactagcggaacacactaccgttcccgcgaagcgccaaaacaatgcgaagaatcacttgttattctgagcgttgttctggcgacgctgcttggcgcgccacttgtaccaatcctcacggctcagaatgatcttgcgcacgcggatggactccggagtgacttccacgcactcgtcctcgttggcgaagtccagggactcttcgaggctcatcttgatcggcggggtcagggtttccagcacgtccgcggtggcggaacgcatgttggtcatgtgcttggccagcgtgatgttcacatccagctcgtccggcttgttgttgatgccgacgacctggccctcgtacaccggggactgcggctcgacgaagaagttgccgcgtgcctgcagacgctgcatggcgtatggggtggcgacgccctgacggtcgcagaccatggagccgttctggcgggtcacgatctggccggcccacggagcgtagccagcggagatggaggaggcgatgccggtgccgcgggtggcggacagcagcgcggtgcggaagccgatcagaccacgggacggcacagtgaactgcagacggacccagccggtgccgtggttggtcatgttgtccatgcggcccttgcggtcggcgagcagctgggtgacggcgcccatgtactcttccggcacgtcgatggtggtgttttccatcggctcgttgaccacgccgtcgatggtcttggtgaccacctgcggacggccgacggtcagttcgaagccttcacggcgcatctgctcggcaagcacggccagtgcgagttcgccacggccctgcacttcccaggcatccggacggtcggtcggcagcaccttgatggacacgttgccgatgagctcgcggtcgaggcggtccttgatcatgcgggcggtgagcttgtggtccttgccttcggtgccggcaagcggggaatcgttgatgccgaaggtcatggagatggccgggtcgtcaacgtggatgagcggcagcggacgcggatcgtccgggtcgacgatggtctcgccgatcatgatgtcgttcacgccggcgacggcgacgatgtcgccaggacctgcggattcgaccggggtgcgctccaggccctgcgtacgcagcagctcggacacgcggaagttctcgatggagccgtccacacgggacaggccgtaggtcttgcccttctcaagggtgccgttgtagatacggaccagaccgagtcggccgaggaagtcggaggaatcgatgttggcgacgtgggcctgcagcggagcgccctcctcgtattccggagccggaatgttcttgatgatggcctcgaacagcggctcgaggttgtcgttgtccggcagaccgccgttttccggctggttttcggaagcgtaaccggccttggcggcgcagtagatgaccggaaggtcgaagagggaatcctcatcgaggtcgatgccttcctcgatgacgtcctgggccaggccgagcagcaggtcggaggattcaccgacgacttcggagattcgggcgtccggacgatcggtcttgttcacgcacaggatgaccggaagcttggcttcgagggccttgcgcagcacgaaacgggtctgcggcagcgggccttcggaagcgtcgacgagcagcacgacgccatcgaccatggagatgccgcgctccacctcgccaccgaaatcggcgtggccaggggtatcgatgatgttgagggtgatgccttccggatggccgtacttggcggccagcgggccggtgtactgcaccgcggtgttcttggcgaggatggtgatgcccttctcgcgttccagatcgttggaatccatcacacggtccgggacttcctcacgctcgttgaacacgtgggactgggccagcatcgcgttgaccagggtggtcttaccgtgatcgacgtgtgccacaatcgctacatttcggatatcgccgcgaaccgccatcgaaacctctcttagtgttgctgttctcttacgtaaacgttcggtacgtacatgctatcggtacttaaaaatccgtacttacacacaaaccgagccaattctagcgaagcattacgacacatggaaaacggcggacctgtcagatcatgccgacaggcccgccgtcaatcgcgcgaagagacgcgcggaccttaatcctcaagctccttgccagtgcgttcaggcaggcacagggccgccacgcaggcgagaatgaacgccacggcgaaaacgatgaatgccacggccttgttgccaccggacaaggtcaggaaccatggcatcagcagcggcgcgatgatcgcggccacacgaccgcaagccgcggctgcaccggaggcggcgccgcgcagacgcgtcggatagatttccggagtcaccgcgtacaacacgccccaagcgccaaggttggacgcggacagcagcatgccgaagcccagcacagcggccacggaaccggcttgggagaaggcgaacgcggccacggcggacacggcgaggaacacgctcagggtcttcctgcggccccagatctccaccagccatgccgcgaggaagtagccgggcagctgtgcgatggcgatggcgagcgtgtagccgaacgacttggtcagcgagccgaactggtcggccagcagagacggcatccacgtgaacgcgccgtagtaggagaagttcacgaagaaccatgtggcccagatggctgcggtgcgcgcaagatacttcttgccgaacagctcgcgggttttgatcttcggcagcggctcgcccttcggggatgcgaccggttcgacgcctccggcctgttcgaagtagcgcacggcctgctcggcctcatcctcacgtcccttggattcgaggaatcgcacggactcagggatatgaatgcgcgtcacgatggcgtacagcagcggcaatgctccgatgagcagcgcccagcgccatccccaatcgccggtgttaggaatgacgaaatagccgatgcaggcggcgatgatccagccgattgcccagaaggattccagcagcaccgtcatacggccgcgttgtttggtcggagagaattccgagaccaatgtggaggcgaccggcagctcggcgcccaggccgaggccgatgaccagtcgagcgatcagcagagccgccagcgaccatgacaacgccataccgccattggccagaccgaaaatcaccagcgtcgcggagaagaccgtcttgcggccaacgcggtcggccacgaagccgccaagcgcggcgccgatcgccattccgacgaaaccgatggacagcacccagcttttctcggtcggcgtcagattgaaatgcgggtcggccgcgatggcggccacgacgaacgacaccagaccaacgtccatcgcgtcgaacgcccatccaatacccgaagccaccaacagcttcctgtgcgccttgttgaacggcagtcggtcaagacgctcgttgcgagtcagcgagacctctcccccaacagtttgttgcgatgcggacatcaacacccctttatcattgttttcctattgtgtcgtgagctcgttcaagcccgacgatggcaggcgatcacgccgtcatcaatgcggataacgcgtcgtcatcctggaaagcaattcgagtgtcgtccgattcggatgccgttccggcttcggtccacaaatccgttcccggcttccggctgtaccggtagaccgccgccggcctgttacggccgatccgcagtttctcaccggtgtcttccaacagtccggaagcaagcattttacggcggaaattcgccaaatcgatacgctgtccggcaatcgcctcgtacacgtcatgcagttggctcaacgtgaatcgctcgcccaccaatcgagtggcgatgtcaggcgattcgattttgccgcgaagccggttcatggcgtattcgacgatggtgcgatggtcgaacgcaagttccggaagatggttgacggggaaccacttgacgttgtcccctccggcgaagtcgattcgtccatcggcctcgcccaccagggcccagtacacgatggacaccatcggcagaccgccatgcgaacgtgccggatcgccgaacgtgtaaagctgctcaagatatttcggatgcagcgacgtcgtcgattccagtgcggcatacgccgactgttccaatgaatggtcggccctcagaccgcctcccggcaacgcccattgccccaaaaaaggctgacggacgcgtttgaccagcggcatccacagggtggagcccatgccggacgaagcggcaccagcgcccacatctgactgcggaaccggtcccaaagccagaatcaccacggatacgccgacctgcggaggctgcttgcgccgttccgagacattgcccatgatcaattgatggcctcttccaatacttcgaattgcttacaggaaaggagtctaacacttatagtcaacatgactataagtgtgtcgagtcgctcataaacaccaagagcccccaacggggctcttgcaaagttcaggccacgatgtcgttggcgatcagctcgcgggccacttcacggtattccttcgccgtcttgtggttcggcgcgtagatggtgatcggcgcggccgccaccgtggaatccggcagcttgatggaacgcgaaatcacggaatggaacaccttgccttggaacgcctcgtagatacgctgcaacacctcctcgcaatgcagggtacgggtgtacatggtgaccagcacgccatacacttcaaggctcggattgatgcgcgactgcaccttctcgatggattgcatgagcagcgccacgccacgcagcgcgaagaattcggcagcgaccggaatgatcacaccgtcggccgcggtcaacgcgttcaccgtcagcaggcccaacgatggctggcagtcgatgatgatcacgtcgtactcgtccttgacctggcgcagcacaccggcaagcacctgctcacgtcccacttcggtgaccagttgcacttcggcggcggacagatcgatgttggccggcataatgtcgagattctcgaaatcggtgtggtgaatcacgctgtgcacgtccatgcgcggattgaacaacgccgtgtacacggtatcctccaccgcgttggcgttgatgccgagacccaccgtggcggcgccttgcggatcgaagtcgacgatcagcacgcgcctgccgtattggcttagcgcgccgccgatattgatggaactggtggtcttgccgacgccacccttctggttgcacatggcgatgacccttgccggaccgtgcgtctgcagcggctccggtgcgggaaacgtctcataatcacgtccaagcaaatccgtaggcataccgtttaccttaccaacatcctcgtgtcaaaaattccactgtttccatgctagcccatcatcgccgtcagaaacggcagcaacacatgcatctcatgctatcttgcccttggatgcgaggtcagatatgtctcgatgaggttctccgggcttacatgcgtgtagatctgcgtggtggtgacgctcgcgtgacccagcagttcctgcacggtgcgcacgtcggccccgccttggatcagatgcgtggcgaaggaatggcgcaatgtgtgcggatgcaggggcttgtcgatatgcgcgcgttccccggccgcacggatgatctcccacaccgattgccttgacagtcgtttgccgcgcttgttgaggaacaacgcgcgtcgttcggtgggccctttcgccttcgactcgagctgcggccgtccgtttttgaggtatcttgcgatcgcctcacatgcgtaactgccgaccggcaccagacgttgtttggagcctttgcccatcaatctcgcaacgttcgattccaagtcgacatcgtcaagattcgcgccgcacgcttccgacacgcgggctccggtggcgtacatgaattccagcaacgccttgtcgcgcagcatcgcgggatcatcgggcatgtccgccatgccttcggattgaggccgattctgcgagacggggatcgcgtccagcaaactggccacctcgtccacagtgagcacgtcaggcagcgtcgtcgcgcctttgggagccttgacctgtgccgcaacgtcattggacaccacatgttcgttcagtgcgaagcgatggaatgcatggatgctggccagtcttcgtgccttgctgcgcgcggattctccggaatcgtcaagaaaggcgatgtatcgttccacgtcctgcgtggtcactgcattaaggtcttgaatgccttgcgtcgcaagccagccgttgtatttgcgcaggtccgagtcatatgcgcgcaccgtggctttcgcaagtcctcgttccacgtcgatgtacgcgaggaactgatcaatcaagcgttcgatatccgtcatcgtggtcctccgtttgcatcgtcatcatttgtcgtgtccgttccgtcacgctcccgtacggaacgcgttgcccgcatggaggattccaaggacgttcgttccaagtggaagccgtcattggatggaaatcaacattccggaaagtctattcaaagtatccggtatggggaacgcgatacgcaagaacccccgtccgtttgccggatcgggggttctgaagttcacaggtgaaccgtcggggaaactcaggcttccttcggagcgttcacgtcagccggaagagcggccttggcctgctcgacgatggccttgaaagcctccggatcggagacggccagctcggcgagagcgcgacgatccagctcgatgccggcaaggtgcaggccctggatgaagcggttgtaggtgatgccttcggcgcggacggcagcgttgatgcgctggatccacagcttgcggaagtcgcccttgcgagccttgcggtcgcggaagttgtaggtaaaggagtgcagcagctgctccttggccttacggtacaggcgggagcgctggccgcggtagccggaagccctctcgagaacgacgcgacgcttcttgtgggcgtttactgcgcgcttgacacgtgccatatttgattcctcagctttctattaagtctttgtttctaagctctcgctatgctcagcgaccgagcagcttcttcatgttcttgctctgggaagtggccagaacaccgtcggccttcagctcacggcgcttacgagcggacttgtgctcgaggttgtggcgcattgcggagccggcgtgcatcagcttgccggaaccggtcacgcggacgcgcttggaagcggcggaattagttttcatcttcggcattgctgccctccttgtttgttacttcgtttcggaagtcttcggtttgtcggatgccacggctgccttggctgcggctgcggccgctgcctgggcctcctgcttggccgccagacgagccgcctgacgagcctggcgctcggcacgggactgatcgccacgacgacgctgctcggactgggtatggaccttcttgcccttcggcgcaagcgtcatgatgatgttgcggccttcctgcttcggagcgaattcgacagtgccgtattcctccacttcgctggcgagacgctgcaacagctcgacgccgccgatcggtcgggactgctcgcgaccgcgcagcataatggtgaccttgaccttgtctccgccgttcaggaagcgcacaacatggcccttcttgacctcgaagtcatggtcgtcgatcttcagacggaagcgaatttccttgatttccgcggtgctctggttgcggcgcgcctcacgagccttgatcttctcgttgtacttgtacttgccgtaatcgatgagcttggcgaccggaggcttcgcgttgggcgccacctcgacgagatcgaggttcgcttcctttgccaggttcagtgcgacggaagtcgcgatgactcccacctgctcgccgttcgggccgatcagacgcacctgggagacgcgaatctcgtcgttaatgcgtggttcgtcgctgatgatgactccaatcctcatattccatgcaacggaacatcctttgattggcagttttccaaagtctcgattgttcaaggcatgccaaaacgcatcacaacgcgccgtaaacccgtaagagcggcttacatatctcaccgagacgaccggtggaaggcatctgcctgaacccgaggccctgaaaggcttccaggtggggatatcccgctttcttgatttctcaagccttgtagataataccacaccccgggaccagcgcgtgtcgcaccggtcccggggtgttcgtcaccattcggacggcatccgccgtcaggcgatggcgatgacgtctggcttctcgccgtcgtgcacgaagtagacgtcgtaccacgtcaggaacgagtacacggtccagatcttgcggcgatcgtcggttttgccggcatagttgtcatcgatcatcttcagcagcgcgtcctggtcgaagaactggctgacgtaatcgcgttcgaacacggaacggacgtacttgtagaacttctcctcacgcagccacttcttgatcggcaccgggaagccaagcttctcacggtcgtaccattccttgggcagatgacgtcccgccgcctggcggaacgcgtatttcgtgttctcgtcggtgatgaggtacttggtcggcacctgctcggccacgcccatgagctccttgtcgagcagcggcacacgcaattccagcgaatgcgccatggtcatcttgtcggccttgagcagaatgtcacccggcatccactgatgcatgtcaaggtactgcttcttcttcagttcgctcagacccttgccttccacacgcgcatacgtcttgtcgacgatgctttgcacgctcggcgccttgcggtattcaggcttgagcagctgttcggactgcgattcctcaaacacacgtgcctgtccgatgaagctttcctcggccggcgcaagattggcgtacagatgccatgcgcccgggaaggtcttgcccttgcagaaccgggcgatcgccttgcgcgcgccggctggcagatgcgtgagccagcgagtcaccaccttgatgggcttgaatttggtgtgcacgccgtagtcgatgtatccggcgaacaactcgtcggcgccttcgccgctcagcaccaccttcacgtctttggcggccaatgcggacaggaagtacagcggcacgcagctcggattggagtccggctcgtcgagatgccattggatgcgcgggaacgcggcgaacgcctcctcgtcggtcaacgactcggcggtgttgttcagtttgagcagttccgccagttcgccggcctgctgcgattcgttgtacgtgcctttgccaaaaccgatcgaatacgtgtgctgcggacgcgccacggcggcgacgtagctggagtcgacaccgctcgacaggaaggagccgacctccacatcggcgatctggtgcgccttgacggaatcgcacaccgtctggtcgatcgagttcaccagctcgcccagcttctgcttgccttcgcggaaatcctcgtcgtaataccggtggatgtccatcttgccatcccggtacgtgaaatagtgcccttccggcagcttgtagacgcctttgaagaaggtctcaccgatcgccggatactggaaggtcatatacggcttcaacgcctcggcgttgagctccttgacgaaatcggggtggcgcaacaggctcttgatctccgacgcgtacatgaacgtgccgttcatcttcgcatagtagaagggcttgatgccgaaatggtcgcgcgcgccgaacagttcctgcttgttcttgtcccagatcacgaaagtgaacatgccacgtacgcgctgcagcaaatccacaccccactgctcatagccgtgcagcagcacctcggtgtcgcttttggtggtgaaggtgtgtccggccgcgatcaattcctcacgcagcgtctgatagttgtagatctcgccgttgaaggtgatgaccttcgaaccatcctcgttgtagatgggctgctggccgccgccgaggtcgatgatgctgagccttcgatggccgagcgccgcatgctcgtcgatgtaatggccttcgctgtccggcccgcgatgcgcgatcatgtcggtcatacgttggaggaccgggcatttcacgtcaatgggcatatcgttgacgaaaccagcaattccgcacattatctgcaatcccttcaaaacaaactcggtgtcagtgtaccagcatccgcatgtcgaaaaaccgccgccgcgcctccgaaccgattcatgcgtgacaatctccacaggtttcagacattttaggtatgccgcatagccatgaaaatgacgattctttcctttcgtccgtcacggctacactaccgggtatggatttccacgatgcccgcacctgcgtgatcttcggcgcaggcgattattacgatgagacccctgcgattccggatgacgccttcgtcgtcgccgcggacggcggcctcgaccacgcccgcgccttcggcatcgacgccgatttcgtggtcggcgacttcgattcgattaccggcgaccgccccacgcaaaacgaccgcaccatcgcattgccttcggaaaaggacgatcccgacctgctgtcggctttgaagatcggctggctgcgcggcgcgcgcacgttccacatatacggcgcgctcggcggacgaatcgaccatacgatttccaatatccagcttatggcgctactggccgaccgtggcgcgaccggctacctgcacggcgacggatcgatcgtcaccgcgatctgcgacggcgcgctcgatttcccggcggacgacgccgttgcgggacgcatggtctccgtgttctcccacagcgatatctcgaccggcgtaagcgaaacgggattgaaatacgagctgcaccacgccgacatgagcagcacgcgcgtcaacggactgagcaacgagttccttgccggcaggccgtcccgcatcacggtggagcatggcacgctcatcgtcacgttccccatcgaggctcccctgccgcacgtggcgcgatggcatggcttctccggagatctcggtgcattggacacggacgtatcctccgcgctggtcgagccaagcggccgttgaacgcatgcgggacatgcatgtgagcgttcactgaaaatcgcactgcattttggaacacgcgcctcggaacgttgccctaagtacaggtgacgcactacagtggacggtgttggtaaacaatggcttcagtgtgcctggcacacgcgtggcctaccctaaagggagaattacatgacagttaagattggtattaacggctttggtcgtatcggtcgtctggctttccgccgtatcttcgagctgcaggctcgtggcggccaggccggtgacattgaggtcgctgcaatcaacgatctgaccaccccgtccatgctggcctacctgctgaagtacgacagcacccacggcaccttccgtcatgacgatggcaccccggtcgaggtcacctccaccgacgactccatcgtggtcgacggcaaggaatacaaggtctacgccgagaaggatgccaacaacatcccgtgggtcaagaacgacggcgttgagttcgtgctcgagtgcaccggcttctacacctccgctgagaagtcccaggcccacatcaacgctggcgccaagaaggtcctgatctccgctccggccaaggacgagaccaccccgaccatcgtgttcggcgtgaaccacgagaccctcaaggcttccgacgtgatcgtgtccgccggctcctgcaccaccaactccatggccgccatggtcaagctgctggacgagaactggggcatcaaggctggcttcatgaccaccatccacgcctacaccggcacccagatgattctcgacggcccgcgcttcccgaaggctcgcaacaaccgcgccgccgccatcaacaccattcctcattccactggcgccgccaaggccatcggcaaggtcgttccgtccgtgaacggcaagctgcagggccacgcccagcgcatccaggttccggatggctccgtcaccgagctgaccaccgtcctgaacaaggaagtcaccgccgatgagatcaacgccgccttcaaggccgccttctccgacaccgacttctacggctacaacgaggatggcatcgtgtcctccgacatcatcggcgacacccacggtggcgtgttcgatccgacccagaccgatgtcaacaccgttgacggcctgaccatggctcgcaccgtctcctggtacgacaacgagtacggcttcacctgcaacatggtgcgtaccctgctgtacttcgccgagatctccgagtgaatcggcgcggagtaatccgcacggttcgtctctgaacctcagaacaaaggggctttcgcttcggcggaagccccttttcgtatccgaaacgccgcaacggacacgtggaaggcttattatgggcggcatggcaaagaaaaagcatgagaagggcgccggttccacaccggccaccgtgcagttggaaaaagccggagttccgttcaaaacctacgaatacgcgcattcgaacgatcacatggatgacggttatggggttgaggccgccaccaagctcggtttcgacgagcatcaggtgttcaagacgctgatggcggacaccggctccgaacgcgtggtcggcgtggtgccggtcagcggacatatggatctgaaggcgctggccgcggcagtcggcgcgaagaaggcggcgatggccgatccgaaggtcgccatgcgcgaatccggctacgtggtcggcggcatctccccgcttggccagcgcacacaccacaagacggtgcttgacgaaagcgcgctgcaatacgacgaaatcctgctgtcgggcggcaaacgcggtttctcagtcggcgtcaatcccaacgatctgctcaaggtgctcgacgcggtagcggcgccgatcggcacttggtaaaaaacacgccgatacatcacaccaatacataagtgggtggtcggaacaacacgatgttccgaccgcccacttgcgtaagcgaaaggttcgcgctatttgcgcagttccgcaggaagcacgaaatgcatgttctccttgatggtttcgatggtgctcacatcctggtagccaagttcttgcaacgctgcgaccacgccggaaaccagctcgtccggcacggaggcacccgaggaaatacccacggattcgacaccttcaaaccatgcggggtcaagttccgaagcatcatcaacacgatgggcgcgaccagcggcgccaacagccgtttttgaggcgtaccgcgcgctaagtccctcctgagcgacttccatcaaccgcacggaattcgaggaattcgcggagccgacaatcaccacgcaatcggcttgctcggcaacgagcttgaccgccgcctgacgattcgacgtggcatagcagatatcggagttcggcggcatttcaagccatgggaaacgagctttgagcgcggtgatcgtgccagcggtctcatcgacgctcaacgtggtctgcgtaagcagcaccaatttcgtgtcaggttggaaatccaacgagtcgacgtcggacgcatgctcgatcaaatgcacatgttccggcgattcctccaccacgccaacggcctcatcgtggcctttatgcccaatgtagatgatctcgtaaccttccttgacaaaacgcagcacctcgcgatgcactttgcttaccagcgggcaggtggcatcgaccacatgcatgccgcgcgccgtggcctcggctttgaccgccggagacacgccgtgggcggaaaatacgattgggatgccggcttcggcggcggcatcggggatctcagccaattcctgcacgaacaccgcgccctgcgcggccaaatcctcgacgacatgcttgttgtgcacgatctggcggcgcacatacaccggcggcaatccgtcggcacgtggcgtatcggcggatttgagaatcgtccgcaccgtcagaatcgccctatccacgccggcgcagaatccgcgcggatccgccagcacgatgcgtttgcccatgtcaagccgccttccaatcgtatccatccatcacaacagcaatcaccaatattaaggcacgggcgccgtcaatcgacatcggccgtcttcatccgcagaatttccacacgacaaacgcatccaccaccacatcgtgagcggtaacatagtagcggaaacacagtcgacaacactatggagtgatttatgacctgcaccaatctgccgccacgcaccggacagcaattttccatttcgcatggcgattaccatgccgtcgtcaccgagttgggcgcgacgctgcgcaaactgacctaccagggcgaggacatcatcgtctcccccggtccggatgacatggtgacctgctgccacggccagctgctcatcccgttcccgaaccgcatcgagaatggcgaatacaccttcgaaggcaagacctacacgctgccgatcgacgagcatgagcgccacaacgccatccacggctacggcaagcgcgcgttctggaagcttgtctcccttaaagaggatgccgtgaccctcagctggcgcgcccccaacatggagggatatccgttcgacatcgtggtgaccgcgacgtacagcctcgccgacgatggcctgcatctgaacatcagcgcctacaacaacggcgatgcggacgcaccgtgggccttggccatccacccgtggctcgccaacggcttcaacggatacggcgatgagatcgacgcccacaacgccaagtgcagcctgaccgtgccggggcgcacgcatgtcaccgtcaacgagaacctcattccgaccggcaccgagccggtggacggcaccaagtacgacctgcgtaaggacacgctgctcaccgagcagccgttcgacgacgcttggacggatctggagcatgccgaagacggcaccgtcaccgcggtgttcacccgtccggacggcaagaaggtgcgtgtgggcggcgacgagaccgtcacctcgttccaggtgtgcaccggcaccggtttcccggccatcaagcatccggccggcgtggcggtggaaccgcagacggcatacgcgaacgcgttcaacaccggcaaggacctcatcgtcatcaagccgggcgagacgtcaagcacggcgctgttcatcgggatgctcgactgatataatcaccatcggaataagtcccggccacacagcggacgccgaatttggcaaacgtctcgctcgtgtgcgataatcccgaaggcttattaatcgcaagtaaaggagtccaatcatgggcatgcgcggacgtaagcgcaaggatcgtcgtaagaaggccgccaatcacggcaagcgcccgaacgcctgatccctgccggcgcgaatagcgtcacagagcatggaaaaccccgcggaatcattacggttcgcggggttttcccatattcagacgctgatgcggcgggcacgcctcgcgtcacatcagcgtggcacttggcgcatgaaacgccgcacgtccttccaattactcgtcacaacagtggtcgagtgtcgcctcaagcctgtcgatcaggctttgcggcgcgtgtttcggccgcaggtacgcgcgcatcgctgcgatcagcgcacgttcgcgttcatcgcaacaggtctccgggtcgaagcagtccccggaggccacgacatgcacgctggcatgcgtcacctgcgtcaccacaccgttcgtgttggtggtggtcgaagtaatggagatgtgccgttccattggttcgctcatggtcgatccttcccggcagtggcatagccacgttccttggcgtaattggcaagctcacgtttcagctgtgtgcgggcgcggttgagccggctcatcacagtgccgattttcacgccttgttcctcagctacctggctgtatgatttgccgtcgatcgcggcgtcgatgaaaacctgcctgcgttccggggaaagccggttcaaagcggccatgatctcctccggcgcgtaggcgtccaagtattcctgttcggcggatttgagctgttcggaggaatgttcggacgcggaatacaggtcccagtcgtcgtattcgccggtggaatcgttggcgcgttgcggccgtcgcttggctttggcgtactggttgaaataggcgttgcgttcgatggtggtcatccaagccgcgaaattcgttccttctttgaaggagtcgaacgccttgaatccacgttcgaaggtgtcctgcaccagatcctgcgcgtcgtcgggattgttggtcagtttcatcgcctgccggtacagcgagtccacaacgggcatggcaagcttctcaaaccgcgcgcgccggcccgccatggattccatttcttgttcagtcacaccctcattgtaacttccccgacgtcacacgtcgtgcacatggttgccgctaaaatggctcttcggtatccgctcggcgtctcatacacagggagaacacgaaaacatggctttgactctggaatcggcggcccgactgctcgataggcacggactgctgcgcgaaatcatccgcggcgatgtctggacgcttgatccgcacgacatcaagggattcgacgagccgttctccgcaatcacctacgacacccgcaaggtggagccgggcacgttcctgtgctgcaagggccgtttcaaggccgaatatctgcagggcatcgacgaacgcggccttgccgcctatgtgtcggagaacgacttctccgacgccacgcaagctccgggccttattgtggatgacgtgcgcaaggccatggctttgctatcggctgaattctatggtcgtccgcaggaccagttgaaggtggtcggcatcaccggcaccaaaggcaagaccaccaccgcctatctcacgcaggcgatgctcaatggctgttccggcggcaagtgcgcgctgttttcctccgtggacaattgtcttgacggccacacctacgtggaatccgatctgaccacgccggaatccatggatgcgttccgcatgatgcgcgaggccgttgataacggcatggaatatctcgtcatggaggtctcctcgcaggcctacaaggtggaccgcgtgttcggtctcacattcgacgtggccgcgttcctcaacatcagcccggaccatatcagcccgatcgagcatccgacgttcgaggattatctccactgcaagcgtcagatcgtcaagaactgccgtgccctcgtattgggtgccgattgcgcgcgcgccgacctcatccggcaggacgcacgtcataccagcgttcccgtcaccacgttcgcgcttggcggcgattccatggcagacgtcatggccgcgccggcgaatgacgatcacagccgcttctccatcgtcatcgacggcacctcgatcggcgagttgagcctgacattggacggcgatttcaactatgcgaacgcggcggcggccgtcgcgatcgcccgtgcggccggtttcgatttcggttccgcacaggccaaggacgcgttgcgtgagatggagccggtacgcatcgccggacgtatggagcatttcaaggacacgcggtcgaacaccatcgccattgttgattacgcgcataactacgcgtctgtcaccgcgttgcttgactacgtcgatcagcgttacggcagcgaaaagccggaaatcacgctcatcaccggctccgctggaaacaaggcatacgatcgtcgcgccgaaatcgtccacgccgcgcaggaccgcatcgaccatctcgtgcttactttcgaagacaccgacgacgagcctgtggaacaggtctgcgcggacatgaacgacagcgtcaccaacccgcagcttgacgtgaagaccattctcgaccgtgccgaagccgtggagaccacggtaagccgcgatcgcaaggatcccgagcatctgcacatcatcctcatcatcggcaagggcaacgaacgttggttcaaagaccacggcaagcacatcccttacgagggcgacgaccgcatcgtggaacgtgtgttccgtctcaaataacaactaaggtgaaggcattatgacacgattccaaccgattctgctgggcagcgacatcaacgtctacggcatggccagggcgttccatgaggagtacggcatcgtttccgaggcgtatgcgtatttccagctgagccccacgaaattcagccgtatcgtcaacgtgcacatcgtcgacgatttcaacaacttcgtcacgttccgtaatttcatgctcaagctcggcaagcgtatgaaggccgaggatccggaacgcgtgctgctgctcatcccctgcggcgacgtgtacgccaatctgctgagccagtgcggcgacgatcttcgcgaatatttcgtatacaacacgcttgacgtgaacctttcgcgccggctcgcctacaagtccacgttctaccagatctgcgagcagtatgatctgccccatccgaagacgcgcaccgtcaccgccgatgaggtgaaggcaggagcctactgtgatttgccgttcagctatccggtggccatgaagcccgcgaattcggtggaatggctcaacatcgatttcgagggccgtcgcaaggcctacatcttcaacgatccggccgaattggagaccatcatcaagcgtgcgtacgatgccggatacacgtccgaaatggtgattcaggacttcatccccggcgacgattcccgtatgcgtgtgctgaacgcctatgtggaccagcatcatcgcgtgcgtatgatgttcctcggccacccgctgctggaggatccctcccctgtcgccgcgggcaactatgcggccattctgcccgactacaacgagggtgtgttccgtcgtatcaaggctttcctcgaggacatcaagtacgagggcgtggccaatttcgacatgaagtacgacgaacgcgacggcgagtacaagctgttcgaaatcaaccttcgccagggacgttccagctatttcgtcacgctgaacggcttcaatctggcgaagtatttcgtcgacgacctcgtcgaggacacgccgttcgacggcaacaccctgttcggccgcggttcgaagctgtggcttgagattccgaagtcgattttccttgattacgtcgcagaaggcgctgacaaggaaaccggcaagcgcatgctcaagtcgggcgattggggtaccaccttggagtattccaaggatatgaatccgctgcgttggctgatgattcggcacatgttctcgatttacaagaagagctatgccaagtacttcaccaagaagggcgagcttaagtgaaacgaccgtttttcgccgtactgggcggcatgggcacgctggccaccgaaagctacatccgcttggtcaaccgcgccacgcatgcccattgcgatcaggattatctggactacatcgtcttcaacgattcctccgtgccggaccgcaccgcgtacattctcggcgaatccgacgagaatcccttccccgtactcgccgacgatatcgagaaggcaacggcgatgggcgcgagtttcattgtgctcacctgcaataccgcgcactatttctatgacgatttccaggcgttgacgacggtgccgattctgcatatgccacgcggcgcggtggcacgcatggctcagcgttatccgaaggatcgttttccgcgggtcggtttcctcggcaccgtgggttcgcgcaaatccggcgtgtacaagcgtgccgtcgaagaggccgggtacacgttcgtcgaaccgaccgacgagttgcaggcccgtatcacttcgttgatttatgacgatgtgaaaggtagtggcgagctcaatctggaacgctacgaatcggtgttgcgcgatatgctcgatccggcaggcccctgcgcgtgcgacacgctgatattgggctgcaccgagctgagcgtgctcaacgaggcgtttccgctgccccagctgccggtcatcgacgcgcaggccgtgctggtggaagataccgtggcgcgggccgaagcgttgcgcgcgtagctattatttgtcacgcctatcttcgactgcttaggcgtcggacgataaaacaagattgtgggtggcttcccattgcctggggagccacccataatctgttttacatggacggtgtacgccgcacgtatggcgtcatcgtccgatgttgtttcgcttcgtcacttcgtttcgttttccgaagccgtttccgcatccgccggttcgttggcatccgccgcctcatccatttcatccgcatcggcgtctgctaaaacggaatcgtccggaccgacgctgccgaaatcgttgatgttgaaatcagggttggcgtcggattcgaaatccacgtcagcctcgtcctgctttttgcgcggttccggatcgacggcttcctggaacacacgttcggcctttggcttcttcaggtcggggttgatcttctcctccagcatgagtcgcgcatcaccggcggttgtgaagctgccacagacgagcacgccatgaccgtagccgacgcccagttcgtcatcggcatcaaccatgttgacggcttcctggatggcgtccggcaattcgggaatgcaggtgacgcgttccggcccgaaaacacggtccgcgatcttcttcagatcctcagccggcatcactcggtcacgccacgagttctcggtgacgatcacatggctcagcaacggttcgagcacgcccagatactcctcgacctgcttgtcccccatcatggcgaccacgccgacgagctgctggaaatcatagttctcttcaatggcggcacgcagcgattcggccgcgttcacgttgtgcccgccatcaaggatgatggtaggcgaggtacgaatttgttcgatacgtcccggaatgcgtacgctgctcaacgcttcggccaccaaatcgccgtccaacgcgccgttgacgggaatcaccacttccgccgcgcacagtgcggcgagcgcgttgtgtgcctgatgctcgccgaatttggcgatcggcacttccgtgtaggtgccgttcggggtgcgcagggtggccacctggccgccgacggccggcactcgggtaacgacttccgattcgacgccgtcgcgcaccaagctggcgtggttctccttggccgcggcctcgataatcggcatgacctcgtcctcgtgtggctggcggccgatgatggcggtgcagttcggcttgatgatgccgaccttttccgtggcgatttcctccacggtgtcgccgagccatgccatgtggtccatgtcgaccgggccgatgatggccgcgtccgcgtcgagcacgttggtggcgtcccatcggccgcccatgccgacttccacgatggcgacgtcgaccggcgcgtcggcgaatttccagatggccatggcggtgagcacttcgaagaagctcatcttcggcttgcccagctcgtccattttcatgtccacgatggcgacaaggtccttgacctggtcccaggtgtcgacgaaatcgtcgtcggacagctgctggccgtcgatggcgatgcgctcgttgacgtgttccagatggggcgaggtgtataggcccgtacgcatgccgtaggcgcggcagatggcttcggccatgcgtgccgtggagcctttgccgttggtgccggtgatgtggatgacgcggaacgactgctccggatggcccatgatgtcgaggatcatcttcatgcgttgcaggtcgagattggtggtgttgcgttccgatggacggctcatgatgtcgcgttcgacgtcgatcatgctttcgttgttgcgattgggatgttcgaatgacatatttcccgttttcctcccgtaccttgcggacagcacactaaacttttcccattctagatgtccgcatgaacgttgcgcgccgggaaaagttataggatgggttgcggtaatttccgtacgttacgaatgcatgttcaggagatgtgatgggcgaagtcattactgacaaggacaaggaatacgagaagatggagcgggagtccgctccgggaccggatcaggccatgagcgatcgtgtgaacaatcgttcgctgcgtccgcgttccgaggcgttcaaggagttcatgaccaccggttgggatgacaacgagccgcagatcgagccgttggagtcctccaagtacacgccggcgcgtctggaggcgttgggcaaggcgttcccgggcgagcgtatcgtgattccggccggacagccgaaggtgcgcaacaacgattgcgattacgcgttccgtccggatacgacgttctcctactacaccggtttgggtgaggatttcgaggccggcgcggtgctggtgctgaatcccgtcgatccggattctccggaagcgaaggccggcaagacgcatgttccggaactgttcgtggctccgcgtgccaaccattacacgcaggactttttcatgaacgcccattatggcgagtattgggtgggtccgcgtgccggtgtgaaggaaatgaccgcgatgaccggcatcgaaaccaacgacatcgcgcagctgcccgacgcgttgagcaaggatgtcggcactgaggccggcgcggtgcgcgtgcgcgtgattcgtgaagccgatccggcgattaccagcatggtcgaggagatccgtgaagccaacggtttcgctgatccggacaataacaccgctgccgatgacaagctgcacgaattcgccgccgaggcacgcatgtgcaaggatgagtatgaggttcgcgagatgcgcaaggccgtggccgcaaccaagcacggtttcgacaacattctgcgcaagattccgtcttcccttggcaagccgcgttcggagcgcatgctggagggcgcgttcaacgccatctcccgcgaggagggcaacgaggtcggctacgacaccatcatcgcttccggcgcccacgctccgattctgcattggatgcgcaataccggtaccgtggagtcgggcgagctgctgctcatcgacgccggtgtggaggtcaacagcctgtataccgccgacatcacccgcacgttcccgaccaacggcaagttcaccgatttccagaagaagctgtaccaggccgtgttggattcccagcaggccggtttcgaggcggccaagccgggcgccacgtattcggacatccatcatgcgtgcatgcgcgtgatcgccgaacgtctgcatgactggggtattctgccggtcgatgtcgaggagtcgctctcccctgaaggccagcagcatcgccgttggctcgcctgcggcgtggcccaccatctgggtctcgacgtgcatgattgcgcgcaggcgcgttatgagtcgtatcagaacgccaagattcgtccgggcatgatcttcaccatcgaaccgggcctgtacttccgtgaggatgatctgctgattccgccggaataccgtggcatcggcattcgtatcgaggatgatgtgctcatgacggaggatggtccggaatggatttccgcgggcattccgaagcggatcgacgatgtcgaggcgtggatggccgatatggccgccgaaggtgcgaaggcctgaggatgcatcatgcccacgcctgaattcgtactcgaacttcgtaagaagataggccacgatctgttatggctcatgggcgtctccggctatgtcgaggacgagcagggccgtgtgctgttgggacggcgctccgacaccggcgaatgggccatggtgtatggcatcaacgagcccggagaggaaccggccgataccgttgcccgcgaggtcaaggaggagaccggcgtggatgtggtcgtcaccgatctggtgtcggtcaaatcgtccagaaaggtcctcacctatgcgaatggggacaacaccatgtacatggatcacctgttcatctgcaggcccgatccgaatggcaacacggagccgttcgtcggcgatgaggaaagcctcagcgtaggctggttctcccctgatgctctgcccgaaccgttggcagccaccacggtggaacgcatggcttacgtacgcgaatatctgaaggccaaggcgaatggtgattcccatgcccagtttgccttcaacggcaccatccgctgaaatcgccttccatacatcataaaatggaatccccgcaacgtttcaagcgttgcggggattcctttttattagattccgtggatcagctcactgctgggcggcaagcagctcatgcagatgctcgcgatgcttgcgctgttcgcgcggatcgggcaccggcagggaggccagcagcttctgcgtgtacgggttctgcggattctgcatgatctggtccgcatcgccatgttccacgatctggcccttgtgcatcaccatgatgcggtcggcgagcatgtcgaccacggcgaggtcgtgcgtgatgaacaggcatgcgaagccgatttcggcctgcagcttcttgaacagttccagcaccttcgcctgcaccgacacatccaacgcggaggtcggttcgtcggcgatgagcaggcttggcttcaacgccaacgcgcgtgccaaggaggcgcgctggcgctggccgccggacagctcgtgcgggaaacggttcatataggcgcgcggaagctgcaccatctcaagcagatcgcccacatacttgcgggcgtctgataccgacgaaaacttcttgtgcacgatcaacggttcggccacgttttccgcgatggtcatcagcggattgaacgagctgcccggatcctggaacacgaagccgatgtcggcgcgtttgggtttgaagtcgcgttccttcacaccgttcatttctatgcctagaacgttcagggaaccgccggaaatcttctgcaggcctgcgatggcacggccagtggtggatttgccggaaccggactcgcctaccagaccgagcacttcggaacggtggatggtgaagtcgatgccgtccacggccttgaaatcaggctgcatgagatgacccggatacgtgatggtcagtcccttggcctcgaccgcgatgggctgatcgcgccaatccttctcacgttcgatgaccttgccatcggcatccttgacgaccagtttctggccaatacgcggcacggcggcaagcagacgcttggtgtagtcgtccttcggcgagtagaagatctgctcgacgctgccctgttcgacgacgtggccgcggtacatgaccacgacctcatcggcgatgtcggcgatcacgcccatgttgtgggtgatgatgagcacggatgcgtcgaactcgtcgcgcgccagacgcagcaggtcgaggatttcggcctgcacggtcacgtcgagggcggtggtcggctcgtcggccagaatcaggccggggttgagcaccagggccatggcgatgacgatgcgctgcttctggccgccggagaactggtgtgggtagtagtcgatgcgggtttccgcgtccggaatgccgaccttcttgagaatgtcgatggacttggcacggagttccttcttgtccttcatgccatgggcgcgaaggccttcctcgatctgccatccgatggtgtacaccgggttgagcaccgaattgggctcctggaacaccatggccgcttcggcgccgcgcatttcgcgcagctgttcgccggacagcgacagcacttccagctcttcggtgcccgcgcggttcgacaggtacaccgcgccggaggtcgtagcggtctccggcagcagcttgatgagggagcgtgcggtcacggacttgccggagccggactcgcccaccacgccgatgaccttcttacggggaatttcgaagctgatcttgtcgatggctttgatggaaccggcgtcggtcatgaacgagacgctgaggtccttgatctcggcgagattgccttccttgatttcactcatcggttcactccccttcctcggaagcccattcggaagccacgaatgacggatcacggtcggtgacggtcaccggtttgtcgctggctcccatcggattcttcgccgcctcaagttcggcgacgacctcgttgcgcttgcctggctcctggctggggtccacggacgtgtcctcgatggaacccaccacttcgcctgcggacttgcgggcgcgcagacgcggatcggccagatcgttcagcgattcgcccaccagggtgatgcccagcacgatgagcacgatggccagacccgggaacacggcggtccaccagatgccggcggtcacatcggagacggcgcggttgaggtcgtatccccattcggcggccgcggtcggttcgatgccgaagcccaggaagcccaggcccgcaagggtcaggatagcttcggaggagttcagcgtcaggatgaccggcagggttcgtgtggagttcttgaacaggtgcttggtcatgatgcgccacgtggaggcgccgaccacgcgggcggattccacgtacgcggattccttgatgcggatcacttcggcacggatggtacggaagtattgcggaatatagaccacggtgatggagatgccggaggcgaagatgccgctccacaggccggactggccgtgggagatcatgatcgccatcagaatcgccagcagcagcgacgggaaggagtacacggcgtcggcgatcatgacgagcacacgatcgacccatccgccgaaatagccggagaccaggccgagcagcacgcctgcgaaaatcgacagcaataccgcgacgacgatggcgatgacggcggtgcgggcaccccagaccacacggctgaacacatcgtagccacctgcagtggtgccccagatgtgttcggaggacggtgccgcctgggccgggaaggaaacgccgtcggcgcccttgagctgcgcgtagctgtatggcgcgatgagcggcgcgaaaatggcgaccagcaggaagaacgccgtgagcacgaggcccgtgatcagcatgcctttctgccagccgactgcgacgcgcagttccttgatgatcggaatcttatgccagaatggcgtcttgttgccgagcttgagctcgtccagacgattgtcgcctggaacggtgaccttgttggcagatgctgcggtcatgtcagtacctcactctcgggtcgaccaacgcggcgatgacgtcgacgatgaagttgacgacggccacgatgatggcgattaggataacgatgccctgcacggccacgaagtcgcgtgccttcaggtactgcgacagcatgaagccgagacccttccattcgaaggtggtttcggtgagcaccgcgcctgcgagcatcagggcgatctgcatgcccatgacggtgatgattggaatcaacgccggcttccatgcgtgcttgttgagcaggcgtttctcggagacgccgcgggaacgtgccgcttcgacgtagccggaattgtaggtggcgatcacgttggtacgcaccaaacggatgaacacgccggcggtcagcaggcccaacgcaagggccggcagcacagcgtgacggagcacatcaagcaacacggacatgtcgcccaactggatcgcgtcgatgatatagaagccggtcggcgagaccagtcgggagaactgcatctcgctgccaagcgatgagcgcccggatgccggcagcacgttcagccagatggcgaagatgagcttcagaatcaggccgaggaagaacaccggggtggcatagcacaggatggcgaaggtgcggatgcccgcatcggccgcgtggtcacgcttgcgtgcggcgatgcgtcccaagccgatgccgacgatgagcgcgacgatgagcgcgaggaatgccagttcgaatgtggcggagccgtagtggacgaggatgctgctgaccttctggttgtcggtcagcgtggtgccgagatcgccgtgcagcaggccgccaagataatcgatgtactgcacgatgagcggacggtcgtagccggccgcatggatgcgcttctgcagttcttccggggtcaggcggccgccgagtgcggcggagatcgggtcgccggtggcgcgcatcacgaagaaaacgatggttacaagaatgaatactgtaggaatgatcagcagaaagcgtgtgagcacgaaacggaagaatccgcttgaaagcttgtttttcttggctttcggctgagcctcggttgcgctttgcgtcacgtcgggctcctttttccttattggtgtttcagatacaaattgagcccctgcccatcttaagggtgggcaggggcgatcaaaacctttatcaggccttggtcacggaagcgtagcggaagcggaaggaggcgtcgaggacgacacccttcacgctggatccggtgaccgcgacctgggcaccctgcagcagcgggatggtggagaggtcttcggtctcgagcttctggatttccttcagggtgtcttcgcgggccttggcgtcggtctggccggcctgcttgacgatcaggtcgttgacgtccttgttggaatagccgttgttcacgaagttgccgtcacggaagaacggggacaggtagttgtccggatcggagtagtccgggaaccagccgagctggtagaccgggtaggaaccgtccgaatccttggtgacgttacggtccttgttgtactgggtccattcggtggactgcaggtcgaccttgagcaggccgccttcctcgagctgggccttgatggccgcatactcgtcggcggaggactggccgtagtggtccgggttgtactggagcttcaggtctaccggggtcttcacaccggcggcttcgagggtcttcttggccttggccgcatccggcttgccggaaccgtcgccataggctgccttcagggtgtcgtcgtggccggacaggccatccggaatgaaggagtacagcggggtgtaggtgctcttgtagaccttggtggccagctcgttgcggtcgatcaggcttgcgacggcctgacgcacggccttggccttgtcggcgttcggctcgctggacttctcgccgtacggcatgatcttgaagttgaaggcaaggaagcgctcttcgccgcccggtcccttgacgaccttgaccttgttgtccttggacaggtcctcgacgtcggtcggggtcatggagcggtaggccacgtcgacctggccctgctgcacggccatcttcaggttggaggaatcggcgaagtacttgacctgcacaacgtcgttcttagctggggtcaaacccttgtaggaatcgttcttggcatatgccagggcctcgttcaccttgtaggaggtgagcttgtacgggcctgcgaaggcgttgtccttgacgacggtgttggcatcggtcagtttgtcggcggagaaggactcttcgtcgacgatcgggccggccgggctggagagcacctgcttcagggtcacgtcgtccttgaccgcggagtggaacacgacggtggtgtcatccttggcctcgacggactcgatgttggccagcagggaggacggaccgttctcgtcgttgatcttcttgatacggtcgaaggagaacttgacgtcggaggcggtcagatcgtggccgttcgcgaacttcaagcccttcttgagcttgacggtgaactcggtgccgtcggcgctccaggtgccgtcatcggcggcgatgtccggagacagctcggaagtgttgtagttctgcgcgtacaggaacgggaacacctgaatctgcacggcgtaggaaccgttgtcgtaggagccagccggatcaaggctggtgatcttatcggtcgtgccgacggtgatggtgttgccagttgcggcgccaccgtccttcacgccgccgcaggcggccagggaagccagagccgcgacagaagccagagcggcgataactttcttgcgattcactatggaatcctctcttttctatccgaatcgcccctgtgcaaggcgatatagtgacaagaatcggcgcgcaatgttaaccgtacgtttcattggaggccgttttacccacctaccttatattcgccgttttctgctatgcattaaaacggcgaaattccaacgttttaacgactagtgaaagaaaataagaaaaaccagccattttatgagacggacccagccaaagtcgcattcaaggtctacgtccttcttttttactcattgctttcgcacagagagacccagataagcgcgcgacacgcggcacaacatgaattgcattaatcaattaacggcgttaatatattaagaagttcaacgagggtccatgcactgtcgcaaggaggtgagcatgagtaggtacagcgcccaacagtcatcgatttcggaaaacaaccgttcccgcatcctgcaatacctgtaccacaatggcatctgctcacgcgcgcagatcgccaaagccatcaagctcactccggcggcaatcaccaaaatcaccgcgaaactgctggcgcagggcatcatcgacgaaaccggcgacatggacggagacaagaaccgccgttccatcggcctgaatctcaattgtgccaaataccacatcatcggcgtgaagttcgcccgcagtctggtgcaaatcgcggtcttcgacctcaagtgcaaccgtatcttcctgtccgacttgcctaccgtcagcgaagagcacatccccgaaacggtggagcgcattcgagataccgtacgccagctcatcaaggacgaccccagcatcgtggccgtcggcatggcggttccggggccctatttaaaggacgaaggacgcaccgctttggtctcctccatgcagggctggaggcaaatcaacttcatcgacgaattcagcaacgcattcagcgtccccgtgttcgtcgaacaggacgcccgcgccggcgcgctggcgcagttcctgttcaatccggaactgtcggaaggttccctcgcctactatctgcttggcgaaggcatcggcctcggagtcatcgacaacggcaccatctactacggcgagcacggcaccgccacggaaatcggacacgtctccatcgacgtgaacggcaagccatgcgactgcggcaatgtcggatgcctggaacgctactgctccgccaacgccatccacgaacaactcaacgccaacccgagcatcgttcccggatgcgagacgatgacgcatgcgcaggcttgcgcagcactgttcgccaaggcgaacgcgggagacgagaccgcgacgcttctgatgctcgatgttgcccgatacgttgggtacggcgcggtcaccatcatcaacgctttcaatccgacacacatcgttcttggagacatcatcgcgcaagccggccagccgttgctcgacgaagtcacacaagtcgtgcgcgaacgcacgatccccgaaatcgggcgcaacacccgaatcaccctgtccgccctgcccaccgacgccaccgttaccggtgccgccgccgtggccatcaccaattttctggaacatccatcgatgttcttcgacgtcgcatagcacgccgcccaccaaagaaaggaaccacccatgtccaagccaatcgtcatcgccctcggtgaaatcctgtgggatatgctccccaccggcaagcgcgccggcggcgctcccgtcaacttcgcctaccacgcgtcccagaacggcgcagaaagctacgccatcagcgccgtcggtaacgacgagctgggcgccgagctgctcaacgatgcgcacaaggccggcatcaacacgctggtgcagaccaacgaatacccgaccggcaccgtcgccgtggcactgaccaacggcattccggaatacaccatcgtgcagaacgtggcttgggaccacatcggctacaccgacgaactcgccgaggccgtgtccaaggccgacgccatctgcttcggcacgctgggtctgcgttcccaggaatcgcatgacaccatcatcaaactgctccagcatgccaaggaaggcgcgctgaagttcttcgacatcaacctgcgcgccaacttctactccaaggagctgatcgaggagctgctgggatacgccaacatcttcaagatcaacgacgacgagctcatcatgatgcgtgagatgttctccattccggagggcaacgacgaagaggcctgcaagtggttcatggatcgcttcgatctggagtacaccatcctgaccggcggcgcgaccttcagcaccatcatcgccaaggacggcgagacctccactctgctgaccccgcatgtcgaggtggccgacaccgtcggagccggcgattccttctccggctccttcaccggcaagatcctgtccggtgcctccctcaaggaagcgcatcgcgcggccgtgaacaccgccgcctacgtgtgcaccaaggaaggaggctggccggcctacccgaccgaaggcgttccggattacctcgccgcagcagccaagtaagcgtatcttctcctttcatcatcaccgattccgcatgccgtcaaataacggcatgcggaattttttttaccggttttgcgaagtttcgtcggtatgatgaatcgccgatagcataatttggtttgtcggataaaccgtggtatcttgaaatgtctggctataaagctggaaggtttgataattcaatatttggggatgatcggtttcgacggtgacctgttcgtcgcagggaagcgtgccgagaacgtagggtccgctcgtggatgccccctacaaaagaataagtgctaaatctaaccgcactgagttcgctctcgctgcctgagcttcgcgccaggattaaccagtgagcagccgctccgttcactccccctcgtctttgggggatgttgagcgtcgtttagaagacttgccttaccggctgagccacagggccggcaagggacttttactgtagatatgctcgccatcagttgtctgcgacatcgatgggggcagaaaaaccgccgcacggccagcagactacgcacgtagaagactgagggttcggtcatcggaccggggttcgattccccgcatctccacggattgaaagccgccagaaatggcggcttttcctttatttccaacggtttccgccacttttgcaattcgctgcaattcaccctttatcgcgatatttctcaaaaacatgggcaaaatgtgggcacgaatcatgtgtcagcaatgacggctttctgtattggtaatcacatttctcgttcggtgaaacagcgcatgtcggcagcaacgcctccgtatcatcgaaataaccgtccggcgccttccaatattacaagccgccggccagccaaccatcgaaagggacgatatcatggcgaagcttacagaggaaatgaaggatttcatcagcagcaatctcgcttgggtggccaccatcggcaaggatggacacgtcgatttggggccgaaaatgagcacgttcgtcatcgatgacactcatatcggctatcacgagcgtaccgccggtcaaatgtaccgtaatctgctcgacggcagcgaactggtcatcgcagtggccaatcttgagcagaagcgaggttatcgtttccgtggcaacgtcactctgcattccgatgatgcgatctacgatgagcaggtcgccgtggccgaacataacggcacgaagaagcccatgaccattcccgttctggagatcacggagattcaggacttgacgccaggggcgaccgcaggcaagaccatcgtcaaggactgacgcccgttcaacgcatacggctaataccatccatccaaacgcggaaacgcgctctggccctcccttggaaagaaggtccagagcgcgtttcgtttttctgtcaagacaaaaagagctagatcaaagtatttccgctccgtcatgcagtgacgttgcgcaataacgctatttgatgatcggtctcaacggcgcggacacgtccacgttatgcttgtctccaatcacgttcggatcattgacgatcttgtccaccaccgctttcttgagcttcaggtccgaggaatcaccccatacgatcacgcggtctcccccattgagttccgtggtgatggaatcctgggtcgccgcggtgaccttggtgatggagttgcgcatcgattccggcagtgagctgagaatcttcaacgcttccttgataggacgcctagacaggctcgcatcgacgttctgcacttcgatgacgggaatgccttccacggaaacgccgctgacggaattgagcacgcggcccttgctgtcgaccgccgtcatatggtcctcgctggttttgagcatggccgcgggtttctgcgccttgatcgtcacttcaagcgagttcggcagctgtttcttcgacttggctgacgtgactcccggaatcgccttgatctgcttctccacggctccatccgaaaccaggaacaacgattttccggactgctgcctcgcgatgtcaagcacctgcgattcactcacccattcgttggcgccgaccacgctgatgttgcctggctccaaacggaacaccgacgagaagaggaacagccagacgacagctcccaaaaccacggctacgacaagaccgatgagcacgcgcaggactatggctcgcgcgccggcctgacggcgttccttgagccgttcgccgaaatcaaccactttcggacgtgtcatgatgccgatcgtgccggtggtctcctgcagggttttggaaaccaggtcctcgctttgcaaacgtcgcgcgtctacgaagccttcggcttttgaacggtccgcgtacccttcaatcgaccgtccttcggcatgctccgatgagatggaccgtccggaacgtcgtccgcccgactggtccgtctcctgcacatccttgccggaactgatgacccgtcgagccatcagccctcgcaatcccaacgatgcgcttcaagagcatgcaggatgacctcgtccatctgcgtgatgtcgccggcgcctacggtgaagatgacgtcgccatgatgcgcgcgcatcaccatcatctgggccgcggtgtgcatgtcttcgacgccacggatccagtcctttgccggttcatgctcaagcttgagcgcctcgtccacgatggtggccggagtcacgtcggggaaatcctcctgcttctcgcgcgcggggaagatgccggtaacgatgacgtcatcggccttggcaagcgcctgcgcgaattcagagctgaagaaacgcgtgcgggagaacaggtgcggctggaagatcacacggatcttggactgcgggtagcggcgacgggccgcatccagcagcgcagcgatttcggtcggatgatgcgcgtaatcatcgacgaccgtcacttggctgacggtgccacggacctggaagcggcgtgcggcaccgaggaacgaggtgaccgccgcggaggcacgttcgacgtccatgcccaacagcgcggccgcgataatcgccgcggaggcgttgcgtgcgttgtggatgccgggaacggtaagcgtcactgcgatgcggcgctcctcttcgccgatcagtccgcccggaatatgcagcgtgaaatgttcggctccgctttcggcggtttcgctttccgattcgatgcgtaccagcgtggcaccgttcaggtcgcccaattcggcggcgttccgtgttgaatagacgatcgtgcgtccggccacggtggcgtcaagcgcacgtagcacggcaaggttgccttcgtcgtcgccgcacatgattacggctttggtggcgtgtccggcatggtccacgaatgcggcccgatagttgtcctgcgtgccgtagtggtcaaggtggtcggcttcggaattggtgatgatggcgatttgcggatggtatttggcgaagctgccgtccgattcgtcggcctcggccaccagcacgttgcccttgccggcatggccgccgtccaaaatggcaccgtctttgccttggatggaaccgccgatggcgtagctcggatcggcgagctcgccttctccggcgttcacgagaatgtgcgccagcatggagctggtcgtggtcttgccgtgggcgccggccacggtcaccgcacgtttcgcgttcatcagcagggcgaggatgtcgctgcggtgcacgatgcgctcccctgcctcatgcgcggcgacgatttccggattgtccggcttgatggcgctggagaacacgacggtgttcttgccttcgacgttcttcgcctgctggccgaattcgacggtgatgccgaggctttgcagacggtcggttttggcgcttggctcacggtccgaaccatcgacctcgacaccctgctcatgcagcatttcagcgagcacactcatgcccgcgccaccgatgccgatgaaatgcgtggcacctaggtcatgcaccgtctcttcaggtgcgaacgacgcatgggttgggtcaagaattatggtaccggcttcacgctggttgtcagacacgattgctcctcgtaaattgttttcaagctcatttcattatggccgcacccatggtctcccacggggtgcggtcatgattgttcggccggttaatcagctggctgatcgattagcgcgagcacgcgcttcgccatgacttcggcggcgtcgcggatgccgtatttccacgcgttggcaccgtatcgggacagcttgtccggatcggcgagcagttccggcacatggccacggacccaatccggggtgaaatcgccatccgccaccatcaagcccccttccgcgtcgaccacgggctgcgcgttgaaacgctgctcgccattgccgatcggcagaggcacgtaaatcgccggcagtcccaaagccgtcagctcgctgaccgtgccggctccggaacggcagatgatcagatcggcgcaggcgaacgccagatcgatgcgttccagatagggagccacacggtagtcgccatccgaaacgtggtcggggccaagctcgccgagcacgtcctctccggcgcttaccgacaccaaggaacgcacttcgtcgtctttgcccttaccggtcagatgaatcacctgggcgtgcgcaagcagatccttggcggaagcggccacagccctgttcacgttcaccgcgcccaaggatccgccggtgatgaccacgagcggacggtccggatcgacgccaagctgcgccgcggcggctttacgagtggcggtacggtcatgttccagatcggacgccaatcgtgcgattgccggacgaagcggcaggcccacgcgttcgacttcgacgcccctgcgtggtttcagtcctggctgggcgtatgcggcaccgatcatggacgcccaacgcgcgcccagcttgttggccatgcctgcgcgtgcgttctgttcgtgaatcgcaatcggaatgcccatgctgtgcgcggccgcgtatacgggtgcggacgtgtatccgccgaaaccgacgaccacttgggcctgatgccgggtgaggatgtcacgtactttggccttctcggccttccatttggctggaaactgcagcgcagccttgttgggcctgcgcgggaacggcactttttcgatggtttccagttcgaaaccggcctgcggaaccaaatcacgctccagaccgacggcggtgcccaccaccgcgatatccgcttccggttcaagctcgcgaatcacatgcgccacggcgagcagaggattgacgtggcctgccgtgccgccaccggcaagaacgatatgcttctgattgctcataatccacgagcttagcccaccatgcggcggcaggccacgcggcataccgccgccgatgcagatacttacatttcgtctacgtttcttttgcttgcttcgcaactcgcatgacgggaaccgattacagtatgcggttctcggctttgacctgcggctgctccttcatcaggctgatggccacgccggcggcccccagacacatgataagagacgatccgcctgctgatacgaacggcatcggcacgcccatgaccggcagcaggctgacgacgacgccgatgttgacaaacgcctggccgacgatccataccgcgatgcacaccaacgccatggtgatgtaccggtcgcggacctgcacggccaccatcagcatgcaccacgtcatgacgatgaacagcagaatcaccatggctgctccgacgaatccggtttcctcgccgatgatggcgaagatgaaatcgttgtgcgcttcgggaagatagccccatttctcgccggaattgccgatgccgacgcccaacaagccgccggatgcgatcgcgtatttgccgtggaccgcctgatagcacacgccctgcaggtcggacggagagcaggtccggtaggccgccatgatgcggccgagtcggttggggctggtcagaatgaatccgacgataccgcatatgccaagcagcgcggctccggcaagccatttgccggggaatccgccaagcagcaatgcaatgccgccaattgcgagaataatcaagcccgtaccaagatccttgccggacatgaccaggcagaacgcgcacagatagccgagaataagcttggagtacgcgcggggcgcgccgaccttcttcacctgcttgcgcgcgttgatcagctcgttcggcatccagatgcataacgccagcttgacgatttccgcgggctgcatggtgaacacgcccggaatgccgatccatcctttgttgccgttgacttcgacgcccaatggcgtcagtgtggcggcctgcatgaccatggcgccaagcaggaaccagaagctgatctttcggtagaagctggccggcagcatcatcgtgatgaatgctatgaccaggccgaacacgcagtacatgccctgtttcagcgcctgcgcccatggcgactgcccgttggcgatcatgttcaccgaagagctggagaacaccatgatcacgccgaagatcgtgaggatgatcacgcataggcggaatccgtggaagcaccataacgggttggcgagattacgcgttccgccgttcttcaacggttctcgtgtctgtgccgcggcgccgtccgtcatgttcgggcggcttgcggaagacgtgatgctacggctggcctcaggcttccccatgctcattcacccaacgctgagcctgctgcgcgaactggtttccgcgatcggcgtacgacttgaactggtccatggacgcgcaggccggagccatgagcaccacatcgccggattgcgcgtaagtgccggcagcatcgatggcgcgggccatgacggtgtcgttgtccgtgggatcgatgatggacatgggaatgtcgggagcgcttgccttgaacgcgtccagcattggctgctggtccttgccgatgatgatggccgccttgatggtgcgcgcctggtcggcgacgagctgttcgaaacggcttcctttggcaagtccgccggcgatccacaccacggacttgtccgcgaagctgttaagcgacgccttggccgcatgcgcgttggtggctttggagtcatccacgaaacggatggtgccaccgtcggacgttttggcgacggcgacggtctggatgcggtggccgcccggcgtgaactgcttgagcgcggccaacgccttgtctttgtctgctccgagacccaacaccagcgccaacgcggtcagggcgtcggcgagcagatgcgggtagaccgtgccatccggctcggtcagatgcgtgaaatcggtgaccttcgccacttggaacggctttcccgcttctccgccggcaatgccggacatgtcgacgatccagccatctttcacaccgatctgcccgtccttcggctcggccaacgtgaagccgatccggcggcattccggcgcggtctgggccgcgaacgccagtttggtgacgcgttcgtcgtcggcgttgtagaccagcgccttcttgacgttgtggaacaccttcgccttgtcggcggcatagttctcgatgccgccatgccaatcgagatggtcgtcggcgatgttggtgatcgccgcgcagtcgagttccagagaataggtgaaatgcagctggaacgagctcagttcgacgcagagcacgtcgttcgcggggtcgacggcggcatgcgacacggctttgccgatgttgccgacggcgggagcggccaggccgcatgcggtcagcatttcggaggtcatttccgtggtcgaggtcttgccgttggtgccggtgatgccgatccactgcgccggcttgccggtggtgttgctgttcacgcgcagctgccaggccagttcgacttcgctcatgaccggtatgttgcgtttctgcgcctcaaggatgaatggcgtgcgcgggttgaagaccggcgaggtcatcaccatgtcggtattgtcccaatcgatttggtcgaaggaatgcaggtcggcgtccggcttcttctcatccacgcccagcactctgccggcacgggagcccagcacttccatcatgctttgcccggagacaccgagaccagccacgattacggtcttgccatccatattcatatccatcaccctccaatcggaaacgtcatttgccgtgatagcacacttatattgcgggcgtaaagccgcgcccgcaatcgtgtcacaggccggaacgggccacccaatcgccgtagaacagcaccaaggcgatcagcacgaacagcatctcgatcatccagaaccggaccacgaccttcacttccggccagcccttcaattcgaaatgatgatggatcggggccatcttgaaaacgcgcttgtgggtcatcttgaagtagccgacctggatgatgtcgctcatggtctcgatgacgaacagaccgccaaggatgatcgccaggaattcggtgtgcgtggcgatggacatggctgcgaacagaccaccaagcgccaaggagccggtgtctcccatgaagatggaggccggattggagttgtaccacaggaagccgaagcaggctacggccgcgcacgccgcgatgatggtcaggtcaagaggatcggacaccgcataggtgaagcctggatggtccgaacccttgaggtggtagaactcccagaacgcgatgatcgcatagccgatgaaggcgatcatcgaggagccggcggccaagccgtcaagaccgtcggtcagattgatggcgttggtccatgcggtcatcaggaaattcacccagatcacgaacagcacgatggccacgacacgaccggcgaattcaaagctgaagaacggcttttcgatgaagctcatgccggcctgggcgctggggaagccggatttggtcggcagaatcagcgccagcaccgcgtatatggtggcgaggatgaactgtccgatgaacttgcccttgacggtcagtccctcgctctgcttcttgcggaccttcgcgaaatcgtcgatgaatcccaagaatcccatcgacagcatggcgaacagcaccaacaccgcggaccacgacggcacctctcccctggtgaggaaccgatacagtgccgaggagcaccagccgagcaccaccgcgaggttgatgaccacgccgccaagcgtcggcgtgccgcgcttgacgagatgcgacttcgggccatcctgacggatgtactgtccgtagttgagtttgtgcaccaacttaatcagcagcggagtgcccacaatcgtcacgacgagcgacaccataatgccgatgatgagtgaaatcacctgatcttctccgtttcagtcagctatgatcggcacgacgccgattccgtcagttttgcgtccaacgctccgccagagcgctcaatccggacgcgtgggatcctttcagcaacaccactgtaccctcatggtcggtcgcaagccgggtgaccattcggtcggcctgttcggcatcatgcgcccattgcaccatcgtcgggtcggcggcaaccgccttgccgccctgcgccatggcctcggcaagcgcgtccaacgcctcgtcggaagtactgccgaccgtcacaagcgcgtccgcaccgccctcgacggcgtatctgccgacgtcctcatgcaggcgatgctcatccggtccgagctccagcatggctccgagaaccgctattctgaacggctgctgctcggcgccggcatgccagcgcgacaggccatcgagtccggccttcatggaatcggggttggcgttgaacgaatcgtcgatcagtgtgaacgacgtttcgggcttggtgacggtggacaccgccatgcgatgcgggctgatgctcgtcacgtcggacaggccggaggccacagcgtcaatcggcatgcccaacgtcatcgccaccgtggctgcggcaagcgcgttcatgacgttgtgctgtccgcagatgccgagcgtgacgttggcgtgccggcctgtcttgtcttccagtacgaatgacggatggtcgagatcgtcgcagcgcacgtcgagcgcggtcgtgtccagttgcgcgtcttctttctgcggcaggccgaaccacagcacatcggccggagcgatggcgctcatcgcggccacatgttcgtcgttggcgttgaggatggtcaggccgcccggcaccagtccgcgtacgatttccgatttggcttgggcgatgcgttccgcagagccgaattctcccagatgcgccacgcccaccttgagcaccacggcgatgtccggcggaaccagggaggtgaggttggcgatttcgcccacgtgattggcgcccatttccgccaccaggaaacgcgtgccggcgttcaccttgagcgacgtcagcggcaggccgatctcattgttgaacgatccgaccggagcgacggtgtcgcccattttggacagcagcgatttgagcagatccttggtggtggttttgccgacagaaccggtgatgccgatgacggtgaacggcgattccagcgcgcgccgacgctcgatattatgcttggcgagcgctcccaacgccttgacggtgttttctacgacgatctgcggcacctgcgcgcccgcgatttcgtggtcgaccagtgcggccacagccccctgcgcgccgaccttcggcacgaaatcatgaccgtcgacgcgttcgccggcaatcgccacgaaaacggatcccggcacgatctggcgcgaatccgtgaaggcgctgatggccaccggttcgtcggtcggcacggtcgtcggcatcaaccgtccatcaaccgcctgcgcgatctccgtcaggctcatcggcatcatggtcgggctgctcactgtcgttactcctctaatggttgggtttgtgtttgacgtggagaatgtttcgttccacgtttagttcaggtcacgcgagacgcgtaacgcgcttttgatgttggctttcctcacgccggcggccagcaccatggcgatggacagggacagcgaacggctgtccgtctggccgtatgccgtcgcggcctgcgccgcaagcaggtcggattcctgggttcgtcccgcgatgcgggtctgtttgccgaccgcgcatccgaattttgcgacgagtttcgcaacctcggcatcgctcaaaccattgtcatcgcaggcaagcacatcgacgctgaccgattgcaacgcgtcctcacgcagggtctcttcatccaacgcgaggatcacagcggctgcgccgtcttcggcgcacaccgccatggtacgttgcacatcgatggccgacagaggatattccagattgaggaagcgttccaatgactgtgaatcggacgagctgatcacgccgacggggttgcccagcatgtgcaggaaatccgcgaggttcctcacttcggattccacgatctccctgttcttccccgtgatggcgaacacggccaatgcgtcggacggattgccggccatgtcgctcaccagtttgccgagctgtcccatggtgggttcggcgtagatgagcggaatctggatgtcgtcggtttgaccgcgcagcgcatggggcacgatcgcgccatatgctccctgctcctgagcctgcgacaactggtgcacgtccacatcggcggacgggacgaacagtgcgccgggacgcaccgattcgacatcatccgcgatggaagtgatcgtcacttcagccgccgacgtcggatcaagatcgaaaccgtatcggctggcaagcagccctaaagtcattcgtctgttcatggattcgctgaccgcgctcacctttccgcccctccgtgtctgaatacgtattcgctcaccaattcaccggaatagcatccgtgcgaggtgaagacgccggcacttcatacttctgcataaggaattcaccaatctccgcggtgacaggacccgccgtcaaaccgccgaagctgccttgggggtctttgagcaccacggtgatgacgaagcgtggattatccgcgggaatgatcgtcgagtaatcgctgatgatcgaggtcagttggccgttcgctccggcgacttctgctgtgcctgatttcgccgccatacgatagccgtcgaccttcacgaaagtgttgtagtgttcagcggacgattccatggcgttgagcatctggctcgccacggattcgtcgatgacgcgtgtcgcctcgcccttggactgctgctcttcgacatgccccgcggtgtcggtgatggacttgatgatgcgttgcggctttttgacgcccttgttggctatcaccgaaatcgcgttggtcagctgcatgacgttcaccgtgtacccttgaccgaacagcacggtgttgcgggttcgcctgtcccagctatccgaggggtgcagcacgccttcggattcgcctggcaggttcagtcctgtggcctgtccgataccgaatttgctgatgaagttgtaccgctgctcgttggtcatcttgtctccggcaatgaccatgccaacgttcgacgactgttcgaggatgccggcgagcgtccaatgttcgttgccatggtccaccgcgtccttataggtctgtccttccacggtcaccgtgttcggtaccgtgaatttgtcatcgatcttgtgcaatcccagttgcagcatgcccgacatggccagcaccttgccgatggagccaggttcgaaggtctcgctcaccgcccgggaggcgcccatcttcgcctggtcgcttccggcctcggtcgtatcgctgtccgccaaagcgaggatgtcgcccgactgcacgtcctggaccatggcgatgccccaagcggaatggtatttgttttcgctgtcgctcagcactttctcggtgtaccattgcacatcccggtcgatggtgagggtgacgtcggatccgttgaccgcgtctttagattcggtcatggttccggggatttcgacgccgctgttgccctgttggtacacctggtagccgtcacggcccgtcaatgtcttgttttccatctgctcgatgccggccacgcccttgccgtcggcgtcgacaccacccaatagcgagcccatcaaagtgccgttggagtacagacgttcgttgcttaattccgcgtagacgatgccgccgaggttcagcttggagattttacgcttgaccgcaggcgtcacgtccttcttcaataccacgtattgcccgctgatcgacagtttggcgcccagttccgtggcgtccatgcccaatacgggggccagcagacgagccacggctgcggctcccgtcacgccgaccggcttgccgttgatctggtggcagttgctgccggtctgtttggtgcaggtggtcggtatgaacgcctgcgcctgttcggggttgccgatgatggtgtagcgttcgacgctttgcgcgagaatcgcgccattggtatccatgatcttgccgcgtcgagccttcaacgtcacggtggtggtacggctttgcgccgcggcctgcgccatgcctttgccgttgaccagttgaatattggcaagttggataaggcaggtggtgcccatcagcgccagaacgacgccgatggccatggttttcgtcaacaggttcttgtggaagaacgtgtagatcctgcggatagggttcaccgggtcttgtctccacttgcgtttgcctgatagccgttcagatcgatggtcaatgcgcctttctgcgggaccatgcccatctcttcggccttgctcggcaatgaggcgtcaagttcgtcgagcttggcctgatcgtcctcgacgtcctgggtcagctgggtgatatgcgtttcgatttggctcgcctcgaaggaattctgcaccatttgggtgcgcagcatcagcgagcccagcaggcatacgccaaggaacaccgcggcgatgaccaggtgcagcagcggcgtgctgcgggtccgcgtccatgtgatgagttgttcgaagccgtgacggatgccgttgccttcgactctggtccctttgatgacgtgcagttcgggacgcgtggtgccgatggtctcggtctggcttttgcggccggccggagccgcattcgaagcgatcgttcttggtgccgccacttcagtcccttcttccttgtctggtcatgcttgcgtaatccgcgccttggtcgaaccgtttgcgccatcgtgcgggaatcggtctggtcaattccaccgcgcgcaatctgacggacgccgatcgtggattgttggcgatttcctccgcgtccgccttgatggcgccgcgggtcagttccttgaagaacggcatcatgtcgggcggcaccacgggcatatccgccggagcgtcgaccttaagcccttggttcatgaaggctttgacggttttgtcttccaacgagtggtacgactccaccaccagacgtcctcccacggcaaggtggttggcgatttgcggcagcgtgccggcaagcttgtccagttcgccgttgacttcgatgcgcagcgcctggaagacgcgtttcgcggggttgccggcgggacggtgggcctgcggcacgacctcgtccaccaaacgattgagctggcccgacgtggtcagcggctcggtttcacgccggcgtacgatttcccgtgcgatctgcttggagaaccgctcctcgccgtatgcgcggaagatacgcaccaaatcggcgaacgaatattcggcgagcacctgctccgcggtcaggggctgcgtcacgtccatacgcatgtcgagcggcgcgtcatgggaataggagaagccacgttccgtctcatcgatctgcaggctggacaatccgaggtccatgaacaccgcgttgaccttgtcgacgccttggtcggaaagcacttgggagaagtcgtcgaatgccgcgtgcacgggcgtgaaacggtcggcaaggccttccatttccatgcgtttcgtggcgagcgcgagcgcctcggtgtcccggtcgatgccgatcaggcgggcgttggggcttgctttgaggaacgctgtggaatgcccggcgaggccgagggtgcaatccaccgcgatcgagccgggcttcgccaatgccggtgccaccaagtccacgcaatcgcggagcagcaccggctgatgaatcgtcgtcacgtctgtcattagaactccatcgccggcaatacgtcatcggcaatgtcggaatatccttgttccttgtcggccaagtaatcctcccatgcctgtctgttccaaatctcggcccgggttcccacgccgatcaccacaatgtcgctgcccagattcgcgtaatcgcggagcatctgcggcacaagcacgcgtccctgcttgtctggttcctggtcgaccgcgccggaaaggaacacacgcaggtagtcgcgtgccgccttgtttcccatggacgtgcgttggatctgcaccgcgatccgtctgaattccgattgcggcagcaggtagacgcatcgttcctggcctcttgccatcaccatgccggagcccagttggctgcggaacttcgcaggcaatgccatacgtcctttggcgtcgattttcggagtgtaggtgcccagcagcaatggcggcaagcccgccatcatgccgccggattgagccgggtcatcgtcggagacgggttctgctccaatgtcatggaccattaccgcacctcctttttgcccacactcggcccaccaatccgagacactttccccactctaccccaccgctcaccatttttccccacgaaaaagcaaaaatgcctcaaaatattgtcgatttctccccatatttgagattgcgcgtccgcaccgtacagttccggcgttgtcagcccatcgcgattcgccgcggccaatcgccgctcgtagaagccttggggtacattagagtgccttaagtttttgatgaagggacagcaatgtcgagttattccgcccagttgcgtgaggagcaacaggccgtcagccgcgcatatgatcgtctggacgcgttgagggcgcaggctcggtcgcgtctcgacacggtccgggccgcaggatcgcacggttcgcccacgcaacgcaccgaacgcgattccttcgccaccatgtacgaggaccgtctcacccagcttcgtgcggtggaggatcgtctggttttcggcaggctcgacgacgtgcatggcgcgcatcgctacattgggcgtatcggcctgtccgatgaggatcatgagccgattctcaccgactggcgcgccgacgcggcacgcccgttctatgaggcgacgccttcgaatcatggcgacatcgtcatgcgccggcatatcacgttgagtttcagggaagtggtcggcgtcgaggatgaggtgctcgacgtgcattccgatcaggtcggcgaggcgtcctccaatggcacattgaccggcgagggtgctctgcttgcgtcgcttaacgccaaacgcaccggcaagatgaccgatatcgtggccaccatccagggcgagcaggaccgtatcatccgtgcggacctcaaccaggcggtggtggtgcagggcggtccgggaaccggcaagaccgcggtcgcgttgcatcgcgcggcctacctgttgtatacgcatcgtcgcgcgttgcagcgttccggagtgctggtggtcggccccagctcgacgttcctgcattacatcgaccaggtgctcccctcgctgggtgagacaggtgtggtcagccgtaccatcgcggatctgattcccggcatcatcgccaccgcgcatgacgacccgtatgcggccaagctcaagggtgaacgccgtatggccaaggcgatcgccaatgccgtggcggctcgtgaacgcgtgccttcgcatctgccggtcatccgcatcaacggtttcaacgtgccgatggtacgtgcggatatcgagcaggccatcgccgatgccaagcgcacgcggcagccgcataacaaggcgcgcgagaccttcgtgcgcgacatgctgtcggccatgcgcaaccggtacgtcgaacggcttgactacgagccggagcaggccgagcttaacgatgtgatgcagcagttgcgtatgaacgacgatttgcgcaagacgctgaacctcgcatggctgccgatgaccggcgaatggttggtcgaccagctgttcgcgaaaccgcagcaattgcgccgtttcgccccctggctcgaagagcgtgacatcgagacgctgacgcgtccgaagggctcgcccttcaccgtcagcgacgtacctctgctggatgaggccatggaattgcttggaccggatccgaaggccgtggccaggcagaaggcgttggatgccaagcgcgccgaggaagagcagttcgccaaggacacgctggcgcaggccggtatcggttccggcatcgtcacttcgcagatgctggtggacaatatcaatggtatggacgccgaattaaccgcgcagcgcgccgcggccgaccgcgagtggacgtatggccatatcgtggtggatgaggcgcaggagctgaccgcgatggattggcgcatgctgatccgtcgttgtccgtcgcgctcgttcacgattgtgggcgacgtggcgcagacctccgcgttgggcggtacccggtcctggcgtcgcatgatggacccgctgttcggcgaacgcaactggcagctcaacgagttgacgatcaactaccgcaatccgaaggaggtgtcgcagctcgccagcgatttcgcctcgtccgaaggcctgtacatctccacggtgaacgccgtgcgtggcgtcccggattcagtcaagcgtctcaccttgcgtgacgatagcctgatcggcgacgccgtcgcgcagcagaccgtcgagttggtgcgcgcctacgtttcctccgacggtaccggtcgtgtggcgatcatcgcgccggacgatatgctcaagccgttgcgcgcacgcgtatacgcacaacttcaggatgagctcgacccgaaggaattcgacaggctcgatgcccagagttcctgggacgagcaggtcaccgtatgttccacacagaccgtgaagggtctggagtatgatgccgtgatggtggtccagcccggacgaatcgaggagaacgcgccgtcgcgtatcgtagcggcctccgatttgtatgtcgccatgacgaggcccacgcagcgtctgcttatactgcggacaaaagacgacgaaaagctgctcaagctatatggtaggaaccatgcctaaagcattgttacttgaaaacatccatcccgacgcggcgcagtcgctgcgcgaccatggcttcgaggtcgagtgcctcaagggagccctgagcgaggacgagctgattgatgcgttggaaggtgtcgacctgctcggcatccgttccaagaccagtgtgacccgcaaggtcatcgacgcgcgtccgacgctcaccgcggtcggctgcttctgcattggcaccaaccaggtggatctcgaatacgcgggcaagaacggcatcgccgtcttcaacgcgccgtattcgaatacccgttccgtggtggagctggtgatcggcgacatcatctgcctgatgcgccgcattcccgcgcacacccatcatatgaagcacggcatgtgggataagtccgcctccggctcccatgaggtccgaggcaagacgctcggcatcatcggctacggcaacatcggctcccagctttccgtcgtcgccgaggcgcttggcatgcgcgtgctgttctacgacattgaagagaagctcgccatgggcaacgcccaccgttgcgacacgctcaacgaattgctggaacagtccgatgtggtcacgcttcatgtggatggacgcaagtcgaacacgggattcttcggcgaagaccagttcgagcatatgaagcaggatgccatcttcatcaacctgtcccgtggtttcgtggcggatttggatgcgttgaagaagcatctggattccggccatctgtccggcgcggcggtggacgtgttcccaatcgaaccgaagaagaccggcgacgagttcctgaccgaccttgcggacgaggacaacatgatcctcaccccgcatatcggcggctccacgcttgaggcgcagaagtccatcggacagttcgtctcccagcgtcttgaggattattggttcaagggttccaccatgttgtcggtgaatctgccgcagatcaccctgtccgacatcaagtcgaatttccgcatcgcccacctgcatgcgaatcttccgggtgtgctggcacgcgtcaaccgtgtgctgggcgaggacggcatcaacatcgccgcccaggccttgggcacggaaggcgagatcggctatgtggtcaccgatgtggcgcagcgcccggaccagagggctctcgaccagctcgcctccatcgagggtacgatccgcatgcgcgtgatcagctgagcacgcaatacgaaacgttacgataatgcgggcggggttccaaccatcaggattggaaccccgcccgcattatatatgctgtatttgcttacagatgcggcacccgtctcacgccatcattcggaacttgcgcccttcagctcgtcgatggccctttggaagtcctccagattctcgaaattctggtagacgctggcgaagcgcatgtacgccaccatgtccaagtcacgcagcggcttgagaatcgccttgccgacctcatcagatttgacttgggccaatcctcgtgaacgaagatcctcctcgaccttctgccccagcatcttcagatcgtcctcgttgatgggacggccctggcatgccttgcgcacgccggaaatcaccttattgcggtcgaattgctcgacgtttccggaacgcttcacaaccaatagcatggtcgtctccaatgtggtgaatcgcttggagcatttcgggcattcgcgcctgcgacggatggagtgaccatcgtcgctaatacgggtatcgaccaccttggtgtctggattctggcaaaacgggcaatgcatgttgtccagaatagactgagcccttgaaataagccacgcttggcggcccctacgcctcatggggaacaatgaggcgctgccccgcatgcaaagacaccgtatcaaggttgttcagccgcatcagttcatccaccgtatctccgacattgccaccctccggagtgatgctcgccgcatacctccacaaggtgtcgccgggttgcaccgtatacacgacgacagcggtggaatccggcgcggactgcgcacttccgggcgcgatgaatccaaaaagacaccaggcaaaaccggccgccatgatcgccatggcgattcgatttgccacatttccgatattcgccgcaccgttcaccacgccactccttttcgaacagctgttctatcgaacgcttgttccaagtatggcacatatgttcgataaacgcaaacacacctcgaacagatgtttgattttatcggcgtttcgcgttatgcttctaaggaactacgaaaggagcccatcgtgagcaccatccccttcacgcccaagaagagcgacgagcgtccggatgaaagcacgttgaccgaccgccagcgcaaggtgcttgacgccatcaaaacgcatttggccaagcagggattcgctccttcgttccgtgagattggtgaggccgcagggcttaaaagcccgtcatccgtcaaacaccagcttcaggttcttgacgaaaaaggcttcatccgcatgaacgcgaacaaggggagggccatcgaagtggtgaacctcaatgacgaggagccgaatggaaaagtcgcccaggtcatcccgttccccagtcaggacgatgcatgcggctccatcatggcctcgcatgacgttccactggtcgggcgcatcgccgccggcgtgccgatcacggccgagcagcatgtcgatgatgtgatgaggcttcccgaacggcttaccggcaccggcaatctgttcatgcttgaagtgcacggtgattccatgatcgacgccgccatttgcgatggtgatttcgtggtggtccgcgagcagaacagcgcggagaatggcgatatcgtcgccgcattgctggatgacgaggccacggtcaagacgttccgcaaggatcacggccatgtctggctgattccgcacaatccggcctactcccccatcgacggcacgcatgccgagatcatgggcaaggtcgtcaccgtgctgcgcaagatctgattgctttcacacgttaaacggcaaagggcgtcgaacataccattttgaggcatgtccgacgccctttgccataccctttgccataccgcgcggttgtgcattcaccttgcgaatccatcaagaatgaacgcgagggcatttcaaaatgtcgtcgcattcttgaagttcgggagcacggttcagaaatgcagttccttgcggctgtccgaatcgtatccttcaggttcaagctggaaggtggtgtgcggcacggatacggggaagtgctcacgcaggcagttctgcaattgggagaggacgtcggcggcatcatccatggtcagcccgcgctccactaccacatgggccatgacgacgggcatgccggtagagacggtgctggcgtgcaggtcgtgcacggccaccacgtgcggcacctgctcaagatgttcgcgcacctcgtccagatcgagttcctgtggggtttcctccagcagcacgcgcacggcgttgcgcagcagcacgaacgcccgggggatcatcatcaatgcgatgatgccgcccgcgacggcatcgaagccggcccagcccgttgagatcagcacgatggctgaaacgatcacggccacggaccccaatgcgtcgttcatgacttcgaggaacgcggctttcatgttcatgttgtcctcgctttgccccgcgaggatgaagatcgaaccgacgttggcggcaaggccgagtatgcccatgaacagcagcaaccgcacgtcatgcacttcgtcggcggctccgccgaacagcctcatgccggcttcgacgagcgcgtagatgccgacgatcaggagcacgagcgcgccgaccgcggcggtgagcacttcgagtcgcgcccatccccaggtgcgtttgttgctgggtttgcgttgcatgagcaccgcggtgacggtggaggcgatcagcaccgacatgtcggtgagcatgtggccggcgtcgaccagcagcgccagcgatccggtgacgatggcgctgaccacttcggcgatgaacaccgtggaagtcagccccaatgacatcatgagtcttttctggtgttcggccccgcttgcggcggtcgtggcgtccacacccgcatggttgtgtgccatgatgggtttcctttcgtcgtctttggttcgatccgcggctattgaaaccgcttctcaataccattttcattcgtctcaaaacgcaggaaaccccagcccgaaggctggggtttccaagttctgctgacagcctagcggctcaccgctcccctgtcaataaagtcaaaccgtcaattaaaaaccgaactgggcggcggtttccttcagcgtctccgcggaacgcttcagggccgcgagctcacggtcggacaccggggtgttgatggcggtattgacgccggaacggttaagcagggtcggcacggacatgcacacgtcggagatgccgtggaagtcgtgcagcatggagctgaccggcaggatgcggttggagtcgcgcatgacggcttcgatgatgtccacgccggacatgccgatggcgtagttggtagcgcccttgccgttgatgatcttgtaggcagcgttcttgacttcctggtggatctgctcacgcacttcggcgtccagcggatcgtggcccggcagcggggtccagtcgcacatcgggacgccgccgatggtggcggaggcccacagcgggacttcggaatcgccgtgttcgccggcgatgtaggcgtgcacgttcttgacgttgacgccggtctgctgcgcgatcaggaagcgcagacgggcggagtcgaggttggtgccggagccgaagacctggttggccggcaggccggagatcttctgggccacgtgggtggcgatgtcgaccgggttggtgatgagcatgtagatggcgttcggagcgaccttcacgaggcccggaatgatggccttgaggatgttgatggtggcaccgaccagctcgaggcgggactggcccggcttctggcgcgggcctgcggtgatgacgatcatgtcggcgtcacggcagatctccggatcgtcggagccgtcgatggtcacggtcggatagaagctggagccgtgctgcatgtcgagcacttcggcctcgacgcgttccttggcgatgtcttcgagcacgatctcacgtgcgacgccacgctgagcagcagcgaaagcgagagtagagccgactgcgccggcaccgatgatagcgagctttgtgggcttgattggtgaatccaccatgtgctttacctctcttttgagcaagaagaacgtcccgcgttgtggcagggtattttctttcgatttcaaccctactttatccatacagcatgacgtttcgccgtgaatccgcatgatttgcaaccactgaaaagtgattttcgtcacagcttttgtgagcgctcacatacactgcacccgttgaaatgcagctgttgcaatccgttgcagcgtttgcacggccgctccggcaaacgtcatcgggaacggcttgcacggaagctcagtcgatggcctgctccacgatctgcgcggccagctggtcgtcgacctccgcttcgagcatcatgccgtcgtcgcggtattcgacgttgaccaccctgccgtactcgcgcacacgggacatgagcgagccggcggcgtacggcagcaacgcctcgacatgcacgtttggcgtcggcagcatcgattccaccttctcgcgcagcgcctcgacaccttctcccgagaacgcggagacaatatacgcgtccggcatcaacgcctcgacccgctcacgcgcggcctcatccatacgatcggccttgttgaatgccacaatcgtgggaatcgtttccacaccatcaatgtcggaaagcacgtcattgaccgcgtcgatctgtgagaacggatcaggatgcgatccatcgaccacgtgcacgatcaaatccgcgtcggcgacctcctccaacgtggatttgaacgcctcaatcagctgcgtgggcaggcggcgcacgaaaccgacggtgtccacatacgcgtacagtcgcccgtccttggctttcgcacggcgtacggcggtgtccaaagtggcgaatagcgcgttctccaccagttccgcggaaccggtcagccggttggtcaacgacgatttgccggcgttcgtatagccgaccacggcgacggtcggcaggccgaagcgacggcgcgcgccacgtttgacgtcacgggcgggcgccatctgtgcgatctgccggcgtagtttggcgattctgctgcggatcacgcgacggtccatttcgattttcgtctcgcccggaccacgggagccgatgccggcgtcgcctgccgcacggccgcccgcctgacgcgacagcgacccgccccagccgcgcagtcgcggcagcatgtattcgagctgtgccagctcgacctgcgccttgccttcgcgcgacgtcgcatgctgtgcgaagatgtcgaggatgacggcggtgcggtcgaccaccttcactttggtggcgtcttccaatgcgcgtcgttggctcggcggcaggtcatcgtcgacgacgatggtgtccgcctcgtcctgcgccacgatgccagccagttcgcgcgccttgccggaacccacgtatgtggccgcgtccggcttgatgcggtgctgcagcaggccgtcgcacaccacggcgcccgcggtttcggcgagcgcggcgagttctcggagcgattcctcggccgcggcctgcgtggtctcgcggctggaccatacgcctacgagcacgacgcgttcgagcctgactttacggtattcgacttcggtgacgtcctggatctcgcccagacccgccacatgcttcaatgcgttgcgggattcgcgttcctgccactgttcgtcgtgggtttcgcgaaggtgttccccgccgttggtatcaagcagcacgtcggattggtcagcgagcacgcccgtgacgtcgcctgcggtcatgctctgctcgatatcgttgtcttggctcaatggcacctctcacggttgaactatggtgtctttattatcatcattgtctagagacatgggcatccatgctttcgccacgtggacgggcgcggcgaaaaacaccatggattgccgcagacgagcgtttgcaaggagatcggacatggcacaggccgaacagtatttcgcggcggagccgcagtcgaaggacgtgcgcaaaacactgcacgtcacgttgcgcggcaacgaggcggacgtggaggtgtcaaacggcgtgttctccggcaaccgcgtggatttgggcacgtcggtgctgctgcgtcaggcgccggaacctcccgaggagggcacgttcctcgacctgggctgcggttgggggccaatcgcgttggcgttgggcttcgcttcgccgaaggcggacatctgggcgttggacgtcaatgagcgcgcgctcgaactgacccggcgcaacgccgagctcaacggcatgggcaacatccacgcggccacggccgacggcattcccgcggagacgacgttcgacctgatctggtcgaatccgccgattcgcgtcggcaaggaagtcctgcacacgctgctcatgacatggcttccgcggctgaacgcgggaggcgcagcatatctggtggtgcagaagaatctgggttccgattcgctgatcccgtggctcgccacgcagctcggcgacggatatgaggtaagcaagtacgcgagttcgaaaggcttccgcgtcatcgaggttatgaaggcatgagattcgaatatccctcccaactgccggtttccacggcgcgcgacgacatcgccgaagcggtcagagcaagccaggtggtgatcatttccggacagacgggttccggtaagaccacgcagctaccgaagatcctgcttgagctgggccgcggctcgcatggcaggcagatcgtgcacacgcagccgcgcaggctcgccgcacgtaccgtcgccgagcgaatcgccagcgaaatgggcgtgaagctgggcgaggaagtcggctatcaggtgcggttcaccgacgaaagctcgccgaagacacggctgcgcgtcgtgaccgacggtatcctgctggcgcagatccaacgcgatcccaagctcatgcagtacgacacgatcgtcatcgacgaggcgcatgagcgcagcctgaacatcgatttcctgctcggctatctgaccgcgttgctgccgaaacgacgcgatctgaagctcgtcatcacgtccgccaccatcgattcggtgaagttccaggagcatttcgaacacgcgctgcatacgaaagtgccggtgatcgaagtgtcgggacgcacctaccccgtgcagatcgtgtacgagccgttgggtaccgcgccggcgctgatgcgctccgtgccgggcttcgaaaccggcgcgatgccgggagacgctgactacgagagcctgtccgcagcgccggatggtagggatggccgcgattcacgcgatacgaacgtggacatgcccaccgccgtggcacgcgcctgcgccgaactggtcatccattcaagccacgaccgcgggccacgcgacatcctcgtgttcgcctccggcgagcgcgacatccacgaattcgaaaacgcgctgcgccgccattacggaccgcgcgcggtggacatgcgccgccccgacgcgatcgagatcgtgcccctgttcgccaggctctcctcgaaggagcagcataaggtgttcgagccgcacgagcatcagcgcatcgtgatcgccacgaacgtggccgaaacgtcgttgacggtgccgggcatccgctatgtggtcgatccgggcacggcgcgcatctcccgttattcgaagacggcgaaggtgcagcgactgccgatcgaaccaatcagccaggcgagcgcgaaccaacgttcgggccgctgcggccgtatcgccgacggcatcgcgatccgcctgtactcacgtgaggatttcgagacgcgtcccgaattcacggagccggagatcctacgcacgtccttgggcgcggtcgccctgcacatgctgtcggtgggcgtggcgcgcaccgcgcgggatgtgacggatttcggtttcatcgacccgccggatatgaaggccgtatccgatggtttcaacgagctgaccgaactgaaggccatcgcccgcaagcatggcgaagtggtgttgacgcatacgggccgcatgctggcgcgcatcccgatcgacgtgcgtttgggccgcatgatcatcgaggccgcgaagtcaaccacgccgaacacactggccgccgtattggtggtcgtggcgttcctcagcctgcaggatccgcgcgaacgtcccgatgagaaccgtgaggaggcggaccgcatccacaaccggtatgcggacccgaccagtgacttcctgaccgcgttgaacctgtgggaccgcgtgttccaagctgatggcgaaccaagcaattccgcactgcgccgcatctgcaagaccgagtacttgagttggctgcgcatgcgccaatggaaggatctggtcgcccagctgcgcgaaatgtgccgggagttcaaattcaagctcggcgagccaatccccgtgtcccgcccaccgttggaaatccgccagctaccgctcaaccagcaggcagcgcattcgctgtgctgctcatgggacgcgcagggcatccacacgtccatgctttccggcctgctgtccatgatgggcatgcagatcgtgcgcgagccgaaggcttccgatttcgccgggctcaagggagcggcacgggcacgcgcgatgaaacgtgcgcagaagatggcgaagaacgactatcagggcgcgcgcggcacgcatttcgccctgttccccgcctccgccgtagccaagtcgaccccgcaatgggtgatgagcaccgaactggtggagacaagccggctgtgggcgcggtactccgccgaaatcgacccagcgtgggccgaaccgctcgccggagcgttgacgcgcaccacctacgccgatccgcactggtccggttcgcgtggctcggccgtggcgagcgcgaaggtgctcctgtacggcctgccgatcgtgcaggaccgcaccgtgcaatgggggcgcatcaacccgctcgaggcacgcgacttcctcatccgccaaggcctggtggaaggcgacatccagcaacggttctcctacgacgatttcgtcatgcggaaccgcgacatcctcgaagacgcggccgacgacgcgagccgcacccgccaggtggcgcagaccgtcggcgacgaggacctgttcgacttctacaacgccatcatccccaacaccgtcaccagcgtggccgacctggcgaaatggtggaagacaaggcacgacgagcagcccgacctgctggatttcgacccggacaaggtggaacgcctcgccgactccgattcggtgtccttggacgactatcccgaccattggcatacgctcggcaccgacggctcccccatcgacctaaggttgagctacatctacgatccgcacgacccgaacgacggcgtcaccgtgcacgtgccgttgaaggcgctgtcgcggctgaccccggaacagttcacatggaacgtgccgggactgctggacgggctcatcgtcggcatgatcaaatcattgccgaaaaccctgcgcgtacagttcgtacccgccccggacacggcacgcaggatccgcgcctggatcgacgaacgctaccccgacctacccggctccggaagccagcaaaaaccaaacctggcccccgaaaacgaggatggcgtcgccgcatggcccgacctgccacacgcgttcacccaagcggccatcagcatcgtcggcgcgcaaatccacccggaagtcctcactggcgaactgtggaacaagctcgcaccatacctgcgcatgaccttcgccgtggaacagcagctgccacccaaccgcaagaaccagcacggcagacggcacgcgcgaggccccgtcaaaacactcggcaccggcaaatcactcgtcgatctgcaacgcaaattcgccgagcaggccaaagcgtccgcacgccacatggtcgagaaacaagcccgaaacgccggagaccaaggcaaaatcgtcgaaaaagccaacctgctcaacaaagcgggagcaaccaccgaagcacgcgccaccatgctctggcaaggtgcactcgacacgctgcgcctgcccggtgaacgcatctcctcacgctggctcggcacggaagcgctcatgctcgcctccgccccctacaagtccacgaaggaactcaccgaagacctgcaattggccgccgtcaaacgactcctgccgaacgtggaccagctgcccgacgacgaagcgctcgccaacgcagtgctcgacgtgcgcgaagtgtacgaggacaccgtgtatgcggtggcgcatgacgtgatcgccatactgaaacggtatgcggaagtcgacaaagccgtgtccggcaaagccgacctgcccctgctgagcgtgctgcagtcgatccgcgagcacatcgccacgctcgtcttccccggtttcatcggcaagacgccaccggacgcattgccgtccatcgaacgatacctgcacgccgacctgctgcgcctcgccaaggcgaaaaacgacaagaaccgcgatgtgcgctgggcatgggaagccgacgaagccaaacaactcgccgacaacaccatggcgaaagcacaacgcgaaccagccggcccacgccatgaaacactcatgaaacaggccgagaccttgcgctggatgctcgaggaattctacgtatccctttgggcgcaggaactcggcacgccgaaaccgatcagcctgcaacgcatcaaaaaggccatcgcctagccaccgaccaaacaacccaacggattgttccgtttcctcaaaccagtcaacgcttcttgaagaaacggaacaactgcgattcccgaatcaacaaccctgcaaacaggctcgccaccatcacaccggcgaacacagccaacggcgtacgcaccgcagccgccaacaccgccacccaatgcgccacgatgagcgatgccatgagcaccgcgtgcgcgcagtagatcggacggatgtgcgtcagcggctccactcccctgccccggtccgcgagcttgccgccatacaggttgctccacaggcaggccgcgccgaagatcaccagtccgacactcagatattgctccggcgcatgcacttcatcgcgcatgatcggagtcaggtacgtgtagaacacgtagcttgcggccgcgccgcacaccacgtcgagcacgcccagctggatgcagcggtcgaagaacaggcgaaactgggacaggaagccgatttttgccgcatggctgttgcgcggcagcacggcgaccatgccgatgatgagcacgacggtaagcgcgttgaccagatggaacgcccaacgccagccgaacgcgttggccacccaagtgccgaccggcacacccaccacggaggcgatggagaagccggagaacacccatgcgatgaatttcgtgcggaaggtgtcggtggccacatcgggcgcgtaggtcatggcgatggccaccagtgtgccggacaccagcgcgatcaggatgcgtccggccatcagcaccgcgtagttgggagcgaaggcgcacagcaggttgcccgccaggaacacgccaatcagcgtcatatgcgtggcgaaccgcgggaagcgcgcggacagggccgaaccgagcggcgtgaccggcgcgtacacgaacgcgaacagcgacaccagattgccgaccgtcacctccgacaccttcaatccgacggcgatgtccggcaggatgccgaccatgatgaattcgctcatgccgagcatgaagctcgaggcgatcaggataagcaccggaagattgaagaaccgttcctttgccatgccgcatttcccttccacaccgggacatcaatcgattgacgtaaccaatccgaggcgacactatgccatgcgcgatacaatatgacgcacgatgacacgcaagacgaacagcacgcgcaaagcacggaaaacccgcaatcgcaagcccctcaatctcaagaatctccgcaccatgtggcggaaggcgaatcccgtcgcacgcatcggcatggtcgccaccgcgaccgtggcagcgatcgcggcgatcgccatcatcgtgggggcggtgcgcttcatcggctggcgcgtgcaggtgaacgaggcgctcaccgcgcaaagccagtcgcagtcgcaatacgacttcaatcccggcaacatcatttccgacggcacgttcttcaacggcaatgcgttgagcgagcagcaggtcagcaccatcatcgaacagcagggcgtggcctgcagtggcgaacgatgcctgaagtccatgacgttcagcaccgaatcgcagtccgcggacgaatattgccaggcttatgatggtggcccgaacgaaagcgcggcggcgattgtctacaaggcgggcaaggcatgcggcatcagccagaaggtgctgctcaccgtgttgcaaaaggagcagcatctgctcacggccaccaatccaaacgatttccaattcaaagcggcgatgggcctgagctgcccggatgatgcgaactgcgaccccacctatgccggcttcttcaaacaggtgtacggcgcggccaaacggtaccagtactatcttcggcacgagggacgctacggctaccatgccggacggctcaattacatccagtacaatccaaatgccggctgcggcggcagcaacgtgtacatcgagaaccgggcgaccgcgctgctgtacatatacaccccgtatcagccgaatgccgcggcgctcgaagcgggggccggtgaaggcgattcctgctcgtcatacggcaaccgcaatttcgcgattatctaccattcgatgttcggcagcccgcgaggctgatgcatcccaatgaggatatgccgttcgagcatatcctcgaccagtccgacaccgattccccgtggcctttccgccatagacgtgtgcgaaacgcacgagcaaggccgccgcccggtttatgttccggacggcggcctcgtgtatgacgttttgtctatcgatggtccgcgatcacagcttcggcagatacttcttcagctcgaacggggtgacctgcttgcggtactcatcccattcctgatgcttgttgcgcaggaagtattcgaacgcatgctcgccgagcacatccgccacgaagtcggacttctccatgatcttcagagcctcgtcaagcgattccggcagcggctggatgcccatggcctggcgttcggcgtcggtgagctcccacacgtcgtcactggtcggctcccccagctgcatctgcttgtcgatgccatcgagtccggcggccagcagcacggagtatgcgaggtacggattggcgaccgggtccaacgcgcggaattccatacgggcggagttgcccttacctggcttgtactgcgggatgcgcagcaacgcggaacggttgttatggccccagcagatgtagctcggcgcttcggcaccgccccacagcctcttgtaggagttgacgtactggtcggtgaccgcgcagatctcggccgcgtggtacaggatgccggcggcaaactgacgtgcggtgacggacatattgaattcctggccggcctcgtagaacgcgttggcatcgccttcgaacaggctcagatgcgtgtgcatgccggatcccggagcgtcgacaagcggcttcggcatgaagctggcatggatgccacgctccagagagatctccttgacgacggtgcggaaggtcatgatgttgtcggccgtggtgagtgcgtccgcatatcgcagatcgatctcgttctggcctggccccgcctcatgatgcgagtattccaccgaaatgcccatctgttcgagcatattgacggtggcgcggcggaagtccatgccagggctacgcggcacgtgatcgaagtaaccgccctcgtcgattggtttcggtgtacgggaccaatcatcctgcttctcgaacaggtagaactcgatttccggatgcacgtagaacgtgaatcccttttccttggctttggccagcgcctgcttgagcacatggcgtggatcgcccaacgatggctcgccatcgggggtgagcacgtcgcagaacatacgtgcggtgccctgcgggcctccgcgccacggaagaatctggaacgtcgacggatcgggcttgacgatcatatcgtcttcggacacgcgggtgaggccttccacggcggaaccgtcgaatccgagcccttcctcgaatgcggcttccagttccgccggcgcgatggccacggacttcagtgttcccaacacatccgtgaaccatagacgaatgaagcgcacgtcgcgttcctcgaccgtgcgcaaagcaaactcttgctgtttatccatagtgtccaatcgttccatgcgcatgttacgaacgtcgttaacacatgccgtgtcgcgacatgtcagcgtgcgacttcgagggcttcctccagcgtgaaggcgcgcgcgtacagcgatttgccgagaatcgcggcgtccacgcccagttcggcgagctccttgatgttgcgcaggtcgtcgagcttggagatgccaccggatgcggtgaccttcgcgtcggtgcgggacgccacttcgcgcagcagctcgatgttcgggccgctcatcatgccgtcgcgtgccacgtcggtgaccacgtaacgggagcagccgacggagtcgaggaacttcatggtctcgaacaggtcgccaccttccttcacccagccgcgggccgcgagggtgtggccgcgcacgtcaaggccgacggccacacggtcgccgtacttcttgatgacggaagcggtccagtcggggttctccagagccgcggtgccgatgttcacgcgggccgcgccggcttcgagcgccgcgtcgagcgaggcgtcgtcgcgcacgccgccggacatttcgatgttgaccttgtcgcccagttccttgacgatggcgcgcagctggtcacggttgttgccggtgccgaatgcggcgtcgagatcgacgaggtggatccattccgcacccgattccacccacgtgcgggcggcttccagcggggagccgtagtcggtttcggagccggattcgccttggcgcaggcgcacggccttgccatcacggacgtcgacggcgggaagcagcgtcaaagacatgtcatacctttcgttgcgttgaacggttttcggccgttcaacggatcttgcgattaccgatttgaatttacgattttgcgattgttgcgattgccttgcacgaatccgcgttcagaacgtcgcaacccagttacgcagcagctgcgcgccggcttcggcggatttctccggatggaactgcgtggcgaacaacggtccacgttcgtaggcggccacgaatcggctgcgcccgtaggtgcaccacgtcacatgctcttccgcatcgccgaagtccagctggtcggcggaggtgtcggcaggcgaagcgctcatcgcggcaaaggagtgcacgaaatagaatcgttcgttctccacgcccttgagcaacacggaaccttccggcgcttcgacggtgtcccaacccatgtgcggcaccacgtcggcgtcgagcagctcgacatcgcccttgatcagaccgagaccgggcgtgccgtcgccatgttccatgccacgttcgaacatgatctgctcgcccacgcagacgccgagcaccgggcggccggcgcgcagacggtctttgatgaccctgtctccgccgacgcttttcagtccttccatgcatgcgccgaacgcgcccacacccggcaccaccagtccgtcggcttccagagcctgacgatggtcggacgtgagggtcacgtcgaggtcgagattggccagcgcgcgcaccatggaacgcacgttgccgaaaccgtaatcgaacaccaccacggaagtcatgggcgctctccttcttttgcttgccgaagaatccatccttcggggaaaaacttattcgatgcttgacgaaccacgaccgaatcgcgtgtgctcggcgaggatcttcatggcgtcatcacgggtcaggcttgcggaatcgacggtttccacgccggaatcacgcaccccctgaacgtcggtgatgcccagcagcaggtcttcgacgaacggcgcggtggaggtgagcagcaccggtggcgcgaacgtctggccgaccttgccttgcaggtacatcgtcgcctcgagcttgtccgcacggttgatcgcgaggacggcaggcatgccggagaccacggtggtcagatctttgatggccgcttccgggccatcgccgtcgagattgcgtaatacagcgaccgcgccttgcggtgaggcgaggcattgcgcggagatgtcggacagttggcagaacgcggcgaacaggcgtgcggaggcaagtcgggtgatgatcaccgcgactttcgcacggttgcccagcagcccctgcaactcgtcgtcgaatgacagcgagttctcggcttcggacagtaccgcgtcggcttccttcgattgcaggccgtcctgcgattcgtcggaagacgcatcggaattaaccgtctcatccggctgatcgaatggcacctgcgcgggagcatcgttctgttgggcagcttcctcgtcctggaattccttttcgaagccggccatggccgcttccagctcctcttcgctgaaatgcatgccgtcgtcgttggtcttccccaagccgtcgaaaccgttcaaatcgtccttgtcgtcggacatcacagcgcgcccttcgtgctgggaatgccgtcgacgcgcggatcgggttcgatggcgaaacgcaatgcgcgggccaaagccttgaattcgacttcggcgatgtggtgcgggtcgcggccggaaatcacgtgcaggtgcaggcagatgccggcatgcatggcgatggattccatgacatggcgaacgagcgaaccggtaaaatgcccgccaatcatgcagtattcgaagccttccggctctccggtgcacacgcagtacgggcggccggaaatgtcgacgacggctttggcgagtgcctcgtcgagcggcacggtggcgtcggcgaaacggcggatgccacgcttgtctccgagggcctgcttcagagcctcgccgaatacgatggcgatgtcttcgacggtgtggtgcgcgtcgatgtcggtgtccccggtggctttgattttcaggtcgatcagcgaatgcttgccgagcgccgtcatcatgtgattgtagaacggcacggatgtgtcgatgtcggttttgccggttccgtcgaggttgagactcagctccaccttggattcgctggtttcacgaacgatggttgcagtacgtgccatgttgcgactccttttgcgatgttgcagttgcgatattacagctacgatattgcgattgcggtggttgcgtcttccgcagccaccgcgattctgttctgtttcaagcttattgccgaatactgtcacgaacttccgttccggacagtatcccagcttgcgttccggcttgttcagccctgttccacgatgcgcagcacttcgaccaacgcctcacggaaccgtgccatttcctcgtcggtgcccatgcacactcgcatccagccttccggaccgacgacgcggatgagcacgccgcgcttcaacagttcgtcgaagatgcggtcgcggtcgtcgaaatggccgccgaagagaatgaagttcgactgggtttcggccacttcgagcggctggcccttgtaggtctgctccttgagccatgcggaggtggcgttgcgggtttcgcgcaggtgcgccacgcggctcagctgttcgtcggtgtgttcgaacgcggcgagggcggcggcctgggtgacggcggacaggtggtacggcatgcgcacgatgcgcacgcagtcgatgatgcccttgttggcggccaggtagccgacgcgtgcgccggcgaaggcgaacgccttgctcatggtgcggctgacggcgaggttttcgtattcgccgatgagttccagcgcggtgggcgtgcccggatctcggaattcgatgtacgcctcgtccaccacgaccaccggatgcacgccttcggcggcgcctgccacttcggcggtacgggcggcttcgagcacgcgcttcagatcttccggcttgagcggggtgccggtcggattgttcgggctggtgagcacgatcatggccggcttgacgtcttcgatcgccttgatggtggcgtccacgtcaagcgtgaagtcggcgttgcggtgcgcaagcttccacgtggtgaacgtgtcgcgcgcgtattccggatacatggagtacgtcggatcgcagccgagcgcgatgcggccggggccaccgaacgcctggaacagctgcagcatgatctcgttggagccgttggcgccccacaactggtcgacgctgagcttcacgcccgattcgcgttccagatatgtggagaaagccttgcgcagttcgatatgctcgcggtccggatagcggttgagcgtcggggcgatctccttgacacgctgggcgatggtttccaccacggccggttcgggcgcgtacggattctcgttgacgttgaggcacaccggcacgtcgagctgcggcgcgccgtacggttcttcgccgatcaggtcgttgcgcagcggcagatatgccggaatcgcgttgctggaagtctcgctcatcggaggccggcctgctcttcctgttccttgatggtcgccttgttgtacgggtcgtcgatgaagcggctcagcacgcattcgccgtgtgccggcagatcttcggagacggcgaaggcgttcacacgggcggcgagggtcttcagtccctgctcgtcgtattcgatgacttcgaccggcttcatgaaggtgtgcacgccgaggccggcggcgaagcgcgcggtgccggaggtcggcagcacgtggttggaaccggacatgtagtcgcccagcggaaccggggagtacgggccacggaagatggcgccggcgttgcggatcttggcgatcacggcatccggatcagcggtctgcacttcaaggtgttcggccgcgtacgcgttggccgcgtcgatggactgttcgatgccgtctgtgaggatgatgccggactggcggccgcgcagcgacgtgttgacgcgctcggcgtgttcggtgcgaggcacgcggtacttgaggctttcctgcaccttgtcggcgatgtcttcgctgtcggtgataagcacggagccggcgagctcgtcatgttcggcctggccgatcagatcggcggcgagccagcttgggttggcgcccttgtcggcgatgatggcgatttcggtcggaccggcgacggcgtcgatgccgacgatgccggagaccatgcgcttggcggtggcgacgaagatgttgcccgggccggtgatcttgtccaccggatcgcacaggatctcgccgtcctgcggttcggagcccttggcgccgtaagcgaacatggcgatggcctgagcgccgccgaccgcgtacacctcgtccacgccgaggatggcgcaggtggcgaggatggtcttgtccggcagaccgtcggagctgctgcggctcggcggggtggcgatggccagcgattcgacgcctgcggcctgcgccggcaccacgttcatgatgacggagctcgggtagacggccttgcctcccggcacgtacaggccgacgcgctgcaccggaatccaacgttcggcgacgcgcgcgccttcggccaggtcggtgtggaacggggccggcacctgggatgcggatacggcgcggcagcggcgcacggattcctcgatggcggcgcgcacttccggatcgagctcgtcgacggcggccttcatggcctcgaccggcacacgcagatgctcgggacggatatggtcgaacttctccgcgaagtcgcgcagggccgcagcgccgcgggccttcacatcatcgagaatcggctgtacgagctcagtggcctcgttggtgcccatctcggcgcggggcatggcttccagcatttcagctcgggtcagcttcttgccgcgcaggtcaatgattcgcatatagttttcttcgctcataacgccccatggtaacaacgccaagtcacgagaacgtcccgtcgtctcacattcagccgcattgtgagacacgcagatccgccgttttccatgccatgccgatttccgcgaaaaatatatgccggtcgacgccattcagcatcggccggcaatcaaaaacctgttcaggtcaaaccgttcaagtcaaaccgctcaggccaacggaagcgagctcggtccgaagagaatcttgatttcggcgaacagcgacgtgtcgcgtttgacgcggaaccggtctccgaacgtcagcaccttggcgttgcctttgtcgtccatcaacgccagtttcacctcgcatgggccgggatggctggtcagaatctgcccgagccgccgcacatgcgactggtcgagcgcgatcggcggcagcacaatcgtcagcggacgttcatcctgcgcctccaacgtcggcacggtgaattcggtggcgcgcatgctcactgtctcatcgcgcttctccacctggccgcggatctgtaccacggtgtcgacggcgagctcgggcgcggcggcctcgtacaccttgccgaagaacatgcattggatggaactttccaaatcctcgacggttacgatggcccacggattgccctttttcgacacgcggcggtccacattcgtgatcaggcccgcgatcgtcacctgctggccgtccggcatgcttcccgcgcggtcgatcaggtgcgctatcgacatttcgcgcaacgacaccagaatcgactgcatgccgctcaacggatggtcggacacgtacaggccaagcatctcacgttcgaagttgagcttggttttcttgtcccactcctccacgtcgggcacctgcaccatggcgtctcccatggcggaatcgttctctttggaatcgtccaggtcggcgaacaggtcgaactggccttccgcctgcttgcgtttcaggccgacgaccgaattgatggccgtttcgtggatggtgaacagcgcacgacggttcgggtcgatcgagtcgaacgcgccggccttgatcagcgattccaccaatcgcctgttcagcgcctccaacggcacgcgtttgatgaaatcggtgaagttcacgtacttgccgtggccgttctcacgttccgcgatgatcgcatcgaccgcgttcttgccgacgttgcggatggcgccgaggccgaatcgcacgacgtcgccgactgccgaatactcgtacaccgactcgttcacgtccggagaaagcacctggatgcccatgcgtcgcgcctcgcccaggtacagcgcggtcttgtctttgttcgtgctggcgccttgcagcagggcggccatgaactccaccggataatgcgttttcagatacgcggtccagtaggagatcaaaccgtatgcggccgaatgcgccttgttgaacgcgtagccggagaacggcacgaggatgtcccacacggcctgcgcggcctcttcggaatatccatgctccttcatgccggcgaagaacggaatcttctccttggccagcacttccggcttcttcttgcccatcgctcgacgcagcacgtctgccttgcccagcgaatagccggcgaggattcgcgccgcggactgcacctgctcctggtagacgatcagaccgtaggtctcgtcgagcacttccttaagcggttcggccacttcggggtggattggcgtgatcttctgcagaccgttcttgcgcttcgcatagttggtgtgcgaatccatatccatcggacctggacggtacagcgcgatcagtgcggaaatatcgttgaagttgttcggcttcaacgttttcagcagcgagcgcatgccgtcggaatcgagctggaacacgccgagcgtgtcgccacgggacagcaggtcgtaggtggggcggtcgtccagcggaatcttcgtatggtcgatgcgttccttgccgttcgcctcgatgttgttcagggtgtctcgaatcaccgtcaagttggaaagtccgaggaagtccatcttgaccagaccgagcgtttcgcacgtatggtattcgagcgtggtggtgacggtgccgtcggtacgttccagcagcggcgacgtgttggtgatcggctcgctgcccatgatggtggcgcaggcgtgcacaccggtctgacgaatcagaccttcgatgcccatcgcctcgtccgtgatgcgtttcgtgtccgggtcggaatcgtacagttcgcggaattcgcgtgcttccgcgtatcgtttcgcgcttgggtcgaagatgtcgtgcagcggaatgtccttgccgccggtctgtgcgggaggcagggctttggtgatcttgtctccgacggagaagtcgtatcccatgatgcgggcggagtccttcagcgcctgcttggttttgatggtgccgtagatcacgcactgcgccactttgtcacgtccgtatttctcacccacgtagtcgagcacgcgtccacgaccgtccgggtcgaagtcgacgtcgatatcaggcagtgagacacgttccggattgaggaatcgttcgaagatcagaccatgttcaagcggatcaagttcggtgatgcccatcgcatacgcgaccatggcgcctgcggcggagccacggcccggccccaccatcacgccgtgggccttcgcccagttgatgtagtcggccacgacgaggaagtagccgcagaactgcatctggcagatcacgccgcattcgtagtcggcctgccgcagcacttcgagcgacggcttgccgttgtaccggcgttccaggccttcctcgaccttcttcaggaacagcgacgtctcgtcccagccttccggacagtcgaattgcggcatgaacgcgccgtcttcatgatcgtcaaacatgacgttgcagcgttcggcgatctccaacgtgttgtcgcacgcttcgggaaggtctttgaacagttcgcgcatttcctcggcggatttgatgtagtagccggtgccgtcgaatttgaatcggcccggctcgtccagcgtggagccggagttgatgcacagcatggcgtcctgcgcgccggcgtcttcggcacgcgtgtaatgggaatcgttggtggccagcagcggcgcgttgagcttttttgcgatgtcgagcagcccgtcggtcacttgcttttcgattttcaggccgtggtccatgaattcgatgtagaaattatcgcggccgaaaatgtcttggaattcgccggcggcacgcaacgcgtcatcgaactggcccaggcgcagacgagtctggatgatgcccgacgggcagccggacgaggcgatgatgcctttcgaatatttggcgaggatttccttatccatacgcggatagcgcatgactcggccttcaaggttcgcgtcggtggaggctttcatgaggttgacgaggccttcgtcgttttctgcccacatggtcaggtgggtgatgacaccgccgccggacacatcatccgggttacggcggcgatgcagcggatccagatccggattccagttggtgtcccagctcacacgggtggggtcctgacgtgcggtttccggcgtcacataggcttcgatgccgatgatcggcttgatgccggcgttgaccgcggcgctccacatctcatacgcgccatgcatgttgccgtggtcggtgatgccgacggccggcatgcccagttccttggcgcgcttgaccagatccggtattttcgatgcgccgtcgagcagcgaataatgcgtgtgattatgcagttgcacgaaatttgcggaagtagccatgcgttccaatttagctgggcttcatgacggcgtggagtcgtttctggccgtccggccacacttttatagggactggtcggcgtgccgtgcgcgcatcacgtcaagcgcatgctgcaggtcggcgggatagtgcgatttcaccgtggtccacacgtgcgtacgcggatggcggaattccaattgcatggcgtgcagccattgccgttcaaggccaagcgcctcgctcagctgcggattcgcgccgtacatggcgtcccccgccaacggatgcccgatggatgagaaatgcacgcggatctgatgggtgcggccggtttccaggttcacggatacgagcgtggcttcgccgaaacgttccatcacgtcccaatgcgtgatggcctctttgccggccggtgtcacgcagaagcggaagtcggagactttggcgcgtccgatcggcgcttcgatggtggctttgtcttctttgagattgccctgcacgagtgcgtgatatgttttgacgacctcatgttcggcgaactgccggcgcatctccacgtacgcaagatcggacttgcatacgagcatcagtcccgatgtgcccacgtcgagtcgtgacacgatgccttgacggcctgccgcgccatatgacgtgatgtgcactcccctgtcgatcaggctgccaagcaccgtcggaccggtccatccgacggatgcgtgcgcggcgacgccgaccggcttgtccaccacgaccacatcgtcgtcctcatagacgacggccatgtcatgggcgatcggttccggttcggaccgttcctcgacgatgtcgaattctacggtttcgcctgcctgcagggtcgacgatttggaaatgtccctgccgagcacgcgcgcctgtccgctttcgatgaggtcggccgccttggcccgggaaatgccaagcattttggcgaccgcgacgtcgaatcgtttgccgacgagcgcgtcgggagcgggtacgagacggctcatgctgctttcgccccgtcgtcggttgcgttcgcatcatcaccaagcgtcttgccgttggcctcgtcaaggtccttttggctgaacggttccccgaggaacagcagcaacaccgccgcaacgcccgcgagcatgaggaagatgtccgccacgttgccgatggaccatccgtagttcaggaaatccacgaccttgccgttgaggaacccttccgcatagatgacgcggtcgatgaggttgccgaacgctcctgcgaaggcgaaggcgaacagcaccgtccatttcatggaaatggtgcggacggcaagtacgaccaacgccacgcaggccgccatcgccagcagggaaatcagccacgtcatgccggagcccatgccgagcgaggcgcctggattacgcaccaatgtcaacgaaagcaggccgggaatcacgcgtatggtacggccatcggccaatgcggacaaagcccacatcttggtgagctggtcaattgcgatcgccgcgatcgcaatacacgcaaagacggccacgcggtcgcgcagccgtctttgatcattcttcatgatgtcagacacaggctaatctcagtcgttgttgtcctgagggtcctggtcgtagttgttcgtatcggacacctggttgacgagctggccgaggaagtcggtgagtcgtgcacggtattcggtttcgaactgcttgaggcccttgatgttgccttcgatgaccttggtctgggtctcgaggttgtcgcggacctgctgggcgtagtcgtcggcagcggtacgggtcttcgaatcgtagtcgaaggcgcgcttctgcacttcggcttcgtagttgtcggcctcggtgtgcttgtcggagaagtacgtgtcggcgtcctgggtcttctgagccaggtagccgtcgccctcttcctgcttctgcgcgaagtaggcgtcgccttcctgctgcttctgctccagataagcgtcgccatcctgctgcttgccggccagataggcattgccttcctcggtcttctgcgcaaggtaggcgtcgccctcctcggtcttctggttcaggtacgcatcgccatcctgctgcttctgtgccagataggcatcgccatcctgggtcttgccggacaggtagttgtcggcgttggcgcgggtgtcggtggagtactggtcagcctcggaacgagtgcggttggagtagtcgttggcgctgccgatgatctcttcgtacttgcgctggctttcctcggtgatctccttggccttggccttgcccttgtcgacgtactggtcgtgcagctgcatggccagcgtcagcatggcggtggcgcgctccggctcggtattggcgcttgccgcggcacctgcgatcttctgcaggctgccggtttcggtgctcggctcggacttggcgacctgttcgcgcagctgtgcctcgcgaatctgggaatccttcagctgctgggcaagctgctgaatctgcatggcctgctgcttcacctgggcatcctgctgctgggactgggcagcatgctcctgagtgagctgctgggcctgagcgacctggtcctgcgcttcctgaagctttgcggtgagctgatcgatctgctccttctgacgctgagccacgaccacctgctcctgggccgatgccagctgacgggacaggtcctcggtctgtgcgcggaacgtgtcacgctcgtgctgcacggcggtaagctgctcgccaaggtcggcctgaccggccgcttcggctgcctgggcggtgagctgatcgacctgcgcggacagacgatcgatctgccccttgagctgctcgttctgggaagacagcgcacgattgctttcctctgcctcggaaagcttggcggccgcggcctgagcggcctgagcggcctggtctcccgcaccagctgcctgctcggaggcggacttcagcgtcgcgttctcctgctgcagggactggatctgagcattcaactcggaaatcttggaattgagtcctgcgacatctgggccaagagactgcgtggcctgtccgccggcaactgcctgcttgccaagggcttccaccgtctcggttacctgatcgaggaagtcatcgacttcatcgacgtcatagccttccttgaaccttacggtctggaaagtatgctccctaatatctttcggcgtcaacagagccataaatccttacacctcgctttgggcttgatgccttactgttgttgctttcagtgttcgactctagcacgaaaccatagatattttgcggaaaaacggttttttagaggtgctaaataaggaaatcaatgaccacaagaacgaaataaagcacaagatacgcgacgtcaaaatagatcggtccgagcggaacgggacgaatatactgccgcaaccaccttaacggcggctccgtcagctggtagatggcgtcgaacaacgaggccacgattccgcttggccgccacgtcggcgacaatgccaacacccagtcgagaatcatgcggacgaacagcaccaggatataggcgttgaccagaaaatggacgacgctaccaattatcgagagaatcacgttgccactgtatcaagcgcgcataacaaaatgcccccgctttcagtgggggcataatcgtctgatttgtgcttgctctgtgctacacggctcagtcggcgaacaggtcgtgggccggacccttgtcttcaggctcctcgaccttgatgttcacttgggccgggctcagcaggaacacgcgcggagtgacgcgttcgatggagccgcgcacgccgaacaccacaccggcggagaagtcgacgatgcggtatgccacggcttcggccacacctgtcaggttcagcaccaccggaatgccgtcacgaatggcgcgaccgaccatctgcgcatcgtcataggtcttcggatggatggtggtgatgcgactcactctaccccctggaacgggttggactgctcacgcggagcggacggcgtggaagcggaagccgaagaggaaggcatcggggtgacggaatgatccgaatcgaacgaggtctcgccggtgtcgacgtcatcctcgaaatcatcctcaccctcggcgacgtcggacattcccaagtacgacatcgcgttcttcatgaaacctgccatgtatgttcctttcgcgtctacgcgttgactttagcgcaggaaatccggaatatcgaggtcgcccggatcgttagccgaaaccacttcatgctcggtggtctggtcgaacgaggcgacgttctggtccggagtggacggaatgtagctggacagcggctgcacctgcggcaccgccggagtctgcaccggctgcggctgctgggcgggagcctgcacgccggcggacaacgcggacagcggtaccgtgtttcccttggccgcggccggcttttcttcggccggctggtcgggcttcttagaattggcatcgaaacctgccgcgatgacggtgacacgcacctcgtcgccgtaggcgtcgtccagggacaggccccagatgatctgcgcttccggatggatggccttctgcaccagcgcgaccgcggctgcggcttcctgcagcttcaggtcggtcggaccggcgatgttgatcagtgcgccatgcgcaccctcgatgctttcctccagcagcggcgagctgatggcgatttccgcggcctgcgtggcgcggtcctctccccgagcggaaccgatgccgaacagcgcggtgccggcaccacgcagaatcgcgttgacatcgttgaaatcaacgtggatgtacgaattcgaggtaatcaggtcggtgatgccctgcacgccggccagcagtgcggtgtcggcggtcttgaacgcgtcgacgatgccaatggtgcggtcggacagttccagcagtcggtcgttcggaatgacgatcagcgcgtcgacttccttgcgcaggttctcgatgccgagcgcggcggaagcggaacgctgcggaccttcgaagctgaacggacgggtcaccacggcgatggtcagcgcgccctgctggtgggccgcacgtgccacgatcgggctggcgccggttccggtgccaccgccctcaccgcaggtgacgaacaccatgtcggagcccttaagcgcctcttcgatgtcggactggtgatcctgcgccgccttggcacccttttccgggtcggcgccagcgcccagaccacggctggaggcatcgttcagcgagatcttgacatcggcgtcggatcgcagcagatcctttgcatcagtgttgatcgcaataaattcgacgctttgaagaccctccgcaatcatgcgattgacagcgttgcctccggctccaccgacaccgacgaccttgatgttggtcttgtcgttgaaattgtcagtctgggcaatctcgctcaccattgtctcctgttcactcacgtatatgaacaactctatcgcaatcgcgccgatgatacgcgcacttttccaggcgtgtaccaccgttttttcacttttttgctgtcagcatgttcattctgcctgcgttgaccccttcagtcatttgtacacggctcttcgaacatgcgtgacgggctttagtagctggcatccatcgggtcatccccgaacagcgcctcacgctcctcgtgcgtggtttcccgggattccaaccatccgtaaggcagatgcacctttttggcgaagcgcacgcgcccccttggcttgtcggcgatgcgttctgggaaccgaatgttcgggtcgagtctgcctatctcgcgccggacatcctcaagattttcacattccatgaacgcacggcgtgtggaaccgcccacggggaagcccttcagataccacgcgacgtgcttgcgcaggtcatgcacggccatccgctcgtcaccatcatagaattcggtcagcagttcggcatgccgttcgatcacgcggcacacgtcgcccagcgtggggtcgacgcgctcgtcactgccggcgaacgcgttcttgatgtcggcgaacaaccatggacggccttggcagccgcggccgatcgcaacacccgcgcaaccggtttcggcgaccatcgccaacgcgtcgttggcaccccaaatatccccgttgccgaagacgggaatatcaagctcggaaaccagctcgccaatgcgggaccaatcggaatgcccaccgtaatattcggcggtggtgcgcgcgtgcagggtgacggccttgcagccttcctcctgcgcgatgtgcccggcttcgaggaacgtctcgtgttcatggtcgatgccgacgcggattttggccgtgactggtacgttggccgcgtcgcacaccttgaccacgcgttggatgatctcacggaacaggtccgtcttccatggcagcgcggatccgccgccacgacgcgtcaccttgggcaccgggcagccgaagttgaggtcgacatggtcggccatgttctcgtcgatgacgattttcgcggcctgctccacaatcgagggattgacgccgtacagctgcagcgaacgaatcttctcgctgggtgcgaaacggcataggcgcagggctttcggattgcgggccaccaatgcgcgcgcggtgatcatttccgccacgtacagaccgtcgggaccgtagctttcgcagatcacgcggaacggccagttggtgacgcccgccataggcgaaagcaccaccggcgtttcgacgtgcaccggacccagatcaacgggctttataacgggaggaaccgacggccgttccgcgtcggtacgcgggtcgagcacgtcggattcctcgtaggcattcacaatgctatctggcataggtcagacttgttccgttcgatatgaccgattcggggcgatcagtacaggccaccggcttcggcgatcttgacggactcaggccaagcctcgccgcccatttcgaccggcatctgcggcacgctgacgcgcttctcgccgatgcgctcggcgatgtagtcggccaccttgtcgaggctgacgcgctcctgctgcatggtgtcgcgttcacggatggtgacggcctggtcgtcgagggtgtcgaagtcgacggtgacgcacagcggggtgccgatctcgtcctcacggcggtagcgacggccaatcgcgccggcctcgtcgtagtcgatcatccactcgttctggcgcaggtcggcggcgagcttctgggccacggactgcaggtccggcttcttgctcagcggcagcacggcggccttgaccggagccagacgcgggtcgagatgcagcacggtgcgcttgtccacaccgcccttggtgttcggagcctcgtccacgtcataggcgtcgacgaggaagcacatgagggagcgggtcaggccggcggccggctcaatgacatacggcacgtacttttcaccggtggcctggttgaagtagctcaggtcctcgccggagtgctccgcgtgcgcggacaggtcgaagtcggtacggttggcgatgccttcgagctcgccccaatcggagccctggaagccgaacttgtattcgatgtcgacagtgcgcttcgaatagtgggccagcttctccttcggatgctcgtagtggcgcaggttctccggcttgacgccgaggtcgaggtaccactgggtgcgggcgtcgatccagtactggtgccaggcttcgtcctcgccgggcttgacgaagaactccatctccatctgctcgaactcacgggtacggaagatgaagttgcctggcgtgatctcgttacggaaggacttgcccatgttggcgatgccgaacggcggcttcttgcgggaagaggtcatcacgttcttgaagtccacgaagatgccctgcgcggtttccggacgcagatagtgcagggagttctcgtcctcgaccgggccgaggtgggtgcgcagcatcatgttgaagtcgcgcggttcggtccacttgccgcgggttccgcaatccgggcacacgatgtcggccatgccgttctccggcagcttgtctccatgcttctcggcataggattcctcaagcttgtcggaacgctggcgcttgtggcagttaaggcattccaccagcggatcgttgaagacggccacgtggccagaagccacccacacgggggtcggcaggatgatggaggtgtccacgcccaccacgtcgccacgggtgacgaccatggagcgccaccattcgcgcttgatattgtccttcaacgccacgccgagcggaccgtaatcccatgcggaacgggttccgccgtagatttcaccggcgggaaaaacaaagccacgacgcttggcgagggatacgacttcatcgagtttggatacagccacaatgcaccttctggattgaatggtttggggtctttacaaccgcacagcctaccgtcacatgctgacagcccagccgccgtcccgcatgcgcacgggagaccatgcggcaagcgatcggaacggcggcagacgatgcattacacaaagtaggctggagatatgctgtaccacaacccgaattcgcgcggccggcgaaatgtcttgcgcatcgtgggcgtgcttgtcgtgcttgcggtcatcgccagcgtcgccaatttcctccgcaccaccaccagcgacgcggtcagtaacgtcaagccgcagatcgaaacgatgcaggacatccggcagaccgcgcaggacagcatcacgttcgcgcagagcctggatgatccggatcaattcgccgcacacatcgaaaccgtgcaacagtatatggacgattacgaccggcttgccgacaccaagcagatcaagtatctgctgtcggacaatccgcaggaacgcatcatcgggctgttgtaccgcgaccagcagcgcaccatcatcgacagcatgcgtgtggcggcccataatctcgacgcacagaccaaggagctgctcagcgcggtcgacgcggccatggcggacgatttcagccagcatgcggcgcaatggctgctgcaggtggacgatccgacgcaggtgaacgagctcatcgaccgatacggcaaacagcgtgagtattcgtcgatgcgggaaatgctcaccggactggaatcattgcacaagctgcgctcggacgtgaagcagcaggtctcgtccgcggtcagcaatctgcacagcgaggaagcctcggcggctgcgatcgccgtacctgagcgcaacggcgatctcgatccggccggatggtacacgctcgccacgaacgtggtatcaacgatgggcgtgcagatcgagcagaccatggaattcaactgcggcggccagtcaggtgagaatccgaacggattcgtggcggcctattactgccagatgcccgaccgcacgcagcgggatgtcgtgcatatcctcaccacgcacccaggttggacgcagaccgcgcgaagcccttggctggtggacatggtcaagcacgagctctcgcaccgttcgatcatggtctcctgcggcaccacccaaccgacgatcgcggccgaccgcaccgaggcggtgacgaattcctattcggtgctgtttttcggggccgatcgcaaccgcatcgccgaccagcagcagggcgtcgccgaatacgcgatggatgcgcacagcgaccagctggccacagccatccacgatggcaattgcgggtgatgtgagtcggtttccgcttggcgactattgcacatccttgaattcgatagtccagttcttcgcgtcgtcgccaagcacattgcgcacatactgctctagaatagtccacgcgcgagcttcggcttgggcaagcaacgccgaatcggttttcgcctgcttcagcatgctttgctgggccttatcaaacatttccgttttctcttcggcggtaatcgaagtggcgaaaccagtgctcaccagcggtttgctgaacgacttctcatttacgtccggatcatccaacacgtgagctggaggcacggtaatgattactttatgaccgttggcatctggactaattgttactttatcggcatcaataccgtacttcacgatgccactgtattccatccacatacgtttgtagccattattgaaaaaccacgatccctcatgactgagcttggccgtgttgtggtaataacattttaatgtggccatctgtgcgatatacgtggcattcgagaaagttgggatagcttctttcttttcctcgccgcaccctacagcagaacatgcaagcgtagcaacacataatgcggcaatcgcacgtttcatggaacgattattcgtcagcatgcgcggtctccttagtgagctttacggtctcggccttctgcaatttgtatccttttgcttccacgagatccttggtcaacgcatccacagtttgttcaagattgctggcagcaatagaaataatgtctccgtttgtcttggtttcctgttgcgcatcctgcttgcaaagcttgatcacctcatcaatttcaacggacggattgttctcgaaaaagtcgaggctgccgctatcaaccacgacgtccccaatagtcggcttcggcagaatcggagtgacggtcttcgcggtatcgtccacttcgaacgtgatatcgctcatcttgacgccagcagtcaccgtcgcctcatatgcaacatgccacttgtccttaccagcattgtctttctttacagcaacaccgccataatggaatttcgcggtcgatagatcgtcgatattcacagccgcctgcaactggctttccacactgatggtagattcggtccttgcattgtcaaaaacaggtttaacgacaccgttccacacaaacaggacaactgcaacagtgacaattgccgcaacagcgccaaacaacaccttacgcaacttttttgcactgagatcgccgaacaacctatcgcaaagaccgccccgcctccttcgactcccgtcatttctcgccaacgcacattcctttcacggttctcttccgtcaacaattctatccccgcacgcaaatacatagggacgtcacaaacgtctcaggaaataatacggggaagcccatctcgtggaatgattatcggaaataatccgatatttgatgacgtttcatcataatgaaaatgcccgccatgtcttcctgcaaggcaggacagcacacataccacttactacttccacgccggcttaaacattcggatgggatactcaaaagagcgtggaagaggcgacctgctattcagcacacgaaatgctgcagccgaacgtacaatggtcgccccatgtcttcgctattcggcgataccgtttttggactaaatcagccaatcggtcacgtccttctcggaaacagattccgagaaacggtgcccggtaagccatgtaccgctgcctgccattttctggagcgtggatgcactgttgccgatatcggagctggcggaagtgcagaacggaatgatcgtcttacctgcgaaatcgttggatttgacggaatcgttcaccagccaaacaggtgccatccaccaaatcgggaagcccagatacacagtgctgccggcaccgaccatgtcatggaccggaatcattcgcggccggcacgttccttgacataaccgacgaagcggtcgaccgcctcaggggtgtcgtggcgaaagaacatgctggtcttggtgtcaaggcccgcgatggttgccatctcgctgtcggagagccggaaatcgaaaatgttcaggttttcttccatgcgctccttgtgcgtggacttgggcagagcaacgatgtcgcgctgggtgagccaacgcaggatcacctgcgcgacggacttgccatgcgcctcgccgatcctggccagggtgggattggagaacatgttctgcatgccctccccgaacggagcccatgcttcctgagccacgccccgcttgaccatgttcttgcgagcttcgatctgctggttgagcggattagtctcgacctgatcgaccatcggggcgatctcattgaaggcgaccatatcggccagacgatccggatagaagttactcacgccgatggcgcggatcacgccgtccttgtagagcttttcgagtgcacgccacgcgccgtaggtatcggaaaacggctggtgcagtaacaccagatcgagatagtcggtgccaagcttcttcaaggacacatcgacggacctcagcgtgttctcatagccgtaattgctgatccagatcttggtagtgaggaacagatccttacgatcgataccggaatccttgattccttggccgacttcggcctcgttgaagtacgactgtgcggtgtcgatatggcggtacccggtctcgatggcctcgcgcacgcagcgaggagcatcgtccttgctgatctggaagacgccgtatccgatcttcggaatctcaataccgttggcaagtttcacgtattccactgtttttccttccataaattcgtcggtattcagtgccggcatgtatgccgttctgacccccacgataaaatccggtagctgctaccggtcaaattacggcacgccggtactatctaccggtattaataaccggaaatgtgacatgataggtacaaacaaaaagaacaatgcgcctcaagcccgaccccatccggcggcacccgccgaacgtcctgccgcgcagcgtccgaaaggagccacgtatggcaatcacggcagtgccactccataagaacatgaaaacctatacgatgaagcaggcctgcaaactaaccggcatgaattacgaagcattgaagttctattgcaattcaggactcgtgcccggtctcaaacgagaccagaacaaccgacgcgtcttcgacgagcgatgcatcgcatggatcaacggcctgacatgcctcaaacgctgcggtctgggcatcaaggagatgcggcactacacgcaactctgtcttaaaggtgagtcatcgataccggaacgtcaggaaatccttgccgaaaaacgcgagcatctggagacgcaactggaggaactgcgtaaagccatcgcatacatcgatgaaaaacagcgcttctacgccgacgtgactgccggcaggacggcatactgcagcaacgtcatcgacacgacgcaaagcgactgactgcgttccgtaggtgatttttgcgttccgtaggcggtcagcttcgaatccggacacgagcaaacgcctaattccaggcatctcgccgatgcttatccggcagcaaccacctacggaagcccaaaatcacctacggaatcgcgcctgtcaagggacgcagatagattaaccactgttgtaaacatgcgggggtgcttgatgtccaagtccatcaagctgagataggcatgaacgcctgaccctttgaacctgttggttaggaccaacgtagggagcagatcatgagcgatgacccatccaccaatgacgcactcggcacattgcgtgccgccatcaaacaagccgtcacggacgtgcgcgggcagacaccattggcgcagtcgttcaccaatttcgtaaccatcaatctggtggccaacgcgcagctcgccgcgggcggcaccgcggccatgagctatctgccggatgacgtgatcgccaccgccgaaatcgcaggatccaattacatcaacgtgggaacgttgctgccgttcttcaagaacgcgctgcccgagatcgcgcgcaagctacatgagaacggcaaaacctgggtgctcgatccggtcgcggccggcatcggcgagacacgcaccgccatcctcgaatcgttccgtgacgttccgccgaccatcgtgcgcggcaacgccagcgagatcatcgcgctcgacgcgatgtggggactcgccgacgccgacagcaccacgcccgcgacccgtcccgccggcgtggaagccgtcgatgaggtcgatgccgcggtcgacgcggccaagcgtctcgcccgccatctggcgaagcgctcccccgttggagcaggcgcggtcgcggtgtccggcgcggttgatctggtgaccgacggcgagcgcacgttccgcctgcccggaggcagcgcgatgatgacgaagatcaccggcgccggctgttcgctcggcggcgtgaccgcaacgtatcttgccgtggccgagccgctggtcgccgcccttgccgcgtcgctgctgtatgatcgtgcgtccgaaatcgccgaagtcaaatccgatggccccggttcgttccaggtggcgctgctcgacgcgctgtggaacgtcaccgccgaccaggtggccgcgtccgacatcatcgaaaccaactgaccgcaacgttccgtggatggtttcgcaccatcgcaatcgtatatacggaatatatacgttcagtgcggtgcgacggaaaataaacggaaaataacaagacttcttctggagcacttacccaaagaacaacaaaggggagaccaatgaataattatccattcgcctcgatgcgcgactgctttgatatgagcgcgtatttcgtggtcggtccgcaggattgcaagggccggccggtgacggatgtggtggatgacgcgttgcgtgggggcgcgacgttcatccaattgcgcgccaagaacgcggatgcgaaggatatcaccgaaatggcccgcgatatcgcgcaggtcatcaagaacagcggcaagtccgattccgtggcgtttgtgatcgacgaccgcgtggatgtggtgtggcaggcgcgcgacaagggcatcaaggtggatggcgtgcatatcggccagaccgatatggaaccgcaggaggctcgcgcgctgctcggcgaggatgccatcgtgggcctgtccgccgagaccgaaagtctggtgaagcttatcaacgagctgccgagcggctgcatcgactacatcggcgccggcccgctacatgtgtccaccaccaagccggaggcttccgtgggcggcaacgacggttccgggcacacgcttgacgaggaacagatcaacgcgatttgcgcggcgagcgagttcccggtagtggtcggcggcggcgtacatgccgacgatatggagatgctggcccgttcgaaggcggccggctggttcgtggtgtccgcgatcgccggtgccgacgatccggaagcggccacccgcgaaatggtgacgcgctggaaggcggtgcgcggcgacgcgaagcacggctatgcgccgcgtgtgaagtagtccgtcgtacaggaaatcgacaagcccgctgagatgagcgagaagttccgcaaaggtggttctacactgtatcagtgagctcagtgaagataatcaatgaatcagtgagcctaataaggagagttaccatgaccagcacattgccaccggtattgagcatcgcaggatcggattcgtccggcggtgccggcattcaggcggatttgaagaccatgctcgccaacggcgtgttcggcatgaccgcgatcgcggcgctgaccgcgcagaacaccaccggcgtgacgatggtcaccaacactcccccggaaatgcttgcggcgcagatcgacgcggtgttcgaagacattccgccggtggcggtgaagattggcatggtgtccagcgccgagctcatcaccgtgatcgccgaccgtctgaccgcgcacaacgcgaagaacgtggtgctcgacccggtgatggtggccacgtccggcgcgaagctcatcgaggatgatgccatcgcggcgctgacgtccaaactgttcccgctggccactgtgatcacgccgaacatgccggagacccaggtactgtgcgacttggccgtagagcagggtgcgggcgcaatcgactatgagaacggcgaatccatctccaccgagaacgacatggtgaccgcaggtcatctgctcgccggccatttcggctgcgcggtgctcgtcaagggcggccacggcacgcatgacgcgagtgacgtgcttgtcgagccggatggcaagatcacctggttccgttcccgtcgcatcaacaacccgaacacgcacggcaccggctgcacactgtcttccgccatcgccagccatttggctcttggcgaggcgctgccgacggccgtcgaccatgccaagctgtacctgaccggcgctttggaagcgcagctcgatcttggacatggttccggtccgatggaccacgcgtggaagtggcgttgagccaagccacgcgaaccacggcaaccgttggaacagtacaacaagtaatcgcacgaaaacacacgagacaacgctgagaaaggtaatcatgacgctcgatcgcaacgcagaaaagcaggaagtgcccgtcaatccggaaaccggcaaaccgtatatcaacacgcttgccgcagtagccatctcccccgccggcgccagcccggagaagtccacgtacgtggcgcaggccgtggatgtgatccgtgaatccggcctgccgaacgagacgaacgccatgttcaccaacatcgaaggagacatcgacgatgtgctcaaggtgatccgcgacgctaccatgaagctcgccggccagggataccgcaccgacgtggtgatccgtctcgacatccgccccggtttcgaaggacagatccacgccaagcaggaactggtaaacgagattctgtcgaaataaccccctttacagtggtgaaacgaaaccattccatgtaaaaaagcgcgctttttcttggcaaaagcgcgcttttcgcgtttatttgggtatagtgttgcgattatgacgacaatgaaggaaatcgccgaacaaacgggggtatccatctccactgtatccctggtgctcaacggacgcgacgaaggcagggtaaatcccgcgctcgccaaactcgtacgcaacaaagcgaccgagctcgggtacaagatcaatccgttggcgcgaagcctgcgtaccaacaaaacccgaatcctcggcttcatcagcgaggaagttgccaccacaccatacgcaggcggcatcattctgggcgcgcaggatgcggccagtgcctacggctacatgctgttcacagtcagcaccgacggcaaggcgagcgaggagaacgaaatcgccacgttgaaacgatacggcgtggatggattcttctattcgaagatgtcgaaccgcatcgcgcatgtgcctgaatcgttgagcgattatcccgtggtgatggtggacgccaccgattatgagaacaaggttcccagcgtcgagcccgacgagttcatgatcgctatgacgccacgatacggttgctgcaggccgattgcaaacgtatcgcgtacgtgggttgcgcggaaaacatgatcgcgcaggacggtcgtcttgccggctactgcaccgcgttgcaggaggccggacgtgcgttcaacccatcgctggtatgcaacgtaatgaacgacggtccagctttacgcgccgtgaacaagttgttcgacgacgagcatccggacggcttcttctgcttcaatgatgcgcgcgcctggtatgtgtacgaatgcgcggcaagaagagggcttacggtaggcaaggatatttccgtggtcggcgtggacaaccaccgcgtgttcgcagagacacttgaaccgcagctgaccaccgtcgaactgccacattacgaaatgggctattggtcagcctgcaagctgatttccatgattgaaggcaaggatgtggataccagttcatgtccatccgccagagcttccctgccgccgcttgatgcgccgattccggcgaagatccactgcgcattgttggaaaaagattccgtcatatcctgatttttctgtttttacaacgattcaaatgcttacgattgttcgcacagccattttctatacatgaaaattgtgcgtttgttcacgacacgccgaataaagcaatcgtgccaacagtccgccagcagttgattcaggcttaatttcaactatccgcaaatccttacaaacgtttgacgtcaaacgattgacgtcaaacgattgacgaagcagttgcaacatgctatcttgaagccatgttcgcttttcggcacggcagctgaaatcagagcaggcgcaagccaaaacaacatcggaagcgatcgctgccgcgcggcagcggcagcgcgaagagaaaaagagaatcaaaatggcaagcaaaacacgttctgtatggaagaatccttcctatctgcagagctccttcggcattttcatgttcttctgttcctggggcatctggtggtccttcttctcccgctggctcactgacccgacccacggtctgggcatgagctccgcggaacagggccagatctactccatcaactccttggccaccctggtcatcatgttcgtttacggcaccattcaggaccagctgggcattaagcgtaagctcgtgatcttcatctctgcggtcgctgcatgcgttggcccgttcgtgcagttcgtgtaccagccgatgctgaccgccggcggcaccacccgattcatcggcgtgcttctcggctccatcgtgctgtccgcaggcttcatggccggctgctccctgttcgaagccatcaccgaacgttactcccgtaagttcggcttcgaatacggccagtcccgcgcttggggctccttcggctacgctgtcgtggcactgtgcgcaggcttcctgttcaacatcaacccgctgctgaacttctgggttggttccatctgcggccccagcatgctgtgcgtctatgctttctgggttccggccgagcagaaggaagaactcaagaaggaagctgatccgaacgcaactccgaccaacccgtccttcaaggaaatggtctccgtcctgaagatgccgaccctgtgggtgctcatcgtcttcatgctgttcaccaacaccttctacaccgtgttcgatcagcagatgttcccgaactactacgcctccctcttcccgaccaccgaaatcggcaacgccacctacggcaccctgaactccttccaggtgttccttgagtccgccatgatgggcgtcgtcccgatcatcatgaagaagatcggcgtgcgtaactccctgctgctcggcgccaccgtgatgttcgcccgtatcggtctgtgcggcgtgttccatgacccggtctccgtctccatcgtcaagctgttccactccatcgaggtaccgctgttctgcctgccggcgttccgctacttcaccctgcacttcgacacgaagctgtctgccaccctgtacatggttggtttccagatcgcttcccaggtcggccaggtgattttctccaccccgatgggtgctctgcatgatgccatgggcgaccgtccgaccttcttcaccatctctgccatcgtgtttgcggctctggtctacggcttcttcgtcatcaagaaggatgatcaggaagtcggcggcgatccgttctacactgacaagcagctcaaggccatgaaggccgctgatgcggaagtgaaggcctgagtctcagcccgtactaagtcggcgtacggcgtcgatggtggtcgcaacctacatcccttctcccgcgatcatcatcggtaccgtacgcatcataacaacaatcgtggtgtccgaagcgtttccctttttccgctttgggcaccatcttcaaaaagctttttatccaacaattcataacccagattcagaaaggcattcaacgatgactggctttactccggacgcacctgtccttcacgaaatcaagaaccacagcgaggaactcaccaaggcagaggccggtgtcgcggccttcgcagccaagcgtaacaaccgctggtatccgaagttccacatcgcatccaatggcggttggatcaacgatccgaacggcctgtgcttctacaagggccgttggcacgtcttctaccagctgcacccgtatggcacccagtggggtccgatgcattggggtcacgtctcctccgccgatatggtcaattggaagcgtgagccgattatgttcgccccgtctctggaagaagaaaaggacggcgtcttctctggctccgcagtgatcggcgacgatggcaagctcaagttctactacaccggccaccgttgggccaacggcaaggacaacaccggcggcgactggcaggtacagatgctcgccgaaccagacaacgatgagctgaccagcgccactaagcgcggtatggtcattgattgcccgaccgacaaggtgaaccaccactaccgcgacccgaaggtctggaagaccggcgacaagtggtacatgaccttcggtgtctcctctgccgagaagcgcggccagatgtggctgttctcctccgacgacatggtcaagtggacctatgagcaggtgctgttcgagcatccggattcgaacgtgtttatgcttgagtgcccggacttcttcccgatcaaggacgtcgaaggcaacgagaagtgggttatcggcttctccgccatgggtgccaagccgtccggcttcatgaaccgcaacgtcaacaacgccggctacatgatcggcacttggactccgggtgagcagttcaagccggaaaccgagttccgtctgtgggattgcggccacaattactacgcgccgcagtcgttcaacgacggcaagcgtcagatcgtctacggttggatgagcccgttcgtcgagccgattccgatgcaggacgacggctggtgcggcaacctcaccctgccgcgtgagatcacgctgggcgccgacggcgacctgcacaccgcgccggtggccgaaatggaaggcctgcgcgaggataccgtcgatttcggtgcgatcgatctggacgtcagcggcgagaagaccattgtggacgatgccgaagccgtggaaatcgaaatgaccatcgacctggccaactccaccgccgagcgtgccggcctgcgtgtccacgccaccgaggatggcgcctacacgtccgttgcgtatgacgatcagatcggccgcgtggtggtcgaccgtcaggccaacgctcagggcgatcgcggctaccgtacggcaccgctgtccgaagccgaacttgccgccggcgaactcaagctgcgcgtgtacgtggaccgtggctgcgtggaggtgtacgtcaacgacggccgtcaggtgctcagctcgtacagctacgcgtccgaaggtccgcgcgccatcaagctcgtggccgaatccggcacgctcaaggtcaagtccctggtgcttcaccacatgaagtccatcggactggaatgatagacgtctgtcatggttgacaggcaaacgaccataaggcagtagcaaggggtatatgggaaggcctccgcatcggaagggtgcggaggcctttctatatctgtctctctatatctaaagtgatatctgggatggtatccaacgcacgttatctctcgttactgccgtacttgctgtgcgggtttgcctacgttccgccccaccgtctatactggcgagccggtaacaatcttttctggccgattggcgggcaggctcctcaccttactgatttcccgcagtcggtcacgtgcgcgtccactttgacgcagaaagcaaggtgaacgatggcggaatcgcacgttcaacacaaactactcggtatggcgaagcgtcgtattccaacgctgatcgccgtcatcacactgcttgtcgtatgggaggcatgggtgcgattggggcacgtgccatccacgatgatcgccgcccccagcgaaatcgcgcaggcaaccgtcgaaacctggcccacactatggccggcgacgcaggtcacgctactggaaggcaccgtcggattcctgctggccgtggcatgcggcatcttgatcgggattctgctgtattgctcccgtgttgcgaacgccgcactgttcccactgctgtctgccgcgcagacgatgccgttgatttcgatcgcaccgctgtttctgatctggttcggtttcgaagtttccggcaaaatcgtgattgtggccgtattcggcttgtttccgatcgccgtgcagacggttcgcgggcttgaggcggtgccgcagttctattccgatgtggcgttgacatgcggcgcgacccgcgcatggacgctgtggcatgtgaagcttcgcgtcgccgcacggcagatttacggcggcatccgcgtatccgccgcatacatcttcgccaccgccaccactgccgagtatctgggtgcgcgcaagggcctcggcatctggctgcaggcggcttacaattcgttccgcacgccgctgatcttctcggccacgctggtcatcatcgtcatcaccggcatactcatgtgcctcgtgaatctcagcgaacgcctgctgctcggcccagccgacgcggacgccgatccggacgcggaccagtgaaaacgcaacaatcaccattgcggccctcatcatcgtcatgcacacccgtataatgggactcgctgtttagccaatgtgtggcaaaccggcaatgttccacagcttcggcgtcaaacggtcaaccgggcggcggcaggcatcataaggaacgtcgggggcattggacgagcgggggccttagcccttcgtatcgttttctgcccgaaccccgcccgcagcgtcatccctagaaaacggtagagaagcaagattcaagggaaatcgcaaggtatgaagaagaccatcttcagcaaagcaatcgcaatcctcggctcgatcgccatgctcgtcggcgtggccgcatgcgggcaaagcaacgactccacgaaaaccgcggcggacggcaacggcctcaccaaggtgacgttcatgctttcgtgggcgcccgacaccaaccatatcggcgtgtatgtggcgaagaacaaaggctatttcaagcaggccggtcttgacgtggacatcgtggcggtggcgcaggccggcgcggagcaggccgtgaacaacggcatggcggatttcgcgctgtccaacctcaccaacgtgggcatttacacgcttaagggcgcgaaaatcaaacaggtcatgcaggtgcagcagaagccgagcgccatctggtgttcgctcgcgtcgaacaaggacatcaagtccccgaaggatttcgacggcaagaccttcgccacgttcggctccaacgaatccgacgcggtgatccgccgcatgattcagaccgacggcggcaagggcacgttcgacaaggtgaccgtcggcacgtccaccttccagacgctgtccagtggcaaagccgatttcggtggcttctacgccacgtgggagggcgtgcaggccgacatgtacggcccgaagctcaactgcttcagcgagcctgattacggcgtgccgggcaacgccgacgccatcggcatcatcaccaacaccaagaccatctcgtccaatccgaatctggtgcgaaagttcgtgcaggccaccaagaagggttatgagtacgcctacgcgcatcctggcgatgccgccggaatcctcgtcaaggaggctccggacgcgaatctgaagccggctttcgtcaagaagagcatgaagaccatcgtggacggtcaatattggggcgatccggccaaaatcaaggacggctcgtttactttcggtaccaacgatctgaagggcacgcaggaatatttcgacttccttgccaaagccgacacgtataccgattcgcatggcaaggtgattcaccaggctccgcagtcgaaggatctcgccaccgacgaattcctgaagtagcggattttgaaataacagctttcttaagaaacgaatcctgcttaagaaagcgaatattgaaataacggattcccctaagagaaagaccggccgatgacgctcacaccctccggcaaacgcaagatgattctcgatgtcgacaccggcatcgacgatgcgctggctttggcgtatctcgtctcgtttgacgacgtcgagatactgggcgtcatcggcacctatggcaacgtttcgactgacaccgccgtacgcaacacggcttatgtactggaacggttggggttccgggacgttccggtgatgtgcggctcgacgcgcccctcctgggcggccgcgttcattcccgacgccggctgcgcgcagttccacggcacggatggattgggcggattcggcccgtccgctgattgtgccgtcggacggcatacgtctgtttgtgacgattcgaacatccagacactcaatccggcacccaatgtgtccgattcgtcaggattggatgttcgagcgatgcgcgggctgatttccgttggcggatatgacgtgcacgaccttcacgccaatcccgcagccgactcgttttcgctttcgtttactgtccgcgatgccggcggcgacaacgattgtgaggaccgttcccactcccctgtcgctctgccggacggcgttcgattcctcatcgacgcggttcgcttctacggtagtgacgtcacggtggtggcgaccggcccgctgaccgacgtcgatgcggcgcttgccgcggcaccggatatcactagccggctccggctggtaatgatggggggaacgctgacgcaggaaggcaactgttgggatgcgaccgccgaaacgaacatcatccaggatccggaggccgccgaccgcgtgttccattccggtgcggatgtgacgatggccggactggacgtgacgcatcagtgcctgttggggtccgacgcgaccgtacagtggcgtcaggccgcatcgcaatcgcaggatggcgacgtgcggacgttccttgccgatatcgccgacttttccatcgcggccaatttcgccgcagacccccgactattcgcagccggcatgccattgcacgatccgctcgccgcagccgtagcggtggatccgagtttggtggaatgtttcgatctgccgatgaaggtcgaaacggagacaggcgattttcatggcacgcgcggccgcaccatcggcgatccggccggaatgattgacccgtcggcgccacgcgtgcatgtggcgctcaccgtggatcatgatcgtttcgtggctgatttcacgtggcgaatcgcgcaactggcaggcgattaaaagccgttttaggagcggaaaagaaaaagacccccgcgggggtctttttcttatttcttcacgtcctgcaattattgacggcctacggccggctcaacattaccctcgcggcatagccgctcgggcgtgaagctggaacagcccaccgggctgttccttatcgcttcacgcctccaaagcgacgatcgcggtgaatatagtggtcgatggagcgccacagcacatcacggccgcaatccgggaacagttccggcacgaagtcgagttccgcgtaggcggcttcccacggcaggaagttggacgtgcgctgctcgccggacgtgcggatcaccagatcgcaatcgggaatatccgggttgtacaggtgctcggcgatcatcttctccgtcacacgatcgccggagatcttgccgtcacgcacctcacgtgcgatggccgcgcaggcgtccgcgatttcggcgcggccaccgtagttcaggcagaacaccacgtcgatggtcttgttgttcttggttttctcctgcgccacttccagctcgtcgatgacggatttccacagcttcggacggcggccggaccagcgcacgcgcacgccccactcgttcatctgatcgacacgacggtggatgatgtcacgcgagaagcccataaggaaacgcacttcctgcggcgaacgcttccaattctccgtggagaacgtgtacagagacaggtagcgcacgcccgcttcgatggcgccggcgatggtgtcgaacaccaccggttcggccgcctgatggccgtcggtgcggatgagtccgcgctgctgggcccaacggccgttgccgtccatgatcacgccgacgtggcgcggaaccttgttctttggaaaatcgggaatgatcgacgggtcggaaaacggtgccgccggaatgtcaagggatttgtaatccacgttctcaaaagccatacccgctaatctagcaagcgcatggaacgaatcggccgttccaaatagtattcgccccattcttccactatttggtgggtttcccgttgaatcgacgcggacgccggaacaccgtccagctcccccaatcgccatcgacaagcgccgaaagccggcaaatcgcatcccacgacaccgcttccgattcgggggtatggtcggcggcgcacatcaggccgccggcgggaatcgaaaaataccaggacagcgcagacgaaatcggctcgccgcacaccacgcagacgcgcagacggggtgtccaaccagcgatcgccagtgcgcgcagcacgtacgaatcgccaatcgtggacggctcgtgcgcatgtttggcaagcgcgttcaacgcgcccaataccagccggtattgtgcgaccgcaggctccttttccgtggcgaccagcttgtcggcggtttcgcagatcacgttcgccgccgtatacgcttgaaaatcggcgcaaatcggccctgcatacgcggcgatcgattcggcttgggacacgacgtcgagcgaacgaccttccgcaatgagcagcgccacgcgcatgaacggttcgagtcggcctccgaaacgcgatttggtacggcgcacgcctttcgcgacggcgcgtactttgccatggtcacgtgtgagcaaggtgagtatgcggtcggcttcgccgagtttggcggtgcgcagcaccacgccttcgtcttgatacagcggcatcgcacctccttttcttgccgttcatcgcatcctgttatgcatacgctcgccgcacgtgcgcgttccgaaatacattcgccccgtcagtagatgaacagcccccagaacgcgaacaccagcaatacgcagaacatggcggccacggtcagccagaacatcacgcgtccgaaccgcgtggaagccagcaccggctgccgtccgctgacgatttcgccgatagcacccttacgtggcggccactgcgcgatgcctcgatgggttgcctcttcgatcagccgcatgaacacgcgggaccatgcccacaccacggcgacgcacacgatctggatcaccggccagctccaatacatcacgcccggattctccactggggcactgccccatgccagtttgaccacacccatgatcacatcgccaaggccggcgcagaacagcacgaacgtggccatagtggcgatagtcaacgtgaccagcgagtttttgaacccttgcgcaagccccagccgataccgtcgtccgtgggcacgcgcccagatcttacgcatcagcacggcgagccacagcacgcctgcggcaagcagcagcaccagcatgctggcatgcaacgcgaccaggtagatggtcaggccgcgattggctttgaggtccaatggcactgcgattgactggtacattctggtgccggccacgcgttcgctggtctgtttgagtccgtgcgtggtgccgacggcccagtcgaccacatcgtccacgtacgcgtcggcgaacggggttccggaattggcttcgtcgccgagcctcagcacatggttggcgatggggtacgtgcgtatggtgacgtcccagttgccggcctggtgagccagatcgacgattttctccgtgccttccacctgcgcggtcatgacgtctttcgtgccatacgccaccaatgtcggaatggcatacgctttcggcgtcaacgtgtcgatgtcgaggttggtgagtccgaacagggacgcgtcgatattgaatacgcggcggacgatcgactggtagccgtcatgcgcgccgacgagcgcgaagtcctgtgcggcgaggaagcccagcgaataccgcggctcgtagaccatcggactgagcagcacctgaaaagcgacgtccggatcgcgctgcagcagatacgatgagatccatgtgctttcggaagtggcgtagatgcccactttggaggcgtccaccgtatccattttccgcaggaggttgatgacctggtcgtagatggcggcggaacccgggtagtcgcgattggcgtcgttggtggaccagaccggcttgtcaagcaccgccgtcacgaatcccgccgaagacaggtcggaggccatgtcgccgaaggaattgtcgcaggtgccatagccggcgccgtgcatgaaaaccacaccgggacgtccgttcccagcccctttcggtttgcggatcagcactttgatgttctgtatctcaccggtggaaggccgtttcgctttgatggtgacgtaccgtttcgccacctcgtaatcgccttttttcgccagtttttcgccggatggattggcgaaggtcacggcggtgttggcgtcaagcgtttcgatggtctgctcggtcggctcgtagttccatgtggatgccgtcagattggccacggacaccagaatgcccagcagcatgatgaaaataggcaggttgaccatgagtcgccgtccgcgcgtccacggttgatgttgcggttgcggacgcgcgggcgatgaagccgattcttgccgtaatgattggctggcggctgatgattgacgttcctgctctgacacgccgctcattctaccggcctttgctgagaagcctgcgattgcatgctaccgacggcacgctggaacatggctttcagcagttgccgttttgcgtcaccggcacgaccaccggaccggtggcggtggcaggcaactgaccgtcggtctccatctgcgcggcgatctcctgcgccttggcgagcagggtttccacgatctggtcttccggcacggtctggatgaccttgcccttgatgaaaatctgccccttgccgttgccggaggccacgcccaaatcggcttcgcgagcctcgcccggaccgttgacgatgcagcccatgacggccacgcgaatcggcgcggtcacgtccttcaacccttcggtcaccgcgttggccagctgaatcacatccacctgggaacggccgcaggacgggcaggagatgatgtcgaacttacgcgggcgcaatcccatgtattccagcagcttgcagcccaccttcacttcctccacgggaggcgcggacagtgaaacgcggatcgtatcgccgatgccttcggccagcagcgcgccgaaggccaggcagcttttgattgtgccttgccaggtcgggccggcttcggtgacgcccaaatgcagcggccaatcgcccttggaagccaacaaacggtacgtctgcaccatggtgaccacatcatggtgcttgacggaaatcttgaaatcgtggaagccgacgtcttcgaacatgcgcgcttccttcatcgcggacgccaccagcgcctccggtgtcgggccgccgtatttggcgtacagctctttatcgagcgaaccggcgttcacgccgatgcgcagggaaatgcccgcatccgtggcggccttgcagatcgaagggccgacctcgtcgaatttgcgaatgttgccggggttcacgcgcacggccgcgcagccggcgtcaatggcctggaacacgtacttgctttggaagtggatgtcggcaatcaccggaatcggcgattttttgacgatttccggcaatgcgtcggcatcatcctggcttggcacggccacacgcacgatatcgcagccggccgcggtcagttccgcgatctgctgcagggtggccggtacgtcagccgtcagcgtattggtcatggattgcactgaaatcggcgctcccccgccgaccggcaccgggccgaccatgatgcggcgggacttgcggcgcggatgcagcgggctttcgctgatggccgcgtcaccggttttgcggaacggtttttcgatttctggcatacgtgatccttgcatgtgcgaggcgcgttatgcgccccgcgatggttcttacggcttgtgctctttacttgtttatcagcttgtcggcgcgggcgcgagcctcctgctcgagtcggctcatttcctccacggaagcgaacagcgggttgccgcgcagttcggcgtccatctcgtcaagcacttcgcgcacggtgtcgacgatgccgaggtatggcagacggtgttcgaggaacgcgtggacggcctgctcgttggccgcgttgagcacggccgtatgcttttcggacgattcgaggcagtgccgggccaggttcaccgcggggaacgcctcgttgtcgagcggctcgaacgtccacgtggccgccttcgtccaatcgcatgcggcggcgacgtttccgagacgttccggcgcggacaggccgagagcgatcggcaggcgcatgtccggcggcgaagcctgcgcgatggtggcgccgtcgcggaattccaccatggaatgcacgatggattgcggatgcacggtcacgtcgatgcggctcggtggcacatcgaacagtcggcttgcttcgatgacttcaagacctttgttcatcagcgtggacgagttgatggtcacgaccggccccatgttccatgtggggtggttcaaggcctgttccggcgtgatgtcggtcatttggtcgcgcttccagccgcggaacggaccgccggacgcggtgacgacgagcttggacacttcgccgtgtgtgccggaacgcaacgactgccagatggcggaatgttcggaatcgaccggattgatctgcttgtcgcgtacctgcgcgctaaacagcaggtgtccgccggccaccacggattccttgttggccaatgccagctgggagcctgcctgcagtgccgcgatggacggttcgaggccgatggagccggtgatgccgttaagcaccacgtcggcgccggagcctgccatggcgatcaccgcgtcagggccggctgtgatgttgacgttgcctgcgccggcctgttccaacgcctcacgtagcgcggggacagcttccttgtagaagatcgcgacggttggcacatggaatttcgccgcctgctgcgcaagcagttcgacatgtgctccgcccgcggcgagacccgtcacggtgaagcggtcgagatgacgtgagatgacgtcaaggccttgggtgccgatggatccggtggagcccagaattactacggttgatggttgcatgggttatgcgctgctctccgtatgatatgccgatgttccggtattggtttggactatgtaagttgggactgtgtagtcgaggctgtgtagttgggattgtgtaaacgcgagaacaggctgacgattccgccagcctgtttattaccgttggttcactcgaaggacgggaacgacagatccggaatatcgagattgtcgtcgttgcccgacgccgggaaaatcgacctgaaagccgggcttggttccggctttttgtcctcctgctgcttgtccgcatcggattcggcggacggttcagttgccgggccaactgccggttctacggcaggttcagccggagcggccggctcggccggagcctgttcaacaaccggagccggaatgacagttgggttcgaatccggaaccggagtggccggagcggccggttcaggcgtgaaggatggcggcaccgaggctgcgagggagctcaggctcgtcgaaccggtggtgacctgaggcaagtcggacgcggacaggctcggaacctgcggcgtgaacgtgttttccgtctggttcgtctcattgatggtgtgggccagatgcgccaacgcggccaaagacggatcctgctgcggctcgggttcaaccggagccggcgggaatgccggagcggctggagcctgcgaatcggtcgcggtcggagccggagcctttggcgcggcatcttccatcgcatcatcggcaagcggatcgaacgcctgggtctcttcaacggcgctcggcgcggaagaagcggaatcggtctgcggctggaacaccggcggaaccaccggaaccgcaggcggagtgttcgtcggcgtggcaggcacgctcaccggggaggtgaccgcggacgtgaagatctcatgctcggccttgttcagcgcgtcgaaggaatcctcttcgctcggcgtgacggttggcacagtaggaggaaccggagcagccggaaccgtggcggaaggagctgcgaacagcggtgcgatcatctgggtttcgccagctgcggaatcactggaagccggggcaacggacggtgcggccgcggccatcgcctcttcggagggttcaccgacgaaatccgcgacgcgcgcatacgattcgagtcgggtcagcaactgcgcgcaggcggccagatagtaatccacctgacgttcgtcatatcccctcttgcctttgcgctgagtgaagatcacgttgctcaaggtctgggaattcgtgtcggcgatcgccttggcgtccgcttcactgacttcctcgacacccagctcgccggcggctttcgtcaggcacttgtcgatcacgctgtcgacctgcttgcggtcgtagctcggattcttgccctcgcccggcttgaaccgttggccatgctcgcgttcggcatgcgcgtcgagcttcttgaacaggtcctcggtctgcgccttccatgccacacggccatgctgggagatttcccacgtggtctgcttgtcgaccacggcacgttccagacgggcaagcgcggcatccacttgggcgatcacatagccgcccttgaccagttcgaaggagacgttctgaatatcatgctgggtgagttgcgcgccctcaccttcatacagcatgtgcgcacgttcaaggaaagcatccacctgttccgcatcgtagccccactttcgcttcgcggcatgagcgattcccgatgcgttcttctcggtttcaggttcctgtgccattggcgttcgacctcctgctacacgtattaacgtcactactttacgtgattgattcgacgcagacgccgcaaaagatgaaaattcagtgaatcgacacgtgcggctcatcgctcgcacggcggtttcgtaccgatcaagcggcatcatatccgccatgccgacacacgagtgcggctcatcgcgcggatacggtacagtagttcgttgcgggcgattagctcagttggttagagcgccacctttacacggtggatgtcgggggttcgaatccctcatcgcccacttttcgcaacgccgtgaaaaatcaaggaatcgcatatcatcccgcgtaatatcaacgcgcgcacccgtgttttgcccacattccgcccacgttttgtttgtgttttgccggaaagtccacgtaatagcgaaatcccccaaacccaatgggcccgggggattttcgtatacgcgagaaaatcgcgaaaagtcttggtttacttgcccttgccgaacgcgcgcaggtgaataccgttccaatcggagctgacggtcagcggagtggcggcgttcatgccggcggtcttggccgcggactgcacggtgctggagcttgcggcacccggacgtcccggcttcggggtgagcacccacagcgggccgtcatcgccgagaaccgcataggcgtcgacaatggtgtcggccagttcgtcctcgtcatcgccatcacgccaccagatgatcacaccatcgactgcggagtcataatcctcgtcgaccagctcctcaccggtcagttcctcgatcttggcgcggatcgagtcatccacatcatcgtcccacagccattcctgtaccaggtcgccggcgtggaaaccgaattcttcagcgttatcagatgccgtttgattcacgttcgtcaatataccaacactgctcgaacatatacgttacgaacgccggaatcgcccacttttcgagatgaaacggcgatttccgcctgtatcacgcctatccccttccgccgcacgctcattgcttgacggtgcattgcggcagtgaaccgcctttaccatcgcggatggcgaccagcgcgtcgtacgcctcatccaacgtgcccaccttcaccacgtggaggccctgtggcacatgaccgaccacgtcagagcagttggattccggggcaaggaaccacgtggccccgtcgcgcttcgcgccgatcatcttcaaccggatgccgccgatcgcgccaaccttgcctttggcgttcatcgtgccggtacccgcgatggtcttcccgccggaaagctgctctccggtcaccttgtcgatcagaccgagcgtgtacatcatgcccgcggacgggccgccgatgtcatcgacgtgcatggacaccttcataccggacacgtcataaccgtgcgccttgaggaaccgcttcgcggccgtggccgcggcgttctgcgatgaggacatctccttgttgctttccttcgcatagtccttggcgctttgtccgacggggaacacggcctcctgcggaatcaccgtggccttcggattggcccatgccagcaacgcctgcgcgttggtcacaggatatccgggaacgcctgaggcgttgacggtgacgagcagtagtttgccggagtccttatgcgtcttcacgccggacacgtcgatgacctgcttgccttcgacttttccgagcacgtcctgggtcggtcccggctcctgcaccacgtacgcgctgggcgcaataagcaccagcacgcaaagcacggccacgatcggtccggcgagatatcgccaagggcgaacatcgaaccaccgtccgacctgacgccaacgtcgtctgatacgtggcagaaggccttgagacgacccgttacgtgtacttttggcgtgaactcgctgtgtttcctgcatatcggccatgcctcccatactatggaaggcaacgaacttaacaatcgcgtggaacaaaggcaggaaacggtatggatgagaatgcgatccgccagtggcttatcgattgcttcggaccgattcagggcgagatggcatggaaccagctttccaacatgccggaagccgtacgcgaccagctgatgagtcaggatccgagcacgctgcccaagcccgaagaggtcaagtccatgatgcaggcgttcaccgccggcggactcaacaccatgggagatatgcagcaggccgtggaacaggggccgatcaacatcaaactggcgaaatcgctcgcgttgcagcaggcgaatggtgccggatcggacagcagcgtgaacgccgaaaccggcgaaatcgcaagacgtgccatcagcgaggcgaacctgtggcttgataccgcttgcgaattcaacccggcgcaaggcgagacgcagctgctcacccgcgccggctgggtggaggacacaatcgacgcgtgggcgcagttcgcctcccccgtggccgaatcgatgaacgacgctctggcttcgattctgtcgcagcgtttcggcgacggcgaaatccagaccgagatttccggggttttcgcaggccccatcgaaattccgattccggacgaaatgaaaaatccggcgaagctgatgcgattcgtcggcaacacgtcgttcgccatgcagttggggcgtgccgccggcgacctgtcccatgaggtgcgcggcagcttcgatcagggcatcgcgctgctgaagaatcccgccggcggactgatcgtgcagaacgtgaccgaatacgcgaagtcgctggacatcgacgtgaacgaagtgatgggctatcttgcgctgcaggagcttgcgcatgccaggctgttcgcctccgtgccgtggctgatgccccgcttcgaggcgctgctgggcaaatacgcgcgtggcatcaccatcgacatggatgccatggaggagcagatccgtgaggcggagtccatcgatccggattccatggccagcgcggtgaacatcaccaaggtggcgttcccggacactccggagcagaagcaggccatgaaggcgttggagaatctgcttgccttggtggagggctgggtggatgccgtcgtgtggcgtgcgggcatggcgcatattccgcatatcgaacagcttcgtgagatgttgcgccgcgaacgcgccatcggaggccctgcggaacgcacgttcgaaagcctgatgggcatgcaattgcgccccaagcgcatgcgtgaggcggccgcgctgtgggaaagcatcggcgcgcaggaaggccccgaggcgcgcgacgcgaaatggtcgcatccggatctgctgccgcaactgccggacgaacagtccgaggatagctccaacgaagagaacggcgccgcatccgccactaccggtacggaacagaccacggcgcaacaggatattccggacagcatcgattgggatgccgaactgtccaagctgctcgacgaggaagagcacaagggcgatgacgccgatggcacgaacgacgccgacggtacagatgacgccggcgatacgaacgcttccggcgacccgcagtcaccggaagaagcgtgatttcctgcgcccgcgatcggacccatcgtcttcgcgggcgcgcgcataggacacgtcgagtgtgtcttcggcacgcgtgaccgccacgtacatcaatcgccgttcctcttccagaaggtcgccttcgggcggtgaaccgtatggaatcagcccttcggagcacccgatcaggaacacgtgtttgaattccaggcccttggaggcatggatggtggagatggtcacgcctttaacgtcgccgcctgcgccaagtgcttccaacatggccaagcgggtctgagcgtcatccgcgagcgcggagttctgccatccgctgtctcgtttgacgcggtagcgcaggtgttgttcgcccagtgcccggcagaggattttctgctgcgcgttgactcgggtgaggatggcgcagtcgcccggagatgctccctcgtccacgagtctgcggatgcgtgcagccacgccccgggcttcttcgagatcgctgttgtagacggtttgcgcgactcggcggccttggtctcgcttggagttgagtttgagatagtcggcgcgttgcggtgaggcttcgagcacgcggttggcgtagttgacgatctgcggtgtggaacggtagtcgttgttgagtctgacgtcggcggtgagggggccgaattcggaggcgaagttgagcaggttgtagctgctggctccggcgaacgagtagatggtctgtgccgggtcgccgaccacgcagatgttgcggttgtcaccgagccatcgggtgagcagccgatgctgcaggggcgagacgtcttggtattcgtcgacggtgagccatgtgatgccggagcggatgctggccgccacgtcttcgtcgctttcgatgaggtggcaggtgatgagcaggatgtcgtcgaagtcgatttcgttgcgattggttttttcggtttcgtaggctttgtagacatccacgaattggcttggttccagtcctgccggcggctggtggtggatggccgcgcagacgcgttcatagtcttccggcgcgatgagcgagattttgcaccagttgatttcggcttgcaggttgcgcacggtgtcgtcgtccacctgctgggtggtgactcggcgtagggaatgttccacgatttcgcgcggattgcgtgagatgaacggcatgggcccttcgcatacgtctggccagatccgacggagttggtgtagtgccgcggagtggaaggtggcggctttgacgtcggatgcgacgtcgagttgggatagtctgttgcgcatttccgcggccgctttgacggagaaggtcacggcgagcgtggcgtgcggatcccatgccttgatggcgcatgcgtaggcgattcttcgggtgacggtccgcgttttgccggcacctgcgccggcgatgatacggacgggaccgcgcacggcggtcgccgccatgcgctgcgcatcgtccagtccgtcgagaatcgcttccgctgttgcatccatatgctccattgtggcagattgcgtgacgatacggacgccatcggcgcgattaaccgtgaattcgtggcaagtcgcgcccttattagccttcagtgtgtattaaggttggaattgtgaccgaacgaagcagatttatgatggccgccttggcgagcgcggcgatgccgaacgccaccatcgctggcacgcgtgacagcgagcaggtcaacgccaccgacaaggggtatggcattgatcatgccgtggtgcaggacgccgcgggcaagttgtatgacacgttcgcttcgaacacgccgaagggacgcaagcgtctcgctggtcgcgtgcgtgccgcgcagacgttgatgggcaaccgcgagttgggcggattgggattcgacgtcgatcgcgttctggcgttctccaacggcgaacaggagaggtccgtcacaggagacgtttccgtgatgatcgccacgcatcatgatggtcaggcgcgtccgctgacgctgctgacgttggacgactgtgccagcgtgggcaccgcgttgggcgcgatacaccgtctccgtccggattttctgcaggaggccggctatccggtattctccacggggcagattcgcgcgcagctgaccgcatggatcaagcgtttgcgtcaggctggccatgtgccgcaggagatcacgacgagctggtccgacgttcttgaaacggacggcctgtggtcgttcgccacttgtccggtgcatggtggcctgtccgacggcgatgtgctgttctcgggctcgtcgatcaccgccatcacgaactggcaggatatgcaggtcaatgatccggcacgtgatttggcgtggattttctccaaacttgacgaaaaccaccgtaatgcgctgctcagcgcgtatggacgcatgctgggcaatcgtctggatgatctgatcatgctgcgcgccaacctgtggctgcagatggaacaggtgggcgatttcatcagcgcgttgaatcaggccgatagcgtcaagatcatgcagttcaaggcacaggtggagcgtttggctcaccagttgggtatgctcaccgcgaagaaccacaggccgagcgagacgcgtcaggacgagcagaaggccggcaaccgtccgccgagcaccatcaccgtgggcacgttgctggacgaatcggaacgtcgcaggcaggcggcggcgcagcagaataacgatgccgacgcgaccggcgaacgtcatatcgacgcgaccgatatggatgatgacaggaccggcgatttcgacgtcaccggctcccagcccgtccgtaagacgaagcagatcgtcgatgacgccacggaagcgttcgatgtgaccgccgccgaacatatcgcctctgccggcatggtttccggcaatgccgattcggacgatacgagcgaacgtgaggaatcccccgtcagcacgttcgttccggagcagtccgcgagggagcgtcacgagtcgttgccgtccagttcgaccattgtgatcagcacgttgcagaccgccgatggcagtgacgacacgaacgaggaggaaattcctcaagcccatagcgaagcggcgaccatgctcattccgctgctcgaacgcgatgaggccactatgcagaaggccaaagcggaggtcgaccggctgcaggccgaggacgccaccgatgagaaaccgcgcgtagaataagcgcatacattgcaaacgactttgcacacgaacacccttacaaggagcatcatggatatcgaactgggcattcagaacgtggcgcgcaccgtcaccttcagcaccgagcagagcgccgacgaggtgaacaacgtcatcgccgaggccgtggagaatggcaagaccatcaacctgaccgacgacaagggccgtcgcatcgtggtgccggccggttctctcggctatgccatcatcggctccgaaaccaagcacgccgtcggcttcggcaatctctgatcgtcgcctgcaaacgcgttggacacgttccatatgaaaaaggcgtcggaccatatcaggttcgacgcctttttcatattcgattcatgtatccggttcacgcttggaaattccatatccggatttcatgcggcatgtgagctgccgacgcgaccgatcaaatccacaccccggcacaagatttcgcgtacggtgtcgtcgtcggtaaggttctcgcccagaccgttcggcttgcctttgccatgccagtccgagccgccggtcaccagcagatcgtgccgtgcggcaatcgtcagcaatcgttcgcgctgttccggaggattgccgcgatgccatacttccaagccgtccaagccgtcggcgatcatcgcgtcaagctgctcgtcggacagcagccggcggttgcgttgcggatcgcccgcatgcgcggcgaccaccacaccgcccgcccccttgacggcggcgatgacctcgtgcgtcgacggcgacggcgtgggaatgtaatacttggatttggcgctcaccgcgtcggcgaacgcgtcggaacgcgtctcgtacacgcccgccgcgaccagcgcgtcggcgatgtgcggacggccgattgtggtgcgctccccttccttcacttgggcgagcacatcgtcccacgtaatcggaaaatcctgcgacagccgctcaaccatgcgtttcgtacgccgcaatcgcgccgcacgcgtgttggcgaacatgctggaaatatgctcgttggacggatcgtattggaaggcgagcatgtgcacggacacatcttcgtcgacggcggtgatttccgtgcccagcagtaacggcaaaccgatttcctccgaggcttccgtcgcctcgtcccagccggcggtggtgtcatggtcggcaatcgccacaccatgcaagccaagcttccttgcctgctccaccagcgtgcgcggcgtctccgtaccgtcggaaaagacggtatggcaatgaatatcccaaccttgtgcgggtggttccgcgtaactcacgtgactcatatgactatcgtaagctcgaatccgcggtttttcgcgtagactgagacatgacaacgtttgtattttgattttccaaggattgacgatgagcgattttgaaggccaggccgctgtggacgcagccgatgacgaaacgagcgtcggcacagccgtcgccatggacgacgactacacgaagccgcgcggatggcgtcacggcgcaacgtggacgtatctgatcatgctgctcgcttcggcggtggcattgctcgtatcgttcattctgtcggcggacacgctgaaaatggcacgcaatcccgggcagaagctcaactgcgatgtgaacgccgtgctgtcctgttccacggtggccgaatcctggcaggcggaaatcgtgaagttcgccggattgagcttcccgaacgcgttcttcggcattgccgccgaatcggtgttcgtgacgatcgcggtgatcggattgtccaaggtggccgtgccgcgttggttcgcgctgtgcacgtggctgggcggccttgccgcgttggcgtattcgtattggctgaccacgcagtcgctgttcgtcatcaacgcgatgtgtccgtggtgtctggtgctgatgttctccaccaccgtgcagttcatggcgttgtcgcatgccacggtggccgtgcaggatatgccgtccggtcatgctggattgcgcaagtattaccggctgaatttcgatctgatggtcgatgtggtgtggattgtggcgttgatcgtggtcattctcgtcaaggatggcccgatgctgttcgcctgatacggtttgcatcgagccttttgcgatgaaggccgaccctgcggggccggccttttgcctatccgcttttcgtttgctgccgcagcggttacagcagttcgattttgcctacgatggtggcgctgccggtaagcttcacgtcttcgtcggtcacgtcgacgcgcaaggtgccgccacgtacggtgatggtccaatggtcgatgccggttttggcgcgcaacgtgatggcggtggcgcataggcccgtgccgcacgacagggtttcgccgcaaccgcgttcgttgacgcgcatggtggcctcgcccgcatcgtcgccttcgctttgctcgtcgatgcgcacgaactccacgttctggtccgacggaatctcgggcgcgacgaccggcttggtgaccagatcaaggtcttcgacgttcggcaggctggcgaacgcgtcctcgagcacggccacgacgtgcggattgcccatgtccacgaacgtgccacgcgcggaaccggacgtgcccggaatggtcacttcgtaaccgtcgacgtcgccacgcttccatgcgcccatctccacctggaacacgtccttgccgaggcccggcacatcgccgagcgaagtcaggaccttcacgccggcgcgggtgccgagatggaacggcttgccgcccggctggtcggcgatgccctgccgctgcgcgaacagcgtgatcgcacgtgtgccgttgccgcacatctcagccagcgagccgtcagcgttgcggtagtccatgaaccagtccgcatcgcccgccgcgcaatcggcgatctgcctttcgttcacatcggacaccgcctgcggatgcgccagacggatcaggccgtcgccgccgatgccgaaatgtcggtcgcacaggaatcgcacttcatcggcggtcggctcgtgcgtaccgtcttcgtcgagatacaccacgaaatcgttgccggtggcgtgcgctttgtaaacaatgcttggaatgctcataccagttcactctacacgcggtaggctattgaaagcgtttggcgtatgcgcctgcgggcatgcgcgcgatggcaaaggaggacgtatggcttcaacggcacctatcggcgttttcgattccggtttggggggtatttccgtagcgcgtgagatccgccgcgacatgccgaacgagcatgtgctgtatttcggcgactccgcgaacgctccgtacggcacgaaatcgcccgaacaggtgcgcgaactgtccgacgtcattgtgaaacgattcgtggaacaaggcgtgaaagcggtcgtgatcgcctgcaataccgccacttccgccgcagccaacgaactgcgcgacacatacgacattccgatcatcggcatggagccggcattgaaggtggcttgcgaccgtggtcacggcaagcgtcagcgcgtcatcgtggccgccactcccctgacgttgcgtgaacgcaagttcgccgtgctgatggaccgtttcaaggccgaccatacgatttttccggagccctgccccggtctggtggagatcgtggagcatgggcagcttgacgaccatgatgtggtgatgcgcacgctgcaccagtatttcgaccaatacgatctgtccacgatcgactccgttgtgctcggctgcacgcatttcgtgttctaccgcgattatttccgcgaactgctgcctgatacggcggcgatcatcgacggcaatgaaggcaccgtgcgtcaccttggcgtggtgctcgaatcgttgggcaagctcgctccggaagacgcggaaggcagcatcgatctggccaattccgacacttccgcacgaatcgcgcagttggcgcagtcgctgcttgatcgctgagcgcgaatgtcccgacagaccgcgtaaagtcgaatgaaaacccggcaaaagggacggacttgcgaaaggacgggcgcatatggccaacaggacagcgatgatcgacgtcggcggcggtttccgcgcgatttacggcgcgggtgtgatggaccgcatgctggaggacggcatacatgtcgaccattgctatggtgtttccgccggcagcgccaatatggtttcctacatttccggacagcacgggcgaaaccacacgttctacacgcagtacgcgttccgtaaggaatacgcgagcttcgacagctatgtgaagaaccacaattacgcgaacctcgactacgtgtacagcacgctgagcaaccacgatggcgagaatccggtggattacgaggcgtttgcggcgaatccgaccgaattcaccgtggtggcctgcaatgcggacgatggttccacgaagtatttcgacaagtcggacgtcggctacgacaattacgacatcatgaaggcgtcatcggcggtgccggtggcgtgcgaaccgtatgtgatcgacggcgtcccgtattacgacgggggcatcgctgatccgattccggtgcagaaggccatcgatgacggctatgaccgcatcgtggtgattctcacccgtccgaaagacaccgtacgcgaacagaagaaggacatcggcccggccacgatcctgaagcgcacgcacccggaggccgcggaaaagctgatgaaccgctatcagacgtacaacgacgagatggcgttggccaaggaatacgagaaggatggccgtgtgctcatcctcgcgccggaaagcatgtacggcttgaacacgctgagcaagtcgttcgaaggtctggaacgcatgtaccgcgccggatatgcggcggctgccgcgattccagcgttcttggaaagctgaaatccgttcttccgcagcgctgtcatgcgtttccaacggccctaacggcaaccgtatgacagtgatcgcatgacagcaatcgtacatacgacgattacatggcagccgtcgtatgtacgttacggcatcgcaacacgcgtaaccgggcggcggctatgctggaacgcatggaaaagcagaatcgtattttttccggctttgatgccgatgccatcgatcgcactaccgccgcagatctggccgaagtcggttccgacaagtggacccgctaccccggctgtatcggcgcgttcatcgcggaaatggactacggcctggcgccgtgcatccagcaggccatcgacagcgcctgcgaccattgcaaactcggttacattcccgaaccgtggaagcgccgcgtggccgaggcgtgcgccggctggcagaaaagccactacggctgggacgtggatccggacatcatccgcgtggtgccggacgtgttggaagcgtacgagatcttcctgcgcgagctggtcggcgccggcaatgccgtggtcgtgccgacgcccgcgtacatgccgttcctgagcgtgccgaagctgtacgacgtcgacgtgatcgaaatcgaaatgcttcagggaaccgacgaaacgaccggcgagcgcgaatggctgttcgatttcaacgccatcgaacgcgcgttcgcggctggctgccatgcgttcgtgctgtgcaatccgcacaatccgatcggcaaggtgcttacgttggccgaggagcagcggctgtgcgagctggcggaacggtacgacgtgcgtattttcaatgatgagattcacgcgccgttcgtgttcgaggggcgtcatattccgtatccgaccatcagcaaggcggccgcgcggcagtctatgaccgctaccagcgcgtcgaagtcgttcaacattccgggtacgaagtgcgcgcaggtgctgctgacgaatccggcggaccgtgagatgtgggcggaacgtgcggagtggagcgagcatcagaccgccacgatcggtgcgatcgccaccaccactgcctacaacgagggcgatccgtggttccaggacgcgctttcctacgtgcgacgcaatcttgggttgttcgacaagcagatgcgcacgcggttctcgggcgttggctatattcgcccgcgcggcacgtatatcgcatggctggatttcggcccgcttggcattgacgatccggccgcgtatttccttgagaaggcgaaggtggcgctgaccgacggccgttcgtgcggccgcgcgggagccggctgcgtgcgcgtgaacatggcgatgccgtatccgctgctggtggattgcctcaaccgtatgcatgacgcgttgcaggcggacggtttgctttaaagttttccgtctttcgtgtgtgaccgacgctatgggcggccacacacgccatattgcgggaaaatccgccgaatcattgcgattgcaacggttgcgctatgggcgaatagcagcatgttacgatggccgcacaccaccgtcggtggacgcgcgacgcgaatccagcgtatgcgtttcattgagaagaaggctttacgaatatgcgattcccctacagcggcaacggcacatggacgcccgactaccactgcggtttcattgatgccgtcaaacgttttttcatcggctacatggagtttcgggggcgttccagcagacgcgagttctggctcgccatgctgttcttcattccggtcagcgtgctgatattccttattccggctgccggaacggtgtccggaatactgtggatgctggccaccatggtaccgatcatggccatctccttcagaaggctgcatgatgccaaccgcaccggctggtggtttctgcttgggcacgtcggcaccattctggcccttgcgatgctggtcgtcattgcgttcggcctggtcatcatcgaaatcggcatgatcatggtcatcccccacgagccaccgaaactcgactttcatgacccgaacagcttcccgggaatgctgctcacgctgttctatgtcagcctcggcatggccggcatctcgctgatcatccaagcattcctgtactcgctgcccagcaagcccgagggcgtccgcttcgactgatgttctcagcggcatcccgcccctcttccctccctgcattaccctcttagcccttttgtatggaaacgttccatctcacattgagacagagcagtgagctcggttaacaaaactcctataatcacgtctattgtctttccgccgtcataagcgacggaatgtcaacatcagaggagaaaacaatgaagagaaacatgctccaccgcctggtcgccatggccgcggcgggaaccgtgctgatgtcggtcgccgcgtgccgctcgtcatccgatgacaacgccgccaccagcaattccagcgacacctcgctgatttccgtgaacaacagcgagccgcagaacggtctgattccgagcgacaccaacgaaatgggcggcggcaaggtcatccgctacctgttcgaaggtctggtgagcttcgacgcgaagggcaagcaacatctcgaagtcgccgagagtatcaccccgaacgaggatgccaccaagtacacgatcaaactgaagaagggttggaagttcaccaacggcgaggcagtaaccgcccattccttcgccgacacctggagtttcgccgccaatgtgaagaacgcgcagaagacctcgagccgcttctccaccatcaagggctatgacgagctgcaggatccgaacgtcgatccgaaggccacactttccggtctttccactccggacgactacacgctggtcgtcgagctgaacaagcctgattccgtgttcccgaccaagctcgcgcaccaatccatgttcccgctgccgagcgtggcatttaaggacatcaagaagttcggtcaggctccgattggcaatggtccgtacaagttcaagtcctggtcgcatgacaagaacatcatcatcgtgccgaacaaggattataagggcagtcgcaaggtatccaacaacggcatcgaataccgcgtctatacgaatgaggattccgcttactccgacgtgctgtccggcaacctcgacgtgatggatcagattccgcagtccgcggtgaagaccttccgtcaggattccagcgtgatcgcctacagccaggcaggatcctcattccagtccttcgtcattccggaacgtcttgagcatttcggcaacgacgaagaaggccaattgcgtcgtcaggccatttccatggccatcaaccgcgaccagatcgtcaagaaggtttacaacaacacgaagaccccggccaccgatttcacttcaccgctcgtccccgaatatgtgaagaagctggagaagaacggcgacaacctgaagtacaacgcttccaaggccaaggaactgtggaagaaagccaatgccatcaagccatggtccggcaacttccgaatcgcctataatgccgatggcggccataaggaatgggtcgacgccgtgtgcaaccagatcaagaacacactcgacatcgacgccgccggcgaaccgtacgccacgttcagcgacgtgcgcaaccaggtgaccaaccgcaccatcaagaccgcgttccgttccggctggatgctggactacccgtccgccgaggattacctcaacccgctgtacgcatccagctccgccgacggccatggttcgaacgatggcgattacaagagcgaagaattcgacaagctcctgaacgccgcgctcgcccagaccgacgtgaagaagcgcaccgaggacttcaccaaggcccaggaagtgctggccaacgacctgccggtgattccgctgtggaacgacaacgtcgcggccgtgtccgcaacgaacgtgaagaacgtgtcgttcgactacaccaacctgcctacctacaacaccatcaccaagtgacggcttcgttgtgacgtttcgctgccaatcggcaacgaaaaatgagtgggggttcgaatccttaatggattcgaacccccactcggcgttttacagccgtttcgtttatttgcttacggcgtcaaacctatggcgtcagctctgcacgtagctgcccttcggggacttccaaccgcagttcatcatctcgctgttgaacaccatcgcaccgtcgccatgggcggggacgacgatcatgccaccgtcgccgtggtgacgggccacaccgtccagcgcggccttcgcagcctcgaccggatcttccttggcatacagcacacggtcggaaacctggtgtgcggcgacttccttgacgaacgcctcaccgatgccggtgcaggagattgcaacggaatcgttgttggcgtaagtgccgcaacccggcagcggcgaatcgccaacacggcccggcatctggttggtgatgccgccagtggaggtgccggctgcgatattgccggacgcgtcacgtgcgacggcgccgatggtgccatgcttctcccattcgtcgccattggactgcgcctcacgcagggattcctgacgggccggggtgatgaagtactcgctgtcgcacagttcgatgccccactccttgagcaggttatcgcccggcttggcgaacatgacgtgcttggtcttctccttgatggcgcgcgccacattgatcgggttcttggacgtggtcagaccgcatgcggagccgacttcgccgtcaacgccggtcatcaggcaggaatccatggacacgatgccttcgctcgtcaacgcggcaccacggccagcattgaattcgggagcatcctccatgacacgaatggccgcgcagacggcatcctcggccggagcgccctgttccagcagcgcatagccggcttcaagggccctgttcagatcctgctccacctgggcgcgacgttccggcgtgtccttcttgccgcgattgccagcgcctgcgtggatcaccagaaggattccatccggatcagcctgggcaacccggaccgtcgactgcggcaatgctgcttcgtttgttgacatcttctctccttcagatatctcgcttatgtttgacattcgcagatatcttacgccggttgcggcaacgaagcgcccgacatgcgcaaaagcgatgccgtcgcgccgttacgcaatcaaaaacatatcgaagcgcgactgcgtcctttcttacgtttcatacttttgcaaatcgcaatctcgtatttcatggtgctcctccgttggtagtgccagtatgtgtcaagcgcatcgttccccggacaaaatcacgttcttaagcaaagccacgcttgtaaatcggaaacacaagtcgttgtggcccctacggattcatgtatatcgaaatggctgaataattatccatcgcaaaaactctcgtaagcaacacctatcgagataaatgtagcttattttaacgttagctacacttatgcggataagtgtagctaacgcacatgcgatgcgactgatagattgacaataaatggatattcgtatacttattcgtatacttttttatgcgttttcaaatctcgcagaggagaaacatgtcagccgcatcgatccttgacagcatggtctccgtcaccagccttaaccacggcggagcaagcaaagcattaagtcaggtgggcgacaaccatccagtcgtcgtactcaaaaacaatcagcccagcgcggtcataatcacgcccgccgactatcgccggctcactcaggctgaagaaaatttcgcgctataccgcaaagccgtggaacgcctacgcaacgatgacagcacactgctaaccgatgcagacgtattcggcgaagattatgagccgattgatgacggttttgaaccagaattcgaataaggtccatcaacaaccggcaagtggacaattttgtatattttgatatggcgatgcaggttgtatgaaatcaagaaatcgacgtcttgcacagccagattgaatatagtggatggcattgcgatacgtacaggtttcacttttggtcggagcagtatccatgcacaaaggcgatttatcaatcacacgaggagctgactgaaatggcagcgttcggcaggccggaatatgaccgttatgtacgtcttgcggaaatgatgatttcatttctaagagaccatggatacaactacgacgccaatctcgatcaagacatccttgaccatgatggaccgggagtgccagtcgaaaatggcgttgacgccatcatcgagttcaacctcactcctccgaaggatatgatcaccttgtttggacaagttcatgatgaaaatccttggtgcgacgaggaatacgaacaatttcgcgattacctgcgagaacgcgaagatgagcaccaatcgggtaaattgattccgccatccgcagattagaacgccccccacacacacaagtaataatcgtttgcactgttcatcgtagcgggcgcggaactcattctcacttcccgcagtgacaccgtatgccagataaaaaaccgggaacggacgcgacgtttgaattacgacgaacccgactcccggcatcgcgactgcttctcaaaagatgtgtgcttgactcacatggatggtactgagaaccattcgcttgcgatctgcttccgcacacatgctggcgcgatgtaaatacaacgcaggcacacggcagatacaaatcaagtctgtgcaaaacttccagccagcaaagaagccgaccggaaagccacaggccactctagtcgtatggtcgaatattcacaaattaactgaccaaaccgacatatgtcatgtgaagtgagcgataaatcaaaaaacggcagttcaaaagcggaccatctcaatacacgtatcccatatgggatacgaccggtagtgaaggtccggtcgtacacgcttatcgtatttcaatccacacatcccgtatgggatgcgacgcaccgcgtctacgaatttccgtgatcgtagaaatttcaatccacgcatcccgtatgggatgcgacttgccacgattaaacatacatcctcctttcgtgttttgcttcaatttttcttaagcaatttctgcactgtttttccgcagtatggggccgctggtttccatcaggaactgcaccatatgaccgcccagacgaaaacaggcaccagcccgccgtgcctgtatattcccgagacgcagcccaaaaacgaatccgccggctgcaaccggcggcgctcgggaaggaaaggacgatggcgataccgatgcccaaacagcaagatatcaggagactggaccgtcagggagtgtccaggtcggagatcgcgaggaggccggacgtggaccgcgccacggtcgcgaaatacgccgacatggacgacatgacgccgaaaccgcccacggacaggcgccgcggctccaagatcgacccgtacgcggcgttggtcgacggatggctcgaggccgaccgcaggccgccacgcaagcagcgccacaccgccaaacgcgtgcacgacaggctccgcgcggagaccgagtacgacggcgagtacacgacgacgccggagtacgtgagacgctggcgcgaggcgaaccggagaggttccgacggatacggcgagctcgtctgggcgcccggcgtcgcgcagatcgatttcggcgtggcgaaggcccgcatcgccggcgagctcgtggacgaccactgcctggtcgtcacgttcccccattcgaacatgcggtacgtgacgagcctgcccggggagaacgcggaatgcctgtgccacgggctggtcgaggtgttcgagcacatcggcggagtcccgccagtgatcgtcatggacaacgccaccggcgcgggacgcaggaacgcgaggggcgaggtgacgcccgccgcggtgctcgacgtgttcgacatcaaaaaatcgctgtcacacaagggcaacccctacgacaacgccgtggtcgaatcgacgaacaggccgctgaagaaggagctcgtgtaccggaaccactgcaccacgatcgagcgactgaggcatgaccccgacgactacgtgtggtggtccgacaaccagcggctccgctccgccctcggataccggagcccgaaggaattcaccgaacagggactcgtcctctaagaaaccgtccaacacgctgttgccaatccactcgtgctctacgagcccgtcggcaccggcaagacgcatctcgcggtcgcgttgggcaggctcgcgtacatgcgcgcgatacctgtcaggttcttcaccgcgaccgggctgcttatgatgctgcgccgcgcgaaacgggaagaccggctcgacacggagctccggcagatcgccagggcgaggctcctgatcatcgacgagttcggctacatgccgatcgacaaggagggctccaggttcctgttccaggtcatatcggattcctacgagacccggagcatggcccatatcatgaacatcgagttctccggctgggggcgcgtgctcggcgacaagaacatggccgccgcgttgatcgaccgcaccgtgcaccacggaaggctcgtcagattcgagggaggctcctaccgtagcgagcacgccctcatgaccagatagctaggaagaaaagggtggcggattccgacgtcgcagtttctgttggagaccagctgcctatgctgctgaaaaatagtgcctatactgtggatgccaacttgcagaaacacaccagagcgccgccgcgcacccgctccggtcgatttcaatccatgctctccgtaaggagagcgacccctctactggtaaggagactgattatggtcgatatttcaatccacgctctccgtaaggaaagcgacccgaccgcgaggtagtcggatgattgcatggcgatatttcaatccacgctctccgtaaggagagcgaccaccgcgccatgcagtatttcagtactaccccgttatttcaatccacactctccgtaaggagagcgacatagcgaggccgtcagatacgagcttcccaaactcatttcaatccacgctctccgtaagaagagcgacactccaaaaaccactgcatacactgttacacctaatttcaatccacgctctccgtaaggagagcgacatggaaaccccgcgcaattccgataattacgatatttcaatccacgctctccgtaaggagagtgacttaccgtgacgggcaccgccacgtacgtcaacccatttcaatccacgatctccgtaaggagagcgacaccggagagcgtcggcaaatggcgaaactattattatttcaatccacgctctccgtaaggagagcgacaatatcagaggcgcatgccaagcgcaactcagatatttcaatccacgctctccgtaaggagagcgacctctagtgtcctaagttataggcgagacttgtgatttcaatccacgctctccgtaaggagagcgacgattctctatggtgatactcatgattcgtccttaatttcaatccacgctctccgtaaggagagcgacatatcctgcgtgaccagctcgtcacgctgcggcagatttcaatccacgctctccgtaaggagagcgactgcccgtgacgcgaatcgcgtagccggtcaaaccatttcaatccacgctctccgtaaggagagcgacgcctgggcgtgatggacgtgggcgactcgaccgtgatttcaatccacgctctccgtaaggagagcgacgcgtggaagcagcttttcgtcagctatggcgcaaatttcaatccacgctctccgtaaggagagcgaccgtatcctccctgatcgtccgcggccaggtcggaatttcaatccacgttctccgtaaggagagcgacggccaccgtcattcggatatgcggcaggcttggaatttcaatccacgctctccgtaaggagagcgaccattgagagcgtggagtcgcgggaaactcacgatatttcaatccacgctctccgcaaggagagcgacctggcgtccattgacgatggaacagtccgaagcgatttcaatccacgctctccgtaaggagagcgacttcgggttccgggggagtgtggccgggaagcacatttcaatccacgctctccgtaaggagagcgacacgcgactaagactgcccacccaccattaaaggaatttcaatccacgctctccgtaaggagagcgacgtcatcgatcatcatgccgtggcgaacttcaccgatttcaatccacgctctccgtaaggagagcgaccgggttcagctgcgccttggtcaggtcggcgctatttcaatccacgctctccgtaaggagagcgacgtttcgggaaatgcagccgcacatgacgcaataagcaatttcaatccacgctctccgtaaggagagcgacgcgtattgcgggcgaatcatgtcgccatgctcggcatttcaatccacgctctccgtaaggagagcgacgcagagtattatggcccgcttcggtgccttcgatatttcaatccacgctctccgtaaggagagcgacccaggcacaggacggcaccaaccgcaccgtcatgatttcaatccacgctctccgtaaggagagcgaccaggccgccgaccatgtcggacaccaactgcatatttcaatccacgctctccgtaaggagagcgacgcatgccgactggcagggaatggctccgttctgatttcaatccacgctctccgtaaggagagcgacttgacaacgacggtatcctgcgctgcggtcttgacatttcaatccacgctctccgtaaggagagcgacatacaggcgcgggaaagcgccataaccgcgtacgaatttcaatccacgctctccgtaaggagagcgaccccgcgttctattggaacgccaaaagtcaagagatttcaatccacgctctccgtaaggagagcgacaagagtgtctgagagatttccagagtgtcgtaatttcaatccacgctctccgtaaggagagcgacttcgcatgtgctgggattcttcctcttcatccatatttcaatccacgctctccgtaaggagagcgactcgcttgatgcttatggcgtggctcaggcttgatatttcaatccacgctctccgtaaggagagcgactgtccgcccctgcctcattgtagttggggatataatttcaatccacgctctccgtaaggagagcgacgtgcaatgagcgttgacgtattcaacgcgctgaatatttcaatccacgctctccgtaaggagagcgactagcacgaactgggaagaggcggatgccagcaaatttcaatccacgctctccgtaaggagagcgactcgaatatgaagaacgcacctcgtacatcgacatttcaatccacgctctccgtaaggagagcgaccggcagacaccaccggccgccatgcgctccattggcattttaatccacgctctccgtaaggagagcgacctgctgcgcgaacgtcggaatgccggacacgttatttcaatccacgctctccgtaaggagagcgactttggagcacggctggatcggagagaaccccattatttcaatccacgctctccgtaaggagagcgacgccacaccgagcgcaacgggtcgctgctgaccctatttcaatccacgctctccgtaaggagagcgacgtgcgcctcttctgggaagaggtcgtagacgaagccatttcaatccacgctctccgtaaggagagcgaccaaccaagtggccgaagcgctgctcggagccggcaaatttcaatccacgctctccgtaaggagagcgaccgttcctcgcgggaattgtagaggcgagtgtcggaatttcaatccacgctctccgtaaggagagcgacccttccacgatgcgatcacctcgggcgtgaagacatttcaatccacgctctccgtaaggagagcgactggatgtctgcacgacgtacctgcaccggtataaatttcaatccacgctctccgtaaggaaagcgaccatgcaagcgcaagaaaaacttcgtcaacagacgatttcaatccacgctctccgtaaggagagcgacaaatacgcaaagtcaagatgctggtgctgcgagaatttcaatccacgctctccgtaaggagagcgacccgctccccacgcatcggcgtccatcttgcgcttatttcaatccacgctctccgtaaggagagcgacggtggcgcatgaggttgtggtggcggcgggagatatttcaatccacgctctccgtaaggagagcgactctgccagaaagtgaatctgaaagctcaatggcgatttcaatccacgctctccgtaaggagagcgacgcggcgctggtgaaccgtatcggcggtacttatgtatttcaatccacgctctccgtaaggagagcgacgcggcgctggtgaaccgtatcggcggtacttatgtatttcaatccacgctctccgtaaggagagcgactctccctctacgccgcaatatttgcgattgccgaatttcaatccacgctctccgtaaggagagcgacgcgcattcaaaaacggcttgtccccaacggttagatttcaatccacgctctccgtaaggagagcgaccacctggaagtaattgctggtgcattccggattatttcaatccacgctctccgtaaggagagcgaccaggcgcgtggctatcgcgccatttgcgagacatttcaatccacgctctccgtaaggagagcgacccaataaacagcgtaaaaatgacgggacatggtaatttcaatccacgctctccgtaaggagagcgaccatccgccatgattcaacgccatccttcatctcatttcaatccacgctctccgtaaggagagcgaccaacttccagcaggaatacgttccaagataaggaatttcaatccacgctctctgtaaggagagcgactcttggggaggctgactgacatgacgcgcagtagatttcaatccacgctctccgtaaggagagcgaccgacgctcctgcgggtaacgctcgtaatcaggctatttcaatccacgctctccgtaaggagagcgaccgccacgtccgaccatcacgccgacctcgtcgcgatttcaatccacgctctccgtaaggagagcgaccatcgccgcgcagcagtcgcgcatcgttgaactcatttcaatccacgctctccgtaaggagagcgaccaactacagcctcccgctcaacctgagtgacctgatttcaatccacgctctccgtaaggagagcgacctggtatcaccaattttccaaccttcatgacggtatttcaatccacgctctccgtaaggagagcgaccggcctcgtacgcgacgtggtcgtcgccattgcaaatttcaatccacgctctccgtaaggagagcgaccacacgccacattcatcaacgccatcaagggagaatttcaatccacgctctccgtaaggagagcgaccacggacggctggtatacggcggccgaggtacggatttcaatccacgctctccgtaaggagagcgacctcgccgaccggctcaccgacctgaccaacctcgaatttcaatccacgctctccgtaaggagagcgaccctcttcggtcaggctaaacgcctcgtccaaggtatttcaatccacgctctccgtaaggagagcgaccttgactggttcgaattgcatgtgcgcgtatggtagatttcaatccacgctctccgtaaggagagcgacccaaaagcgtctgagagacttccaaggtgtcataatttcaatccacgctctccgtaaggagagcgaccccacggctcaacacatggctccgcgaccaatgggatttcaatccacgctctccgtaaggagagcgaccatgtactccgcccatcgtcccatggagtctcgatttcaatccacgctctccgtaaggagagcgaccggactggcatgattcggctgacgtcacttatggaatttcaatccacgctctccgtaaggagagcgaccgtcggttggtgccgcatcaagatgcaccttgtaatttcaatccacgctctccgtaaggagagcgaccaccgcacagccaacgatgtcgccaatacgaaagcatttcaatccacgctctccgtaaggagagcgacctatcggataactaagggatgtaaccgtttgtaccatttcaatccacgctctccgtaaggagagcgaccctgtacggtgctgccccaatacagattttcctttttatttcaatccacgctctccgtaaggagagcgaccttccaaatcatcgagacgttgcgcgatctcgtgagatttcaatccacgctctccgtaaggagagcgacctggacgctccccaagccgagggggtggcttcatatttcaatccacgctctccgtaaggagagcgacccgtgcagctggacatttttgtccactttctgagacgcaagccagctgcttggctttaagcatatcaaacaacaccaccggtacgacgaacaacatgcctaaaacgagcagctgtctttctgtctcattttaatgtccactatttagttttcaaacgcccacgaaaatcacaattcggatttcgacagtttttcaggtgcgaaaggcacccctcatcatgagcgcttccacttcgcacaaacaccatttcaagaccggccaccttgccgaaaccacaataccgccggctagagaacacgctccagatgccggacgtcacacgtcacactcaaacactcaacccggcataccccacaccatatcgttatgacaccatgccattttaccctgtgctatatcatcatcacatcattaaccggcaaactccgttcatgcccataacgctcaatcctatccgcatatcgagcgccaagtttataaaagcgcagactgtcctcatcaatattggcaatcttcaacaaatcgtgcaccaacaccagataatcggaaggactcaccgagcattcgaaaacactgttctgtacacgctgtccgtatttcatgcatgtcttcgccaccaaacgaagacgacgcttcccctcaggggtttccgtactcacatcgtacgcaaccacaaccatcatggtttttcacctccaataacacatcaccacgaatcatcgcataccgccacacacagctacgcaccttttacttccacataaatggcgggtaatcatcaagatcaccccgcaacgatcgagctagcagcagcgcttgcacatacggaaccaatccccacgaaattttttcttgcaggaacggatgaagaatctgatcactcttctttttctgccacgccgtaagcactttcttccgcccgaaatcagacagcagcaccccgccattctcccgtatttcaaaatcccccggcttaacagcgcctgtattaaccaatgtcagaacgaagcggtcagccaacaccgggcgaaactcttcaactagatccaatgccagagaggctctccccggccgatccgtatgcataaaaccaacatacggatccaaccccacaccttgcaaagccgcaatgcaatcattcgtcaatatggagtagcaaaaagacaataatgcattcagcctgtccagcggaggtctcctcgacctactggtgaaaaagaaatcatctttattcttcagaaccaaatcgtcaaaagcgtagaaataatctttggcagcaagcccttcgacacccctcaactcatcaatcgtcaagctttttcgagcttttgacaatgccgccgacaatttgccgctctgctcggcaagtcggtcgatgttcacccgcaaagcatgatcacgtttcgtgcgttcgagcacccatttcgcattgtaaagcttgccaacaatgaaagatttcgcataacgcaaagatttttgttcgtcatccgcgactcgaaattgttcacggcgaagtagcacattacgattctcctcccctaacacggaacagtaataatgacctctcggtgaatagaatgccatagaaacgcccagtttgccgcagcgccccataagagcaggcgaagcacccttatacgagaaacacatgattccttcaattgaccgtaatggcactttcgccaaggtttggtcattctgataaatcacaacattatcgttctccaaggcaagataggcatcttctgtcatcacaaacaacgtgtttaacagctgcttcatcactccccgctttccttgagccgttcttcgatatatgcttttgccgatttcatcttccgtaattcaggcaggcacaaatcccgtagagaacatgccgaacacgatctggtctgtttcactttgggagtccatccacgggagaaaagatcatgcatttgcaagaagtcagcttcgaccatgttgcgaagatcttcgtcaaattttacccgctcacgacgttttgtctgctgatagaacaaagcaccttcaggaatatcacacgcgagcatttcttccaagcacatcgcttccgcgcatagctgtaaacgatcagcatcaatcgttttggatttgccgtgtttgtattcaatcggatacggcaaccacaatccatctcttccgtgaagcggaacaccatcattagacttatggaattccacaacatcacaggctccagttatgccgagcgctcgcgaatagactctcaaatcccgcatgatcagcatatcgccgcgagattcagaagccgcataatcgtgggcgcgttcatgttccagatgccccgctgtggtcagataattttctgaccacagctgctcgatatgaataagcgcccattgacgcttgcagaatgagaaatgctgaatacccgaaagggccagccaatctgcttctgaataaccatctggccctttcatataagcacctctcatctaggcttggacgctgtaatcagcggccttcgattacttcgtagcgaaggcctggaatggaagcgtcatctacattcacggttccatccgcgtcaacggaaacggaacgatgaactttggccgaagaatactggccccccttgcagttatgtgcaaaccagacgacatccagcacttccatcgatcccgacggacgtgccgaactctcatcattctcgaacagcgtgaccagagcttccttgattttctctgcatcctctgcgctgaaacctgttctttccgccagctgggggctaatgcttccataagttacatatacggcacgtccagagacacgatacttcatgcccatggtgtcggatgattttttaccggaatccgtagtctcgctgttgaccgatttagtgatttgcacatcgtcaattgcgatgggattaatggagaatgccggctgaatcgagaccggtccgcgtacgccaatcgaaacctcatcggtatccttggccttcttaaaggcgaaaacctgaccaaaggaccgcacatcaagccaacgctcgcacaccttaccgaagactacattcttctgcttctgctcatccttcggcaaggtcttcagatatgtattgaacctgtccgacagcgatttggcaccatcatcggaacgatcatcagactgcacaaagactgattctcctgcatcctgcagacggttgcggatcttcctcttcaaggcgacgtcggaaacctcacccagcccttctgacgtcgttctcggacgattaccattcaacggatcaccattgggatttgcgttattcaccgcaaaggcaatcgcaaaatcaatcttattttccaaagctgccataatcacatactccttacttataggcgatgaatcgactctgataattacaaaagtcagttgttgctattatttttttgagaaatctcttgcgctttacgcttagatgctctccgctgacatgaatatcccagaagaaacattggcgaaagcgccttattatcttcaaaatccccttccttaaacaaagccataacatcgtcgacttcattacggaaccaggacccaccgtttgccgatttaaggtatggcgtaagctgcttccacaatgtgccccacgtcgtatagggcttcgccgtgaaattgctcatcaatttgattgcattggttggacggtccttgactccctgcttacgcaagacgctttcctcgaaattgtcggcaagcgccaacaaccttccatacagataatcacgatcatctcgattcggttcaagatacatggttattacgtcctcctgtctatgctgttttcttgtttcatcgatatagtgttttttccataggctgcaagcgatttcaaaatcacgacgccagaccctgatattgtcgtatcccataggcttggtgaccttatgacatgcggcattcaaaatcgacatgggaaattgcgctccgccaaacatacattcaataagccgttccttcacatctttcgcgaagcgtttatagctcttgctgctcctatcagacgtgccacaagcacagttgataatgtcagtgaacgatggagccccttcatactgaacgacattaacccgctcagctccctccacgatgctttttttgaaaaatgtaagaggccaagctgcatcgacatgccattgcagtatgcgcttaatgtattcgtccttctgaagctcgcagtagaacgttacgcctaaacgccccgttgtagcagcatccaagatgacgacaaccatcggatcattgtgcgtcttcagatcctccgcaccctcatatcctctcagaacccttgagaaaatttttgcatactgaacatttgtcgcatttagcgcatcgctgatgtcgtcatgaagcgctttggattcgtcagctattggcgagaggaaatcatcaaaatcaaaagatcctgactgcggattcaatacgggcttttcctcaggtctttttattgcccagacaacgatagcctgattgcctgtcaacgttccatgattattcaccaaccaccgcaaagtggagttgattttctgagaggacgcactatcaaccagcaaagcttgttccttactggaaaaacgtccacgaaaagtaaaattcgtagaatcattagcagacaatagcttggcattggcatcggagctaactacctttttagggaaattagtggttggcgtataaagatcctcgccaaaaacatccttccccagcctgtgttgagaacgctgcagatacgcaatccaacgattccgaatatcaacgtcattcgataaatcagaatcttcgagtccgatttgaacctcgaaacaaacaccggctttatcgtccttatccgttagctccacgccataatgcgcagcagcctcgctgatgctatgctccgacacacacttgaaaacagcttcaagcttggcgtcatcacctttccattttgcaagctgctgcaagtacatgctcgtcttctcaggactgcgcccactatcgacgtactgtaactgatcaaacagcggatgcggtactggcttaatggtccttcccatcgattcctctgtacaaggaatgatgatggtgctctttctcttggcaacacctctgatacaaccattcgcgtccacaagcactgtcagcgaaaccggaagagtcgtatgcccgtacggaatcagcgccctcttcgcagcgtcagcgtcaccatctttctctgcactatgaggagtctgaccagacgccccctgtatcatttcgtaggtagtaagcaaattaccaaacagactcatcgttcactcctcctctactgatgtaacgttcttgcctaagttgaattctttaacgttcaaaccatgcctaacgatgtgccgatcgagaagcggcgaatccggtgattcgaatctgataacgccatccttcataatcggcatccagaagcgcgaaatcagattatggtcaggattctcatccggatacgagaatccatgaaacatatatcccatgttccattctccataagagtcgtagaacccttctccccctccgaattcacacggttcgacataagcttggcattccctagcacccagaaaaatatcgcgacggcctccttgacgcacggacctcatcgcaatgttgtgatgtttgttttcatcacgatcatcagcaagttcctccctcaggtcgttccattcaaaatgcgcaagaacttgatacctcacatcctttaaatatgtgtagtatgaaagatcatttttaacattttttttcttgggctggtacacaatagtgcgaacacctctgctctccgtctgaatcttattcatgactcgcacagcatcaatgacccacttaaacgtgggcttccaatagatgctctccgtaatccccttcaatgcttgatacgttggcacctgatacgagtacttctctccaccaacacgcgtggcgacttccgagaacaatgcgtatctaccccaaacttcatattcgattgaattccgatgccgttccatataactcctttgtaaacggtcttccaaagctattggttaatagcgtaccacaaaaaatttcttatgccatatatagaatctaataggcgtttcgcggcatacgctttatcgactatccttgtgcctgtgggattcccactgtcatcgcgccaagagcgatgtggattgaaaatatatttggcatatgtgttgccccccccaaaaaaaaaactacggctctctcgcatactccttggagcttgcgagagagcactcatccttcctacatcagcaggagaggcatctccgcctcccgtactacgccgtacttgtcgttgtagtattcctcattcagcaagaaaactccaaaatcctcatttgctaacgagattgcatgcttcctggccaaaccacgatagtcatcatcgaacagggaaaccgtatattcctgcaaccgccttagcactgagattttctcgggtaattctcccctgtggagcatatcaagtaactcagtcgcctgaccatacgggaccacaacattgtgcgtgacatccggaattacatggaagttatcgctaaccgtctgaaaagcctgagcaaagcacaaaccgtactttcctcccgtagtattcgtgaattgagatcgatcacattcgttgaaggacaacagatcataagcagtcgtcgctccctccgcccttccccgaattgggcaatccgtatagcctcctttaccattaccgtccttcttacggagaagcatgtcatagtactgttccagaatattcgaagacagcaaatcctttcctgggtagttctccataatctgtaaagtgagctgcttacccattgcgatatccggcagatacctttccatgctgtcttcagctttcaatggatagacatacacattctttggttctaccgattcaccattcctattgcagcgcccagcggcctgcataatactgtccagaccagccatcgccctgaccacgcaagcaaacgaaatgtcaacacctgcctcaataagctgtgtgctcacacaaatcacaggtttcggattgcctggatcaagcagcgcaccgattctgttcagacaatccgttctatgccttccacacatggcagtactgagatgaatcagctcaaactcatgattcacatcaagtcgttccaagcattggaaaatctcacgcgcttcctttttcaggttgacgattgccaagcaattgccgttctcccgcgcctgctgataaataatctgccctagttcatcgcagcttttattttcagttgaagcaacgattcttgtacgtcgaagcttgtcttcatagctttccgtttcagcaataagatcaggcttttccgaaaggagcagattctctcgtttggttttttcaagtaacggctgcgtcgcagagcacaaaagaatcgttgaattggtaatcttcgataggaagctgacgatctcattgaacagattgattgtgttcatcggcaacgactgtatttcatcaaaaatgatgacactgtcggccatattatggaatttccggagtttggttccgcgagcagacatgacagtctcaaggaattccaccatagtggtaacaattatcggattgtcccaacgctctgccgccaacttgcgctgatgctccccggcatcctcaaactcactcgacgcattatccgctacatcagcggaacgttgcatacctgcagtggagtaatgctccaatagaacatcgctatcggcgctcagaccaagtacatctcggaaagtctttgccgtctgagttgtgatagacaaatatggaatcacgtaaatgatccggtgctttcctgtcttcagcgcatgatgcaacgcaaaatttagcgacgccaacgttttaccgccgccagtcggaatcgacaaacgataaatcccggtttcccgcgcccccgccaaacaacactgttcattaatctgatgtcttatcctgtttatttccgaactcgaatcaaaagatctcatgcttttatcgagtcgactaatcagattctgccaatcaaccgcattaggccgatactgttttcgggtctcgaaacaagcagcatccgtcctatccgcatccaccagtcgcgaataaatcagtttaacgagcaaacctagatagaagtatatgctatctttcgacagcctcagcgatttaattttcttcaggaaacaagcgatatcttccgctgaacctcggaaattcgattgcagatcgagcgccaaaccgttaagcccccgcttgatttcttgatacgcatacttctcgttgcttttgtccgactccgtgaacccaagaagaaaagctctattcccggactcgtcaatgcaatcaggaagacctccgtgatgtttagaaatggcaagctcaagaatttcctttgctatctcttcaatttcccctttcgactcgaaaaaatcattgacgacaaacgccccttgacgggcatgctgcacatctcccctatgcccatcatccgataacagatatgtttggaactgctgagcaaccttcccgacatcatgcaagacggctgccgtacgtgaaatatcagcgaattcatcctcgaaaccactagccaatcttcctgtaccatgaagatggtcatacaaagtctgagtattgccttcctcatctttacgagctaatagaaccataacctgctcctttacagataccccctgaatagtctttactctaccgcattccagcaaaagataaaaacgaaatgattgattcgaagattaccgtatgattgattcgaagattatcgtcgccaaatacctgtgcatacgtagtacgccccaacacaaatagcagtagggggtgtgtttctcctgccaaactcgacaggagaaacacacccccacatactatcgtcagtcagccacccagccaaccacctcagaccttagcaacctccacgcccagctcggcgccggcttcgacgcttacactgtcggacgaggtgtcatgcgccacgaggtccttgaactgttcgaccttggccacatcgtccgcgggcacggtcaccttcagcgtgatgcggtcggaaatttccaggccagcggccttacgggcctcctgcacggcgcggatcacgtcgcgggcgtagccttcggccagcaggtcgtcgttcagttcggtgtcgaggatcacgaagccaccggtcggcagcgcggcggacacggagttcgcagcctcctgcgcgttctcctcctccacacggttgatcagctcgtattcgccttcctcaagcgcaatctcgccgttcggagtctcacacacaggcacgccggcggcgtccacatgccaggcaccgctcttggacgccttgatggcgaactgcacgtccttacgcaggcgcttgccggccacacgcgcgttcacgcgcagctcgttcacgatcttcagaccctgggagccggcgtcctccagcgtgcagaactcgatatccttcacgttgagctcgcccttcaacacgtcgctgtaggcggcgaccgcatccgggttctcgaccaccacggtcagcttggcgagcggctggcgcacgcgaatctgcttggccttacgcatggaaagcgtgccggaaacaacctcacgcaccttctccatcgcgtccactagcttggcatcgtcctgcagcacggcacccagctcggtggtctcgccggtcttctcgtcggcaaggaacggccagtcggccagatgcacggattcgccgccagtcaggccgcgccacacggcttcagcctccatcggagccagcggagccagcacgcgcatgaaggtttccagcacggtgtacagcgtgttgaacgcgttctcatcaccggcaccgaaacgttcgcggttgttgcggatgtaccagttggtcagcacgtcgatgaaatcgctcgccgcatcgcacgcgtcggaaatgtagaagttgtccagcgcatgctgggtcttctccactaggcggcgcagacgggccagcaggtagcggtccatctccggcagcttcgccacttcgtcggcacgcagcttgcgcgcgtcgtacccggccgcgttggcgtacagcgtgaagaagtagtaggagctccacaccggcagcatgacctggcgcacggtgtcgcggatgccatcagcggtgacgatcaggttgccgccgcgcaggatcggcgagctcatgaggaaccaacgcatggcgtcggagccgaagtcgttgaacacgccgttcacgtccgggtagttgcgcaggtgcttcgacatcttctgtccgtcggagccgagcacgataccgtggcagatcacgttcttgaacgccggcctgtcgaacagggcggtcgccatgacgtgctgcacgtagaaccagccacgggtctggccgatgtattccacgatgtagtcgcacgggaagtgctgttcgaaggtttccttgttctcgaacgggtaatggtactgggcgaagctcatcgaaccggattcgaaccagcagtccatcacgtcgctgatgcggtgcatgtggctcttgccagtcgggtcgtccgggttgacgcgggtcagctcgtcgatgtacggacggtgcatgttgatattgccgtccttgtcgcgcgggtaatcgccgaaatcggccttcagctcgtcaagcgagccgtacacgtccacgcgcgggtacttcggatcgtcggagacccacaccggaatcggggaaccccagaaacggttgcgggaaatcgaccaatcgcgtgcgttcgccagccacttgccgaactggccgtccttcacgttgttcggaatccagttgatctgctggttgagttcgagcaggcggtccttgatcttggtgacggccacgaaccaggagctcaccggcttgtagatcagcggggtggcgcaacgccagcagtgcgggtaggagtgcacgtagctcttctcctggaagaggatggcgcgctgctcctccggaatgcgggccagcgggccgtcaccggcgcgcaggttgcgcaggatcggcttgttggcgtcgaacacgtacaggccttcgtaatccgggcacagcgacgtgaacttgcagcccgcgtcgagcacgtcgatgctcttgatgcccttggcgttgagcgtgttcatatcgtcttcgccgtacggtgcctggtgcacgaggccggtaccttcaacggtgtcgacgtagtcggcggtgaagatctggtagccttccggccccggcaccttgccttcgacggcgttctcgtcgcccgcgaagtacgggaagaccggatagtagcgccagccttccatttcggcgcccttgagctcgcgcacgatctcgtagttctcgccgagttccttctcgtaggagccgagcagcggcttgccgaggtagaacttcttgccggcgaacttgccttcggtcggacgcacctcgacatagtcgatgtcggcaccgaccacgatggcgaagttggtcggcacggtccacggagtggtggtccagaagacggcgtaggcatcctcctcgtcgcgcagcttcacggccacggacacagtggtgtcctgacgatcctggtacacgtccgcatccatgcgcagctcgtgcgcgctcagcggggtctggtccttcgggcagtacggcagcacgcggtagccctggtatgccagtcccttgtcgtacagctgcttgaaggcccacatcacggactccatgtacgtgatgttcagggtcttgtagccgtgctcgaaatcgacccagcgggcctgacggtgcacgtagtccttccactcgttcgtgtacttgagcacggacgcgcggcaggcgtcgttgaacttgtcgatgcccagttccttgatctggtcgacggagtcgatgcccagttccttctgggcctcaagctcggccggcagaccgtgcgtgtcccagccgaacacgcggttgacgcggtggcccttcatggtctggtaacgcgggatgacgtccttcgcgtaaccggtcagcaggtggccgtagtgcggcaggccgttggcgaacggcgggccgtcgaagaagacgaattcgttctggctgtggtcgccggaaggacggcgttcgatggacttctggaaggtgtcgtccttatcccagtagtcgagcacggactcctccagcttggggaagctggggttcggcgcgacgttggcgctctgctcgccggcagcagccttcggatacacatgattggtggattcgctcaccgtatgctcctcgtttggcggtttcattacttaccttacgaggacgatggcttccgtgcgatcgcgcacgtccggcaccgcggtaccacctcgcttgccgcacttccctgttgttcccacgcaggttgtccgcctgcgcaggtctcgtacgaccgcttgacattcggctgttcgggccgaccccgccggttctactaagcctcgccagaaagcgtcggccgttcttccggaaactccccgctgatgacggatcatcgcttttcgtttcaaatcgtcagcctagcacgccgtacgaacgtagaaacgcgaaaagccgcacggtgtccaccatgcggctttcgtaatcgcaaaacaatcgaaatacaatcggcaggccgaccacgaatcgaccgaagacgatcgcgctcggcggcgaatcagccttcgttcagctgagcctcgagctgcctgacgataccgtcgtgcatcttctcggtgatcttcaccttgagcaggaacacgaccgcgctcaggatgatgaccgcgagcggcacatagaaggcgcagatctcgaagatccggatgttcgcggcggtcatgtcggctgcggtggcgttgccgatcatgccggcggcgatggccacggctccgacgatgccgttcgagcacgcgcccgcgatcttgtcgagcatcggacggacagacagggtgacggcctcgttgcgcttgccgttcttcagctggccgtactcgatggaatcggtcagggaaaggatggccgtcatctggataaaggtctgcggcagatagaagaagacaagaccgacggtgacgaccggcaggctggtggggttgatgatgaacagcagatagccgatgaccataagcaccatgccgccgaggtacaggtagcggcgcggaatgcgcttgttcagaatcgggtacagcggagccataacgatgcccgcgacgacggagacgacgccgacgatggaataggctgcagagttgttcagaatgaacttgaacagatacatgagcacgccggtggtggccacgttggcgatggcgtacagcaggtaggacagggccacccacaacagctggtcgttctgtgcgagagccttgaacgcggcgagcgggccgccgttgtcctcggccttggtgcgcagggtgctggagctttccttggtgccgaacgcgacggagcacacggtgaggacgccgagaatagccacgatgatggcgaagcaggtccagccgctctggctctcctgatgcttgccggtgaagatgtagctgaagtaagtgacgatcggaatgaccacgatggtcaggccgttgtagccgatggagccgccgaaggaaccgagggcggtgtaggtggagcgctcatgggagtcggaggacagcgccgggatcatgccccaataggagatgtcgcgcagggagtagaacacgtcgagcacgatgaaggtgatgacgaacagcacgatgaacagcgtggtgttgacgttcaccaagccgaacaggccggtgtagaccagcacgagcagaacggcggaaacggtgccgccgatgagctgccacggcttgaagcgcccccatttggtattggtgttgtcgacgatgttgcccagcagcggatcgatgaagatctccgcgatgcggatgacaaccacaaggccggtgatgacgccgatgagcttggtggcgagcgccttgtcgaccccggagaacagcgagctggtgacgtagacgatgaagtaggtgctcagcgcgttgtagaaggcggattggccgacgttgccgaacgaataggccacgcgggacagcagactgcctttcctggttggcttcgcagactgctgcgtctccttcggtgcggctgcgacattggattctgccatcgtacttctccttagaagttgtgattgaagctgtaatcggaaatcatcatttaatttcgcatgagttaagtatatccctttacccctgtttagtaaaatttaacatctgcgttgtgcactgttgggcgtgtcgcattttgtgcgattctgcacatatacatatcatattgtgtgcgattcgcggtatttcgccgacagtagacaaacaaaaggcgattgatgacgcagcatcatcaatcgcctttcatatttttccgcacatacgtacgctaggcagcccgtttcgaccgggcagatcgcttcgatcgggtctgcaattttggccgcgattcacgtttcggctgcgccggcacgaaactatctcgcacttccagcgtcgtcgacaggtacgcatgctgccgtactgtgcgcttgctggcaatcgcatcggccaaggtgagaatcgcaacgcgcgcaagctcgttctggtcgattgagaacgtgctcaacggtggcgacgtaagctgtgcgatcgcctggttgttgatgctgatgacgctgatgtcgcggggcacgatcacaccaaccgcgttgaacgcctgcagcacgccgaccgcgatgatgtccgccgaaacaataactgcgtcaggcagtgcgccgttgtggtcacggataaactgctcccccagcttgcgaccattctccacggtgaacaagccgtcagaatacaccagtccacgcaggtcgagaccataacggcccatttcacgccgaaaatatgtggcacgcccctcttcgtccacctcataaaaattcgtcagcctccccttgccgccgatgaatccgacacgcttcatgccagccttcgcacatgcttcgaccgcgtcatgcatggtctgctgtaggtcgggctgcacggaatcaaacaggttcggtgcgggattcacatcgatgaacacaccgtatggcatgacctcatgcaacttctcaaggtcgctttcggctatgacattggcgccgatagccatgaaaccatcgaatttccccttctgattcaacatctcgtcaagactgtggaaaacagtgagctccatacgctgctgtttggcgttatgttccagcgccgaacgcaaatcggcaaaatacgaatcacgcagcgtttcgtcggactcctcgttgtccaacaaggctacttcatgcggaatgacgatacgcttggcctgggcgctgtatcccaaatcctcgctggcgcggatgatcgcgcgacgcgtctcctcacgcacggacagcgtcggatcgccattcaacagacgcgacaccgtggcctgcgagaatcccgtacgtttcgcaatctccttgatggtcgccatcgctccctcgccctcccatggatgcctcatcagattttagtaaaagcattactaaatccatcatactacattaccgaacgtattcttatagccatgacacagccagagcaatcacggaaaccgcgaatcgcgcatcagtccacggaacggatgaacgaactgcgtgcacaacaaaaatcctttgccctgcagaacatgcggagcaaaggactcggcaacgccggtctgcctttcaaagcgaccggtcataaaggtggcatcagtcggcagggttccaaacgcggctgacaccgtggagaaacgcggtcaccgtcagccccacgggcctgcggctggaagcgcccgcccttctgcgtggccgacttgccatgtgagccacccctcgatgacgccacgctccgcatcggttctaccggacgcgtatacatcaggcctctccccggtgatgccgcggatagaaccatgcacatatccacatttttcacggagacggttgcggggctgccggctttccatataccgtcagcgcatggaaagctttggacacaatacatttttcacattagagcaggcacgggaggaggcggcgagacggcatcttgaatgcaggcaggtgttgtcgcggataaggtcacgctcctcggttccactctatgtaagccacggcacagcgctggagctgcatggcatgatcgccaccatgaattatttacccggatatggttcggagctcgttcacgtttcggtgtgccggcaacgcgacttacggaaaatacagggaatgaaattccattacgcaagacatggcatagacggggtgcacgccgacgaattagtgtcaagcgtctccgcgatgcaagcagtctgtcagattgcgccctatgtcgacgaacgaagtctggtgatcgccatggattggctcacttgcgccaatcccgatttacgcgtctgcactcacgatgagctctccgactacatccggagtgcgccgcgattcattgggagcgccaaatgcagaaaggccttgcgcctgtccaaaccaggtaccgattccccgcaggaaacggtgcttcgtttggagagcgatgcctacgggctgcctgaggcacatgtcaactatgagatcattgaccacatacgcggctcgggcacgatgaaggtggatatcgcctacccggatgaccgcgtctgcatagaatacgacggaaattaccactacacccacggccgctggatgtatgacctcgataagcggaaccgactgagggatctcggtttcactccttttgtcgccacccgcgagcatctggcttccaagcagaagctgaacgagctgttcggcatggtcgcccgagcgatagccagtcaccgttacggcttggactagttccgtaggtggtttttcgcttccgtaggtggttggtcagagtatcggggttggagaaaggctttattctggccgttttcatgccgggtattcagacccaaccacctacggaacacccaaaccgcctacggaaccgcatgagtagtccccgcaatggatttttcgccattgattcggggaatccatgaaaagccacagcgggcgcaccctgcgtaaaaggtcatgcccgccgattcatgggagccatatgcgcaagggccgtgcggaagccacatatgtggcttccgcacggcccttgcattcgttgaacactaccgttcagcctgtccaattcaccaagaacgggacaggaacgaagcagaaggagccttactccagttccacggcgcccgtgtacagctggtagtactcgcccttctgcgcgatgagctcgtcatgcgaaccgcgctcgatgatgcggccatggtcgagcaccatgatcacgtcggagttgcgcacggtggacaggcggtgcgcgatcacgaacacggtacggcccttcatgagattgtccataccggcctgcaccacttcctcagtacgggtgtcgatggacgaggtggcctcatcaaggatcatggccggcgggtctgccactgcggcgcgtgcgatggagatcagctggcgctggccttgggacagaccggagccgtcgccttcgagcacggtctggtagccgttgggcagcatgcggatgaagctgtccgcgttggtgagcttagcggcggcgatgcactcctcgtcggtggcgtcgagcttgccatagcggatgttgtccatcacggtgccggtgaacagattcacgtcctgcagcacgatgccgagcgacttgcgcaggtcgggcttgcggatgcccttgacggagatgccgtcatacagaatcataccttcctggatgtcgtagaaacggttgatcaggttggtcaccgtggtcttgccggcaccggtggcgccgacgagcgcgaccttctggccgggcttggcgaaccaggtgatgtcgtgcagcacgggcttgtccgggttgtagccgaaggtcacgtcggtgaaacgcacgtcgccctgcagcagggtcaggcgcccgtccggcgaggtgatcgcgttctcgcgcgccttcctcgccacttccgcggccttcgggctcagcgactgcgcggccttcagggaacggctgccgtcgtcgccttcctcacgcttccaggcccaatggccggtttcgtggtccacttcggtcatggtgcggccgtcttcgccgagctcgacgttgacgagtgtgacggagccgccgtcgtcctcgggcttctcatccatcagctggaagatgcgggacgcgccggcgagcgccatcatcaccatgttgaactgcatggagacctggccgagcgggttgacgaaggagcgagacagtgtcagcagggagatgagggcgccgagggtgagcttgcccgcgccggcgagaccgaagttgcccatgccggagagcgccatgaatccgccgacgatggcgagcaggatgtagaggatgtaacccatgttgcctacgacgggcatggtcacgttgccccaggtgttcgcttcggcggaggccttgtacagttcctcgttcttctcgtcgaaggtcttctgggtggcgtcctcatgattgaagaccttgatgaccttctgaccgttgacggattcctcgacaaaggcgttcacgtcgccgatccacatctgctgcttgacgaagtagcggccggagcgggagacgatggcgcgcacgaccacgaacaggatcgcggcgaacacgagtacgaagatcgtgaccggcaccgacagccacagcatggagaccagtgcggccagtgcggagatcgcggaggagaacatctgcgggaaggactggctgatggcctggcgcagggtgtcggtgtcgttggtgtaacggctcatgatgtcgccgtgctcgttggtgtcgaagtagcggactggcagggtctgctggtgggcgaacatgtcgtcgcggatcttcttcagcgtgccttgttcgacggtgacgatgagccactgccacaaccagctgcagaacgtgccagccgcatacagacagcccatcagcgtcagcgcgcgcaacagcggtccccaatcaggatccgttgcgccgaccatcggcaggatgtagctgtcgatcagcgattgcagaaacagagcggagccggcttgggcggccgcgccgaccagaatgcataccacgattgcgatgacatgccatttgtattggaagatgtagtcgaagatacgtttggtggtgccgggagcggctttctgcattggcggcttagcgcccggcttcacgtccggattcatatccggcttggattgcatggtttttccagtgttcttttcagcggttttcccagtcatgtccatccctcctttcacttcagcccctcaggctgtgcctggtttttggtttgagattcgtagatggatctatattcgtcgcaggttgcgagcagttcgtcgtgcgtgccggcggccatgattcggccgtcttccatgacaaggatcatgtcggattcctgcacggatgcgatgcgttgcgcgatgatgattttcgtggtgtcgggaatctcgttgtggaacgcttcgcggatcagcttgtccgtcttggtgtcgaccgcggaggtggagtcatcgaggatgaggatcttcggtttcttcagcaacgctcgagcgatgcacagacgctggcgttgtccaccggacacgttggttccgccttgttcgatataggtgtcgtatttgtcggggaattcctggatgaaaccgtcagcctgggccagttggcatgcgcggcggatttcctcgtcggtggcgttcgggttgccccagcgcaggttgtccgcaatggtgccggagaacagcacgttcttctgtaaaaccatggccacttggtcgcgcaggatttccagatcgtacttgcgcacatccacaccgccgactttaagcgaaccgtcggtcacatcgtacagtcgcggcacgagctgcacgagactggacttggccgagccagtgccgccgacaatgccaacggtcatgccggaacgaatcttgagggtgatgtcgtccagcaccggtttttcggaattgtcggaatagcggaaggtgacatggtcgaaatcgatcgaaccgtcggcaaccgtcttgactggttcggcggggttggtgacggtgctttcctcgttgagcacctggcagatacgttccgcggaagcctgcgaaatgatgcacatgacgaagatcatggacagcatcatcatagccatgaggatctgcatggcgtatgtgaccaatgccgtcagatcgccggtggtcaatcccaatgcggcgttgttgccggacgagacgatctgccgcgcgcccatccaagcaatcagaatcatcgaaacgtacacacagaccatcatgagcggaccgttgaagctcatcacacggtcggccttgctgaaatccttgtagatgcgctgcgaaatacggccgaacttcgcgatctcatgggattcgcgggtataggacttcaccacacggatgccctgcagattctcgtccaccacattgttgagcttgtcatacgcgtggaacacacgctcgaacaccggatgcacgtacaccgccagaccacacagaccgaaagcgagaacagggatgcacgccaggaacaccaaggaaatggacgggctgatgcggaacgagaagatccacgccacgatcatcatgatcggggctcgcacacccagacgaatgatcatggaataggcgttctgcaggttggtcacatcggtggtgagcctggtgatgatcgagccggtggagaacttgtcaatattggtgaagctgaagccctgcaccttctcgaattcgtcatgacgcaggttcttggcgaatccagcgccggcgatcgcggcgaatttaccggcaaggaagccagccgcgagcgaacatagcgagcacgccagaagaatcagaccgaatttgacgatggcgggcatgcttttgccggtgatgccttcatcaatcaacgacgccatcaccgtggggatgaggatttccagaacaccttcgaccaccacaaatatcggggtgagaatgctgggcttcctatattcacgcagcgatttgccaagcgtgcgtacgagatgccgcttttgttttggctgcgattgcaccgcagccgttgtcacgtttgttccgctcacttactcttcctttcctgtttcgtcttcctgtgatgttttccgtacagttggttgcgattcgcattcccgcgattgccgttcccacgattccgcctcgcacaatgccaggctggaatagcgactttcgtcaccgatcagcccagtggagaccagattggtctgcatcacgtcgagcacgtgcatgaattcgcggatctcgtcatcgctcaaaccctgaagaagaatgccttccatagcgatggcgttggctcgcagcgcctcggctatatcgcgcgatttgtcagtgagcacgattttcttcaaccgcgcgtccctcggcacggattcgcgcacgataagccctttgcgttccatcaatgcgagcaccctgctcgacgtcgaccgggtgatgccgaagcggcgttccacatcctgcgggaagatctcccgttccgaatggcgcgcgaggaaggtgatgatgtcgatgttgccaccgctcagactctccacttccataggacgcgtcaccgtaagataccggttgatgacgttgtgcagcgatcggatggcgacgcttggaggcttgcatgcgccccgctcccatgcttcggcgaacgcggggttcaccgaagccgttccatcgttctgtatatcgttcacggaacataagataacacgttgtacatgcaacagttgcatatgcaacattcagcgtgtcgtgtgtgacggaaccggatcgcagcacaccgagcgcaatattgtaatcgcaaaatcgcttaaaaatagccaaaaataagctcggaacaagccgaaaccaagtatgaaaaagccgaggatgtggtccgcaccggttcattcgcgggccacatcctcggtctaaatccttgaaactccttttgcttacgtcttgtttacgtcaatccgtcttattcggcggtttcggcgattttggcgtattcgtcgagcatgaaggcggtgatggccttgccgccgtcgctcatcagcatcggcatggagttgatcggcatggacttgaggaacatgcgcatcatgtcgttgtcgggcagctgcggcagattgccggcctcgccttccgcatacacggatgcgacgattttggagccgaccggatcgtcggcccattcgccgaacgtggaccattcgtcgagcggcagggccttgccgtcgccgtcgagcgtgacgacggccacggcggcgatgtcgcggctggacgtgccgacttcgacggtgtattcgccggcttcgacatgccagtcgttgaacttctcggaccagtaggcgaaggcgcgctcgtccagatcgaaggtaatctcagccgattcgccggccttgaggaacacctttcggaagcccttgagctcatgcttcgggcgggctacggcggccttgcctggagctacgtagacctgcacggtttcggcggcgtccacgtcggacgtgttggtgacggtcgcggtgacgtgtgcggtgttggcgccggtcttggcgacgttcacgccgtcgatcgcaaaggtcgcgtagctcaggccgaagccgaacgggtagtcgacggccttgtcgtacgtgtcgtagtagcggtagccgacgaacacgccctcaccatagtcgacgtgcccctcctcacccggccagttgatcatgctcggatcgtcgttgatgttcatcggaatggtctgtgccagcttgccggacgggctgaccttgccgaagatcacgtcggcgagcgccggaccgcccgcctggccaagcagccaggattcgaggatgcccttggcgttgcccgcccatggtgccacggagacgacggatccgttggacagcaccacgacgatgttcttgttttcggcggcgacggctttgagcagttcgacctgcttggctggaatgtcgagggtttcacggtcgaagccttcggattcggcggcttccggaaggccgaggaacatgaggacgacgtcggcgtttttggcggtttcgacggcttcggcttcgagcgtgcgatcggccggttcgaggtcgagggtgaagcccggtgcgaacgcgacgtcgacgccccgcgcggcgagggtgtcgaggaagctggtcatcttggtcggggtgatgtgggacgaaccgccgccctggtagcgcggagtgcgggcgaattcgccgatgacggcgattttcgcgtttgcagcgaccggcaggatgtcgtcgtcgtttttgagcagcaccatggattcgatggcggcctgatgggccacctcgtcgtgggcgtccacgtcgaaatggtaatcgtcgatgctcatggcggagcgcgtcttgttcacgaggtcgaccatgccttgggccatgcggtcgagctgttcgggctggatgcggccgtcacgtgcggcgtagacgatctggtcgtccgtgtagctcggcggcatttcaaggttgaggccggcgttgagggaggcgacgcggtcgtggtcggcgccccaatcgctcatgacgatgccttcatacccccattcgtcgcggagcacgtcggtgagcagccagcggttttgtgcggaatgcacgccgttgatgcggttgtaggagcacatgatggtccatggctgggcggttttgacgatgtgctcgaaggccgggaagtagatctcgcgcagcgcccgctgggagatgttggcggatacgcgcagacggtcggtctcctggttgttggcggcgaagtgcttgagcgaggtgcccacgcccttggactgcacgccggcgacgatgccgactgcctcatggccggccagatacgggtcttcggaccaatattcgaagcagcggccgccgagcggattgcgcttgatgttgacgccgggaccgaggatgacggcgaccttctcctggatgcattcctccgccatggcctcgccgacctggtggatgagttccggattccacgagctggacaggcccgcggccggcgggaagcaggtggcgggcacggagttgttcagatcgacttcgccggtggtggccgagttggacttgcgcagaccgtggggtccgtcggtgatcatatagccgggaatgcccttggcttcaacgccctgcagatgccaagcgtcgccgccggaagttagggatgctttctcttcaagcgtcaggtcattgacggaaggataggtgttttcgctcatacgttcctctttcgcatcgttttcttgagttcgtatcggttaaccggcttgtggaatctcaaccccgaaatctttactaaccggtcggtaggtactttatcaaaatcaacatcgcaacacgccaatcttctttgaaaaatcagttaaccgaccgtaaagtaactgcaagtatttaccacttgagagaaatggcgattcataagcattgcagcgcacatgaatcgccattcatggaaggcaggagagggaatcatcatggccaacgaagaagtcgaccgaagagcggagattctcaatgcggccgtcgaactgtttggaatgctcggctattacggcacttccctgcagaaaatcgccgatcgcgtaggactcaccaaggctggcgtgctgcattatgtcggcagtaaggaaggactgctcacagccgcgctggacgaagtctacgattccgaaacggaagatattcttaccgacatagtacgtgagccacgcccgttgatcgccgacatgtggcgcagaatcgtggcggtgaacgcacgcagaccgattcaggtgcacatgttttccacgttgagcgccgaagcgatcgacccgaaccaccccgcacacgagtacttcgccaaccgtgagctgcataatgccgacaccgcactcaacatccgttggcaagtgcccgaaggtgttgatacgcgtcggctgcttaatgcgggattcgccatgatggatggcgtgcagctgcgttggctgcgcacgcccggtcaggatctgaacgccatgtgggcggaatgcgaagacgccctgttccccctgcccatgtgggaggactaccgctaagcctctgccccggcactgcattaatgtatggatgcagacgtaaaaggagacatgtatgcggattctgctggcaccggactcgttcaaggaagccgcttcggctgaagcaatcgcacaggcgatggctcgcggcattaagcgtggcaatccgcaggcggaatgccggctcatgcctctttccgatggcggcgaaggattgacgcaagccttggttcatgccaccgccggcacgttgcacaatgttgagacagttgatgcgatcggccgcccgattaccgctcagtttggctttcttggcaataatcatgcttcttgtattctccacaccgccgtagtcgagttggcttcggcaagcggacttgaacgggtctcccccgccgaccgcaatgcgttgtccgcttccacgttcggcaccggcttgctgattcgtgctgcgattgacgctggcgcggatcgtattgtgcttggtttgggcggcagtgccactacggatggcggcacgggattggctcgcgcgcttggatttcgttttcttgatacggcaggtcatgatattccgcttggtggcggttctcttgttgatttggagaggattgacgattcggaagttcccgattttgtaaaaaatgttccgattgttctcgcctgcgatgtcgccaatcctttgaccggaccagaaggtactgcgcatgtgttcgctccgcaaaaaggcgcgaacacagcacaggtcgaactcctcgatcagggactcgcgaatctcgcacacgcgatcatgcaatacaatggccgcgatattgagcgcattcccggtacaggcgccgcgggcggtaccggcggcgggatgctcggcctgttcaatacaacagtgcggccgggaatcgaacttgtgctcgatcttgcgcatggtcgagaagcatgcgcatgggccgacgtcatcatcaccggcgaaggttccatcgacagtcagacaccgtacggcaaagtgccgaatggcattgcgaaactggcgcaatcgcaaggaaaaccaactattgccattggcggaacggtaacccgcgatccacacaccatcgaagcgttgaacgagaccggcatcgtcgcaacgttcggcattgcgcccgggtcggcggatcttgcgacgctgatcgccaatacggaacgcaatgtcgagattacgtgtgccgcaatcgccggcacactgcgcgttgcttcggctactgcagtagctgcagctacttcaccttgcgaatcagcatgatgaacaccgtgcccagcagcaccgcaaccacagcgatcgggaacaaagccgtataaccgccagtggcaagcacaatcgcgacggcaagctgctgtatggcgttcatcaccgcggaacagtcggcgttcattgacgatggcaactggttcaacgcatgcgtctgatcaggcaccagtacgaatccggaagcggccataaacagtgcgtatgccacaacgatgacccattcatgtgagccgcccacgatcggcatttcgtaggcggctcatatcagactagcgtgtcgattattaggttctgcgacacggcttatttcgtttcgcttttacgcgacggtgaaggtggtgcgcttcaagtgttcgcgacggctggaatgaccgataagcacttcgaattcgcccggttcgacgatccggttagcttccgaatcgacgatggtgcaatcggaaaccggaatgtcgaaggcaacggtcttacttttgcctggttcgagttccacgcgctggaatgctttaagttcacgatcagtccagctgtaggaggtcacgatgtcgccgatgtagagctgtactacttccgtgcccttgcgatcgcccgtattggtgagggtgatttcggcatgcacagtgtcggtttcggcgaatatgccggattccggaacgttggtgatggtcggatctccgtattcgaacgtggtgtagctcagaccctcgccgaatgcgaatgccggattctgcgtgaggtcggcgtaacggttgccgtgctggcctcgaatctggttgtagtagaccggcagctgtcctgcgtgacgcgggaaggtgatcggcaggcgtccgctcggttcggtttcgccgagaatgatttcggcgatggcctggccgcccttcatgcccgggcttggagcccacagcagagccgaagtgccttcggctggagtttcgtcaacaatcacgccattggtaccgatcacggatgccggcagcacttgcggcttggagctgacgagcaccaccacgaacggcttgccggtttcgcgagccacgttcgacagtgcatcgatcagtgcattctgtccgccgagcagttcaagcgtggcggtggagcagccttcgccaatggcctggatcacatcgcccaccacggccacgatcaggtcgcttttacgtgcgttttccacggcttcgccaagcagtgcgcgatcaatcttggcggaaacgccgatcttcgggcgaggctgtccatccgggtagaactcgccttccggatcgggcaccaaatccacgatgttggcaccgcgagagtacacgacctcgcaaccttccggagcgagctgcttgaaaccatcaagcacggtggtgatcatttcacgcgggtggccgtcaggcatccagttgatctggccggagctgcctgcccagtcgcccagctgggtctggacgtcatcggcgagcgggccaacgaccgcgatacgcttcgcaccggccacgttgaacggcagtgaaccgtcgttcttcagcaatgccacggcttcgcgagccacttcaaggttgagctgctgatgctcttcggaaccgatcactgcatcgatacgcttctggtcgggcaagcgtggatcttcgaacagtccaagacggaacttcagtgcgagaatacgagccacggcggcatcgatcaacgattcgtcaagcagaccggtcttcacggcttcgatcgcaccctcgtagaactttggcgtggtcatcaccaagtcgttgccggacttgaccgcatcggcagcagcctgcacataatcaggcttgaccttctgctcccacacggaacggccgacgttgtcccagtcggtgatgagcgtgccctgatagttccaagcgccacgcagtttgtcggaaagcagccacttgttgaaggtgaccggcacaccttcgatggattcgtagccgagcatgaaggtgccacagccttccttggctacgcgttcgaatggcggcaggaaccaggattccagcttgcggtggctcaggtcggcttcggaagcgtcacgccctccctgtgtttcggaatagcctgcgaaatgcttggcgcatgcgaggatcgcgtctttggcgagcggctcgcccgccttggctccaccttgatagcccttgacaatggacgatgccatttcgccaatcaggtacggatcttcgccaaaggtttcgcctacgcggccccaacgggtgtctcgcgcgatgcacagcaccggggagaacgtccaatgcacgccggtggctgacacttcctcggcggtggcacggcccgcggcctgtaccttttcggaatcccacgtggttgccatgcccagctgttccgggaaaatggtggctcccggccagaaggaatagccgtgaatgcagtcgtcgccgatcaccagcggaatgccgagacgggttttggcgttcaccgtttccacggctttcggcagatcggacggcgaggtgtgcagaatggaaccaacgtgcttgttgacgatcagatcgtccaaatcgccgcttcgcgcgtcaagctgcatcatctgtccgactttttcctcaagggtcattcgaccaagcagatcggcgatgcgttcctcagtaggaagtttcggattcctatagggcagatttacagtattttcagtggtttcggtcatggattgctcactttcctcattgaagcgatttcctttaattaccaattggtattttagtatatcatatgcacatccgcaactcgacataaacccgtcaacgcaaaaggcgagggaccatcagaccctcgccttttcgcacgcgcatgcaatgccaatctcaacaagtattcaaaatcaacgatatgcatcccacaacggggatggaaacagcatgttttccatctgagcccactctttgcataaatcaacttcaggctcgcgcaaccaccataattgcacaccatccatgatttccatggccttacgcaccaccggtcgtatactcgacttccatgaacccaattgcggaggaatcagccaaggatattgcgaatagttctcccaaatatcgtccatacgagcagtgaattcatcatgcaacggatgttcaggattcaacgattccgcagaaagcacggtaaactttgaaacagacacccccaagtatgccaaaaccaagcgtcactatatgtggacgcagcaatgaacaattcccctatgacaactagcatggggagacattatttgtaaagcataaaagaaggtccattcaaatggagaagccgaacgatattaaaagagactccatatcagtgaattactttttgaatactgctgcgtacagcggtctcttctcccttctttcggttattctcaccggccaagtttctgcggcgtcatcgctatatgttgggctggcgctcggaattttatctcttttttctagaggcagtactgtttttataggtagcctgattgagcgtttctcaacggtatccctcaccgaggccggtttcggattcatggttttttcacttttgctgctacaaccggcaatgggtggttttatcggcttcctttttgcggatttggctttgctgggactcggtctttcattggttaattttgccctacgagggcatatcatcgctacagtaaaggataaaaaaattcaggcttctttgtttgctttagtgactatggcagccaatcttggatccgcgattggacctctgggctcgaattacatatataaagctttcggacaaacgctctttattgcaatcatcgtcggactctatgctttttctgctttactagctccaatagcgctgactcatcatgtcttcatacgcaatgagaaaagcggcgaggaaaacacttcctccatcgtgaagaccattacagactcgctgaaaagtcccggtacggttcttgccatcctggcggtgttcgtgggcagtataatgaatggtcagctttttgccggaatggcattggaattccactcgttatccgatagtccagtcataagaggattgttctattccattgatgccatatcggtcatagcactgcaaatgccggtaagtaagatcatctcgcgcaatatgaccaaagaacataatgccacctcattcatagtcaaaagcctggggatttatggaatttccttcgcactattcgcctgcggagtctcgtcgtactggtggatatgcatcatttccttggttgtgttctccattgcagaatgcatctatgcgccattaatcaatattgctctggtagaggcacagccagataagcctttggtggacattctgaactatcggctgataattgcagccattggtgaatcggcaggctcattccttggcggttggatcgttccggcactacgtcctgcaggattgacggcttggtattggtgtgcactggcgttagtgggaataatgcctgcagtcgtcactaatcaaattagaaaacgtggacaaagaatcattcgtcattgaaagaaaaagtcttggtgagtacaccggaaggggaatgacatgaaagtattattgctgcaacagcccaaatctttctcaaattatcctaaatggattgaggaaatccaagaacgtttcgattgtttagaagttatggtcttcacctcgaacgatcgagccgcacaccatagttggccgagctccgtcatcaaggaaatcgaggtttccgattattcctctgatagcgctaccgcaaaattctttgatattgtcaggaaatttaaaccagataggatagtttccagctcagaggaagacgtactgagggttgcagaggcgagaagtttatttggaattcccggtttacagcatgaactggcgttaagctgtcgagataaagtcacgatgaaacaatcggcccttgatgccggattaaagattattccctataccacctgccaaggctttggagatattatttcggcgttcgatcgttgggagacggttgttctcaaacctcgatggggcgcagggtctgcaggcattacgatattgcattcgaaagatgacctgcctgctttagctaccaagccggaattcatacgaaacgtgcattcaaaccagtattacttagaggaatattgttccggttccgtctaccatgtggatgtagtctatatcaattccggttcgattctgatctcaccatcacggtaccttgtcccgccactggatttcgagaaacaaaacaccggttccgtgatgttggatgagaacggtgccgactattccgagctgctccgactgacaaagcaattaattgcatctttcaacgatcagacgattccgaatgtgatgcatatcgaattctataagaatgaaaccggtgatttcgtattcggggaaatggcggcacgcagaggaggcggtctcatcaagcaggagctggcagccgcctatggcatagaccaaagcaaggccaacttcctattggaacttggtcttgtcgatgcggatgcgaatattacgcgatcatctcagtatggcatactgctggaaaccgctggattgaactggccaaaggaaaaagaaatcccggattgggcggttttggaatctgtgggcaagaaaaaaggtatcgctcataactctgttgattctgacaggaaatttcttatttccggcaagaatgaatctgagattattcaacgttctaattatcttataaatagtcaatataatgagtaaaattaactttttacagagggacaattgtaactaattctgcagcaggttctatatatgacgaattattatgtagaattggtaattctactgaatctagactcttccgtaaaataatgatactagtatcgctagggatgttgggaaccagcattggcgtctatacgggaagcgcagcaggtagtctgactgcatcaaaatggtcgacatctcaagaaaccagcatgtctctttcagcaaacttttcaggcactaccacaatagaagataagcaaaatgagggtggccgtcaggtcacccccgaacgtatgcggaacacacataaaatcagcggcatgcatcccagaggggcgcgggaaacagcagattctccatttcggaccattcctcacacaagtccacttccggttcgcgcagccaccacagctgaatgccatccatgatttccatggctttgcgcaccactggccgcatgctgccggcccatgcgcccaattgcggcggaaccacccacgggtatttcgagtagtgttcccagatgtcctccatgcgtcccatgaattcgtcatgcaatgggtgatccgggttcagggattccaccgacagcacggtgaacagctgcaccatcatgcggcggcgcgagttgtgtttcaccaggtagcgcagatacgcgggaaaatgcggcgcggacgggtcgctgcccggcatgcccgaagagaagaagtcctccggcgtgccggtctgcccgtagtattcgtcatataccagcgccagcattttgtctttgttgtcgacgtatcgcaacacgccttgtttggagatgccgaccctgtcggccacgtcttggatggaaatgccattgaatccacgctcactgatcagctgaacagccgcatccagcacttccgctcgacgctcctgcggtgattttcggatacgtttcgaagtctcttcctctgccatgattccgagtctaatgcaccttgcgtcgattgccgttgattgactgcctatggcacgtcatcgtgagaggtatccgcccgaatccatccatgacgccatacgcgagtcagatcccacgcctcaagattgccgccgttgcgaggatcccgcggcggtttcccttcgccactacccggtttcgcggagcgcgcaagctggtagctccaatagatctgccccgccgacacgtcccatgccgcgcgttgcaatcgtgacacttggcggtatgcagccgatcggttttggctgtgtagggcccactgattctccacgcaccactcgcccaccagcacgggaatacgacgggccgccgaacggatggcgatgccactcgcgcccaccagcatccggtacagccatggcagtcgccgcgatcgcaggtacagccggcgtgccggtcccgaaaacagcggatcctccatcgcgatgagatactgatgggtgtcgagcatgacgttgcgcatgccagcacgacgaaaccaaccgccccagcggagtagtcggaaaccgtcatggaatacgatcacggtttccggacgtagcacggcgcgtaaccgggcgtaagcgtcgcggtagaagcgcttcagaaaccgcagtgagacatacatgctaccggaagcctcatgagagtctttcgccgtgttcgacgtgctatggaacaccgaccagctcactggttcgttgagtacttcgatgctgtgcagggccggttcgtcgcggtatcggcgagccaatcgctccagcacgttcagcgtgtactccaccaagtccgtattctgcgcccatttgcacacacccgtcagaccgccgttgtcgaaaccgttctgcgattcgggaacggtatgcaggtcaatcataatcttcaatcccgtctcccgcgcccagcggaacgcgcggtcgaggtacgtgatgcagcccggatgcccgggccagtcgccgaagatgaaatacggtatgggaatgcgtacgaggttgattccgtgaccgacgataatacggaaatcctccaaggtgatgtaggtttcgcggtgccggcgcagttcctcggcgagattccgttcggaccagagggatacgtgcgtgcggtgcatccagatttcatcgtcttcggcgctgcgggtgaacggtttcggatccatccatttctccagcaccagccagttgccgaggttcacgccgtcgattcgctcgtcgatgcctagcaccatgcgtctcaccgcccttacgttcgggggttgcccgacttttcgcttccgcccatcacaacccatggcaaaacccattcggcccaatgggccaaggaaccgcgcgtcattcgcaacgttccttggtccattgtatgcgccccgcgagcggccacgcggccgctcggaatcggatcacagccggatcagggtcgttgaatgatcgtggtggccggccgggcgggatcagtcgacgggcttcgtctcgtccgcctcgtagtcgaagaagtcgaagtcggcggtcttctcgtgcagagcggcgtcggtgatggcgatgccgaccatagtgccggtgaattcgccgtacttgcagtattcgtcagagaaggtggtagtgtcgaaatccgggccaatcttggtccagttctcgccatcataaccccactcgaaccaagtacgacgaccttcgatattcaaacggaaatagatcggcttgtcttccacagcaacgcgagtgtcaagcatttccgtcttttcaccgttttcgagacgcacaatcgaaatcgcgctgccgccaagcgtctgtgaataatacttgcgcaggaaaatattattcatgttgtcgtagtagatggtcaagccagcgctgtgctggtagacttccggctcgaactccatcttcgtggtgacggtggcgtacacgctggtgagtttgcgtgcgatcaggctcgtgcggttgagcgatgccaacgattcctcgccgcggatgcgcagccaaccggggcgttccgtcacgttggcgaaggtggtcggcatctgccgcggcgaataataccagttgccgatcgcgccgccgtcgaagtcgtcgtgcccgggaatctccggcatcggcgcatccggcagatccggctcttcgacttcgagtttggccagattggagccgtccgccatgcgcagccagccgtcattcgtccatgtcatcttctgaatggcggtttcacggccaagcgtacaacgtaattccggcacaaacggacggctggtcaggtgcacaagatatgtctcgccgttcggcagatccacgtaggagccgtgcccggacttctgcagcacggaatccgggttgaaatagcgcggcttcaaatgatcgtcatcagcacgctcgtttgactccttcggctgcgaagtgacgagcggaccattcggatccggctcatacggaccccacacattgcgggaacggcccatggtcacggcatggttgtagccagtgccaccctcggcgcacataatgtaataccagccgtcacgcttggtcagatgcggagcctcaatgcagccacgatcagtagcgccacgccatatacgcttcggatagccaaccacatgcttggtttccggatcatattccacacagcagatcacgcccggcttctcatagccttcacgggtctcccactccaagctgacgatgtacttcttgccattgtcatcatgtaaaatggacgcgtcgaaaccagaagatgtcagatataccggctcgctccacggaccttcaatgctctttgacttaatcagataattattcacgtcgaaatagcgtgcattcatggagttcataacgccgtaaatcacgtaaaacatgtcctcttcctcacaatacgtgagacatggagcccaaatgcccttagcgctcggcagcttggtgaggttcggcttcgtatcatcagtaagcacgtgggtgagcagctcccaatgcttcatatccttcgaatggtaaatcggaatacccgggaaccattcgaatgtagagacagcaacatagtagtcgtcgcctttacggcagatggccggatcaggattgaagcctttgaagatcggattatgcagcattgtcgttccttaatgttcttgatatcacgcgttgctttgtacgattcttgcgtccgacggaatcacttttggacggggaaccagttttgggcgatgcagcgtccaaggtcccatgcgtcccagccgatccagccgggagtgttgacagtgtcagtgagcagcttgtagttccagtagtagaagccgctgcccttgctccatgcggcgagctgggattcggctaggccccggtacagcgagcgcttctgttcggcggtcagggtttcgacctgagccccttcctcgccgttgagcacgctttggccgccgtgggtgtccacaccgcagccgacggagttgaacaggcaccactcccccacaatcaccgggaagtattcgctcatctcggcgatcatcggcgcataggtattcctcacgaagtcgtcgtagccctccgctgtctgcgggcaacccatcgtttcggcggtcatgaggtattggtgggtatcgaggaccacgttcttaaactcgggcgcgagcttgccgtcggggccgcgcatgaagtccttccactgttcgatgtcgaaaccgtcgtggaacaccacgactttgtcggtcggcaacgcgcccttgtcagcgtcgcgcagacggtggtaggcggtgatgtagaagttcttgagccagtcgaatgcgatcgggccggtgccttcggcgagttccggatcgaccgccttgtagcgttcggtcacgttcgccatcggccagcaggtggcggtgttcggctcgttgatgatttcgatgcccatcagcgcccgacgatggccgtaccgcttggagaggcgttcgagcacggacagcacgaattcgacttcgtcgggcagctgcgcccacttgcacacgccggagatgccgccgttgtcgaagccgttttggctcatcggtgcggtgtgcagatcgataaggatggtcaggccgtatttctcggcccagttgaaggccttgtcgagttcgtcgatgcagccgatgaacggcgcgcggtcgccgaagatgaagtacggcacggggatgcgcacggagttcagtccccacgatttgatggtggcgaagtcgcgctcgttgatgtattcggcgcggtgggtcctgatacgggcctcgtagacggccggatcaagttgcgtcggcagatagtattcgtcatcggcagtggttccatcgaataatgccgggttcatccacttttccagaaccagccagttacccaggttcacgcccttgatgtaattaaggtccatatgcactccttcgtacgctttcaatcatattttttattacttagtaattactaagttagatgatagtacatttttctcctccccgcaactcgtctcggacatctctccgaaccgctgtcgcactatttcgcataaagcaccctttgcgaaaatcgtgggaccgacaatcaaaatcgtgcagcaatttcacagaatcatgcgattaatcataagaaaaaagcctctttcttgcgggaagaaagaggcaacctgcagccggagagacgattactgcttatcgctggcgaatcgttacgtgcaaggcactcaccgaggcagcgggcaacgttaccgtcagctcggcaccgccggcagattcgtgcacgctcacggcactatccacgtccacggcatgagtgcgcaccagatccgaatgctccactgtgttgcaatcatgcggatcttcggaagcaagcgtttccatcgaatcaacctgagcgccgcacggcaaatgcagccgcacttcggcaccatcgttcatatgcgcattggtgagattaatcagcagctgcgtgccatcctcattacgtgacgcaaacgtatacacggcagaatcctcggaatcgttacgcgccacatcaagtgcggtcatgccacgatgcgccttatacatcatgaacacatcgtagttaggcgtaaggatggtccgatcgccttcagtcaagatcagtgagttaagcacattgatggtctgcgcgttacacgccatggtcaccttgtcgcaattacgctgcagcagatccaacgtaagcgcggtggtgatggcgtcacgcatggtcacctgctgcttgagcgcagggcgtgcgaagaatgcggtcttgtgccaattgccccattcgccgatgattagatcgacatgcgcgagcttggaatccatagccacctccggctcatgaataagcgccaggccgtcattcatcaaacgccactgatcacgcagaatatcttcaagttcgaggcatccctcaatcaccgcattccagccgtcttcatcgaaccgggtgggagtgtcggcatcgttatccacgttccaattgtagaagtgcagatcatagccgtcgatattcggctgacgatattcggcaagaccgcggaagaaatcctgggtccactgcacgcgttcgcgcggcttgttgccgtcgggaccgctcgcaatagcatacattggggtcggcgcgaacacatcggtggtgaagctcggcatggcggatgcgaacctgcggtattcattgaggtaggtccgcggagtcatggtaccgccgccagcccacacttcgttgccgatcccccaatatttcaccccgtaaggtgccttatggccgttagcctcacgttccttggcaagatcagtgggctgcgcacgattgcagtactccatccaatccttcatttcggcgaccgtgccggaaagcatgttgatattgatccacggttcagcgccgagcatttcacacaaacgcaggaattcgtcggtgccgaagctgtgatcgtccagctcataggtggcgaaattctcgttgaaagtggttttacgttcgctttgcgggcccacaccgtcacgccaatggtaggtatccgcatagcatccgcccggccagcgaataaccggcggcctcaatgcacgcaaagcatccaatgtggccttgcggtagccacgctcgttttcgatcggggaatcctctcccacccatagaccttcatcaatgcattcgccaaggaattcaatgaattggccatgcagtttcggatcgatacgaccaatcgtactgttcgggtcaatgcagacaaccatggtttgctccttttgccgtagtgctcacatctgcaacgttcgtaattcgtatggttcttgtagttattgtgccgcacaatatatgcgaaatggccgaagattccaggagagatgatgaaagaatctccggccaagttatttcgaaaagcgccgacgctacttcacctttttaatcatcagaatgaagatgcaggcgagcgccaccataacgattgccgtcgggaacaccagtccgtacgagccggtagctaccacaatggcggaggtgacaatcgggccgaccatctgaccgagagtagtggcaatgttcaaaatgcccaaatccttcccggcctcttcttcattcggcagaacgtcaacattgagcgcctgatcgacggaaccgtacatgccgtagccgaagccaccgatggcggagaagagaatcatgcccaacgcgttgtgcatgagccatggcagagcataaccgatggcgagcagcacgcttgcggccacaaccggaatcttacggcgaccgattttgtcggaaatcggacctgcggaaagcgcggaaatcagggagacaaccatcagcaccaagctcatggtggaaatggtggccgcggaatcttcaacactttgaccaatgtagtcctgcagaatatacagctggtagttgagaatcatgtagtagctgaacagcaacagggaacggccgataaatgccagccagaagtcgcgagcgcctttggtcggcggacggaagctcatgataatacccttgaaatcaaccttttccttaggcatatccttgctggacttttccttcggccagaagaccacggcaagcacaccggaaagacccatagccacaccggacgcgatgaagcccgggagctgcagggtgatgaactgcgcaccaacaatctgaccaagagcagaaccgaacaacgtacctgcagagataaatgcggacatggtgccgcgcatatcttcaggaatacggtcagacaaagatgcgatgaccggtgcgatcatcatgttcagaccgaccatggaaatgcagtagctgatgccaatgctcacaccgtccggcagaatgccgatgaggaacagcgaaatgcccgcaacaatgccgcccgatgcgatccatggcgtacgacgtccgaagatcgagcgcgtacggtcagacatgttgccaaccacgaggttggaaatcagcgaggccaatgccgtggctgaattcagcacgccgaaaatggcgtctttgctgtcgggcgcgatatcagccaaacgctgcggcagcagcactgcagcaacgatccgcaacgccagcatccatgcgaatgagaacacgaagaacgctacgcagaaacgcgttttgtcgattttggaaagctcgttggcatgttccgcaggccgtgcgtcagtcatgcttgtctccttatctttatctttctttttcaaagtcagccctctacgtttttgccgaatcttcaatgatcatgcaaacaacaggcaagagaggcgttgtgttgaagtcaactctcatcggcttcgtcagttatcttatatcttaaagatataagataacaaatcggcgtgtcgaacaacgacctactttcaagcacagcaatcaaccgcataaccgcaatatcgaaaccacatgaaaacgcatgtggacagcggcaatagtattcttcaaatcagtatggaatcacaggaaaacacatcagcaaacagcatcaagagccgtccaatcaaccaaagaaaacgactctccccagcgcagcgacgcaaacaaatcacacaagaagcggtaaccctaatcacgcaatacgggtcatacggcttccccatgcaagcattagccgatgcagttggcatgaccctgcccggactcaaccattacgtcaaaaaccgagaagaattactctcattggtcatcgaaacgttctacgactccgaagaagaaggcaatgcccacacggcattgggcgcagccatcagccactgcgaccaaacagattcagcaaccaaagaacgccgacatctgcccggcgcattgcacgaaaccgtgcgcctcaacgccaaacgtcccgaacttgtcgcactgttcatgcgcctcgccatcgaagcgtccgatccagaacacccagcccacaagttctaccagaacagacacagttcgattttgatcgacatgaccagcgtggactgggaactaccggaagaataccgcgatccagaacgcctgcatgacctcatcgtcaccgcgttctttgccatggacggcgtgcaaatccagtcgttaaccaatcccagcgaatccatgatgcaactatgggaacgcgcagaacacatcctattcccctcccccacatgggacggctaccgctgaacagagcgcaaacaagcaaagacaccgcaaacgcaaaaaggcgtttgcctgcggcgaccggtaaccgatcaccataggcaaacgccccgcaacacaacaccggcttgcgaagatggcaggaagagaagggaaacttgccatccggcattcaacaaacctctgccacaaccaagccgacgcgttacgcacacattcgcatcagccaggcagctcccgtcagtccagcacaaacgtgttgaacgaacgcggagcaagcgtcaccttgataccgcgatcggcattgcaaggatcggcaaattcaaacggacgctcctcttcgagagcgttctgggccaccaccacaatggtgccatccggattacggaacgcaatagccatcgaattgaaatgacccgtagtgccaagcacatgcgcacccggcttgacgaaatgcgagaaatgacgcatcacataatattccggattacggcgaacctcatgcgtatccgcagtaatggtgaacagtgaattctgccaccacccccacgtagaatcctgatcgtcaagaatcatattccaataagtgtaagcagtcgcgccattacgcaaataatggttgatcaagtggaaaatatactccgcatattcccacgtattatcacccataccgcattcggattcagactgaatcagctcgatttcaggccaggattcatgcgtacgcgcaatacagttctggccggcccactggtaagcgatgcccttgatgtacttgcgagcgccatcgtcgaacagaatattgtcgacaaaacggttgtaattattcagcttcatgccgtagccgccggtccacgccatatcttccggaccattcagcgtacccagccaaatatcggtgtcaagaccagcttcgccaaaagcaggtccaagataatcgcggatgaacaccttgagcgcttcggaatcccacaatgcactcgggaacttctgatcggcaaacacctcattctgcacatgcagctgattcacggtaatgccatgctcggcataagcttgaatgtacttgacgaaatacttcgcatatgccttaagattctcaggagtctgcaccaaacgaccatagttataagccttcggacgcttcatccatgtcggcgggctccacgggctggagaacagttgcatgttcggctgccattcctgcgcgcgatgaatatacggaatcagcgtccgctcatcatgctcgacggagaaatgctccatctcataatcgccgtcggtctcgttatagctataccaatgatcggcgaaatcattggcaccgaccggcgcacgattgaaggtgaagttcatctcatccgggctgaacagttccttgatgatctgatcacgttcctcttcagtaaccgtctgcagaggaagccagccaagctcgttgaagcagccgccgaagccacgcaatgcctgatattcattgccatcaagctgcagatcggaagcggaagtggcatgcgtggattcaatttcggatgatttgtcggcaagcttgttgtcttgcgttgtcgcgatccaagtagtcatggaaagtccttagtattgtcgctgattctttggatttatatttattcgttttttgagttgtttttatttgattattgggatttagttatcgatatttagtttttgagattgaattattgagattgaattatcggcaacgcaatttcatttcagtaagtgcaaaaaccgcaggatgccgcgataatctattcacaacacgctccaggccgctctagccaagtctttacggtcttaaacagattatcgcggcatcctgctcgtaacgctatgacgttacgtttgcactgttatttagttttgcattgttgttcagttttggaaaaacttcctattccctctctccctctcctctctcgaaattgaggggagggggaggaggtggggttacttgaccttcttgatggccatgatgaagaagcagccgatgatggccaaggcgatggcggtcgggaaggcgaagttgtagccgagggacaccacgatggtggacatgatgaccgggccgcacatctgaccaagggtggtgcccatgttcagaatgcccagatccttgccagcctcttccttgttcggcagcacatcaacgagcagagcctgatcgaccgcggagtagacagcgtagccgaggccagcgatgccagcgaacagatacatgcccagggtggacgggatcagccacggcatggcaataccgatagcgaagagcacggaagccacgacaaccggaaccttacgacggccgatgaaatcggaaaccgggccggagatgaaggagccgaccagagacatgaccatcatgatcatggaaacgacggacacggtgacagcggattccttgacggactgaccaatgtagttctggatgatgtagagctggtagacgttgatcatctggtagctcatgatcatgcagaaacggccggcgaaagccttgtagaagtcgtgggcgccagcgaacttcggcggacggaaggatacgaggacgtccttgaaggagccctcttccttcggcaggaagtcagcggactgttccttcggcaggatgatcacggcgacgatgccgccgaggaacatgagcacgcccgcgacagcgaagccggcagtcaggttttcgatgaagaatgcgccgatcatggtaccgatcggagcaccgatggtggagcctgcgccatagaaggcggacatggtgccgcggatgccagacggcacgcggtcagacagcacggcgaccagcggggcgatcatgcagttgaggccgaacatgcaggcgcagtagaagatggtgagcagcacggcgttatgcgtggtgccggtcaggaacagggtgacgccaccgagcaccgcgccgaaaacgatccacggagtacgacgaccgaacctggagcgggaacgatcggagaagttgccgaacatcaggttggcaaccaaggatgccaccgcggtgaacgcattgacgatgccaacgagagcatccggatcagcgccttcgatggtcttgtagtgcatcggcagcagcacggcggagacgatgccgagacccgacatccacaacacgccgaacagcaggaagcccgcaccgaaacggatggtgttgaccttgctcagtggcttgccggtttcaggagacagctgcggatccttgtctgcagcggcgatgttggcgttataacacaccaaacgctcctctttgtttgcgattgcttcactcatgaaaccctctccttcgattcatgtttcagtagtgttttctgtgatattcctgttttccgatagggcttctctgcccagccagctaactaccatttggtaactagccggttttcgtcatagatgccctttcgaaagaacgcaagtcagacgcgaatttttccgacggcagcgttttcaaatagcaatccacaacgattcgccccatacagcaacttcagtttttattacttagtaactgcttagttaaagcatattacaatctcttgtatctgtcatttgccggcgtgtcccaacgtttccaacacacttcctctcccccttcttgtaacttagtaagcacaagagaggagaacgcatgcgtcgccacatcgaaagcaaaaccaagaaacgaatgagcgcagaagaccgcaagaaagcgattctcgaaaccacggtctctttcatctcacaattcggattctggggatttaccattcgcgacgtggcacaagctcagaacatcaccgaagcaggactcctttactacttcaaatccaaagaacaactccttgaagcgacactcaaatacgccgatcgcactaaccaaatcgccattgcagagcatcttggcgtcgaaggcgtgaccggcgaagtcttgcaagacggcatcgcataccattgcgatctcggactcaaggccatctccacgggaaccgtggaaaccaacgcaggccgacccgaaatggttcgcctctacaccctgctcgaaagcgaggccctaagcaaagaccatccggtgcacgagtatttcgaacagcgcgaaatcaatctgctgaaggaatacacgttcgcagccaaacgagatggcgtcgccgatccggaacgcaccgcactgcaggtgctatccgccatggaaggcttgcaattgcggtggctcaacggatctcacgatatcgatttcgttggagaatggaaggccctgatcgaccttctcattccctaaacgttctcttctcgagttctcttatcgcagatttcagccggcgatcaccgcaacattccagcggccaatcgtcaacggatcaccctgcttaacggctgcaccttccttcagcacgacttcagcatttgcaacctcatcaatactgccgtcggtggcgatgacgaccggagcgaccactacttcacccgcaatcgggcttgcaacagtaacttcgtcggcggaatagttgagcaaatacgtcacgttctcgccgagggcattcacaccctggcgaaccgcgacctgtcccgcgagcgcggttccagcgccctcgacgccggcatgctccacagcctctcgcataaccgcacgaatggaatcggcgtcaagcagtgtggcgacccactcggcatcgcccttgccgaatgcgtgacgggtgactgcggcgtaatccttccaagcgtagtgtccataagatgcgagcacctcagtatcggcgtcggcgttcaacagttcgatcagcgactgagcatcggtggacgcggtttcggcgagcgcacctgcgaattccacggaaacgtggccgtttgggcgggtgaactggttgtacgtcatgccgaacacgtcggtgagattgtgcggcgcgcggtcgtgccatacggtcacctcgtcgtcggtcacgaaggagcgcatggtggagacgaggtgtccgccgttggagacgaattcacgcaggcgatcggtcgtttcctgcggagcacagtacagcgccggggtcacaatcatctcgtatgaggccaaacgctcggcgggagcgtcggaggggatgaaatcgcattccacgttgagctcgaacagcgcgtcgtagacattgcgcaccacgtcgttgtatttgagggtgccgccgaatgggaagccggcttcgatgaggaaccagtcgagcgcggtcagcgattcgttgctgaccatgatagctaccttgttgtgcttcttcaggtggacgagccgctcccccacttccggtttggcaatctcgcgaccgaatacgccggcttcgcggtacgtggggttcggttcgaggtcgtggctcagcaggcccttccaatatgtttcaaaggaattatggatggagtgccagtgccagtattccaccatgtcggcgccggaggcgagatgggagtaggcctgcaggcgcagctggccggggaatggcacccagccgtgctggccttgggcctcggtttcgagcaccaggtagttctggccgttcttggtggagcgggtcatgtcgccgccgaaggcgatctccttgccggtcaggtcgtcttcggtcgggtggtagatgtccacgccggtgatgtccaccgcggtcgcggccttgaagtggtcgacggccggctgcacgccgtaggagtatccgcgccattcgaaatcgaagttgtgggtgatgaactggtcgtcatgcgcgtattcgcgcacgatgtcggcctgccactgcaggaaggcgcgcacctgatcgcggcggaacttgtcgaattcgccgcccagggactcgttgatggtggcggtcacgtccgggaagtcctcccaggagtcgatgcggttggaccagtagtcgaggccgaagtggtggttgagctcgttcagatcgccgtggaacttctcgcgcagatacttgacgaacaggcgctgcatgtcctcggagacggaatcgtagtatttcgtctcgttgtccacctggtagccgatgacggccggatggtcggcgacgtgggagatgagcttgcggatcacacgttcgccgtagaagcggtaggtggcgttgacgatgtccatgatctggcgcgcgccatacttgccctgtccgttcggcgtgaccgcgagcacgctcgggtcgagcttgacgagccagctgggcaccgcgtaggtcggcgtgccgacgatgacatcgatgccggcacgctgcgcggcgtcgagcgcacggtccacataggtgaagtcgaatacacccggttgcggttcgcaggtgctccacgtggattcggcgatgcggatgacgttcagccccgcgtccttcatcattttcatatcctcatcgatgcggtcgatgcctttcatcatgaggtattcgtcatagtatgctgcgccaaaaaggatgtggtccacttcgttgcgactcatggttttcttgttccttacgtcttcgctgactacggtcgagatttttatctaacaagtattagatataagaaatatattatctgcccgcacatatgtcaagaggcttggaaataaggcgtgtcttacctaataaacattagatatacgaccagccgctactttttaccggtatccgtcccataccggagagggaaaaatcaaccgttcgaaggcgagccattcgtcatacaggtcgatcggcggtttgcgcatccaccgcagctggataccgtccatcgcctcgatgcattgccgtacgatcggccgcatattatcccatccgccgacttccggaggcagtttccatgcgaactttgagtaatgctcccacgtcagatccggtcggttttcgaaatactcgtgcagtggatggtccgcgttgaacgattcggtttccaaaaccatgtacagctgcagcagactgcggcgttgcgcattgtagcggaccagaaaccgcagatatgcgggaaacagcatgccgtcagaatcgctgccgggcaatcccgacttggcgaagtcggcgggtgtgccctgctggtcgtagctatcggtgaccagcagcgacaacaaccgctccttgttgccgatgtagtgcagcagtccgggctggctcatgccgatggcgtcggcgatgtccttgagcgacgtgccgtagtaccccttctcgccaatcagcttacccgccgccgcgatgatttcgcgtttgcgctcttcgggcgatttacgaacccgctttttcccctcggtaaccatatggaacagcgtaccatcggacgggccctcggccggtcacgcctggaagacgtccggatgcttcgggtcgcccggttcgtcggcgagcacaccctcaaggccgagaaactcctgccagaattccaacgaattgccgtatgggatggcctggcttccgcgcgcctgcaggttcgccttggcctcgaacacgtcctcctcgcggatgccgtcgaagtagctttccagtcggtcgagattcgtcggatcgtagaacagcgagccgatgatttcagtaagccgctcggcgcgggccaccggcagcgaatcccagtggcggaattcgatgaagttcttcaaacgcacgtcgttgaagtgcgtggagatcacatggttgatctcgtacgcgttgagctcgcggtccgggtacacgtcgttcgcgttctcgtagaacgccggatggtgcagatcggtgccgggcaccgccagcgcttcgggcgtgtgcgtcaggtcggcgaacatcatcggcgtggacagcacgtccaccgcgtaatcctcccaaccgaaacgcggatcgaacaggccaggaatgacgttcgtgcgctggaaatcgagataatcccacatgcgctggcgtagcggcggataaggattctccccaccttcgaaatacggagtgttacggaagaaccatgccagaatcgggccgatcaccgtgcccaaccgcagtttggcgatcgcgtcctgttccgaaacgtagtcgatgctgacctgtgtcgaagcggagcaacgcatcatgcacggaccgaactgtccgacacgtcccaggtaggcggtcatcgccttgtatcggtccttcggattgacgggaatgtcggcgtaactggatttcggttggtaaccatagttgacgagtcggaaaccaagttcttcgaggatggggtcgacttcgcggcggaacgcgccgtacaatgtggcgagctcctccggcttgtgcaggatgccgatggacgtttccaactgtccgcccggttccaaagatacggagatgccgtcacgggcgagtccgaccagtcgcccgttttcccagtattccttgttttcgtcgtaatacgggcggatgcggttgaacaacgcttcaatgccgttgctttcgtagtaggtcaccgcggtatcgtcgctgttatgtaccggcaggtgttcgatttccacgccaaaaccgccggtgccgcgctgttggcagccggattcgaagaatttgataaggctttccacatgcttcggattcggctcggtcagcaggtgcgcgtacgtgatctttggcgttgtcatagtggccatcctaacgaaaagcgccattcgcaacgcaggctacgctatacggaaaatcgataaccgaccatcattccccatcgatttggctggcgatttgaatgccgattcgacgaccatcgattttacgatcgccgaatcagccgtcgatttggcggctcagataccgtcgaaccgacgtcggaaagtttcccaacgtcggttcgacggaaataagaatggcgattcaagcggccttctcgctgttgcgcgcctcttcggctgcgcggtgcgccttcttggccgcggagatcatcagtttgatgcggttgagctggttggcttccgaagcgcccggatcgtaatcgatggacacgatgttggcttccggatgcagtcggcggatcttgccgaacatgcctcggcctgtcacgtggttcggcaggcaggcgaacggctgcgcgcacaccacgttcggacatcccgattcgatgagttccaggatttccgcggtcagcagccagccttcgccggcctgcacgcccacggacgtgacctcgtcggccttcttgaccagttcaggcatcggcagatcctgcgaaaacttgccgtgagccagatcgatcgcctcgcgtaccggagcgttgtacaggtcgaggcccttgcgcatcagcgcatagccgatcttgctgccgcccatgccgaggtaatgctcgttccagtcggaaatgtacggtcgggtggtcatgaattccatgatgcccggcaccacggcctcgcaatcctgcgattcgatgacatcgaccacatggttgttggcgtccggctggtacttgacgaggatctcgccgaccacgccgacgcgcaccttgcgcggctcgtccttcaacggcaacgagtcgaacgacttgacgatttccttgacgagcgtcggatacggcaggtatcccttgccgatgaacttgcgcgccgtcttggaacgaccgtggttttcgagcgtctcgcgcacgatggtgtcccacgtttcgtacagcttgttcgcgctgccgggggtcacttcgtacgggcgcacgcggtacaggcatttcatcagcaggtcgccgatgataagcgccttgactgcacggtgcagcagcgccggcgttgcggtgaagcccgggttgtcctcgatgccctgcgtggagatggcgatcaccggaatctgcggataaccggcgtccaccagcgccttgcggatcaggccgaagtagttggtggcacggcacatgccgccggtctgcgtgatcgcaagcgcggtgtggtccggatcgtatttgccttccagaatcgcgtccacgagctggccgatgaccatgatggccggatagcaggcgtcgttgttgacgtatttgaggccagtttccacgtcctcacggctggcgtgctccagaatgtcgaacttgtagccgccggagcggatgacggattccaccagagagaagtggatcgggctcatctgcggggccacgatggtgtagtccttcatgttcttgccgaacgggatgcggttcgcatacttggacagggtcgccgagttgtgtgcggacgcgcccttgccatttgtctgcgttttggcggtttcttgcgattcgcccttgccgttttccgccgcgcgcttggatgcggccgtgacggcttcggtgagtttcggattggctttcatgacggtgtcgagcatgacctggcgaccgggggtcggcgcttcggtgccggtcttgcggaatccgtcgttcttcttgttgcgttcacgctcttcgacggcggccttgagcgagcgcagacggattttcgccgcgcccaggttggagacctcgtcgattttcagcatggtgtacacgtcggccttgtccgccaggatctcggacacctggtcggtggtgatggcgtcgaggccgcagccgaaggagttgagctgcacgagctcgagtcccggataggaggccacgaaatgggccgccgcgtacagacgcgcatggtaggcccactggttggtgacgcgcaatggcatcttggtgaccttgcggtcgtcgacgtggcggaagccgttcgcgttcttcttgcggggatcctcttcgccttcggcgaggaattcgctcaggttgagcttctcccccggctgcagttcgcagatggagtcttcggacagcaccaccatgccgagcgcgcagatggtttccggaatgccgtggttgatttccgggtcgacgtggtatgggcggccggcgagcacgatgcccttgcagtcgtgttccttcatgtaggcgagggccttgaggccttccatctgcacgtcgtgcttgaacacttcgttttcggcgtaggcggccttgaccgcggtttcggcttcctcgcgggtcacgttggcccaggcgaattcctcgacgatgcggtccaccatgagctcatggttggccatgttgaagtacgggcgcatgtagcgcacgccttcctcgcgcagttcgggcatgttcgcgccgatgaccaccggatagttggccacgaccgggcagttgtagtggttgtcggtgttgggaacgaagttctcctcatagctcacgcacgggtagaagatcgtcttgatgcccttgttgagcagccacttgatgtggccgtgcacgagtttggccgggtagcagatgttttcggaggcgatcgattcgatgccggtttcgaacagttcgtgcgagctgcggccggagatcatcaccttgaagccgagcgaggtgagcagcgtgaaccagaacgggtagttctcgtacatgttgagcacgcgtggaatgccgatttcgccgcgggtggccttcttgtcggtcagacgacggtaggcgaagcaacgcttgtatttgtagtcgtacaggttgggcctgtcggaacgctgcttcttggaatcgccgccgcgttcgcaacggttgccggtcacgtagcgggagccatcctggaacgtggtgatggtgagcttgcagtggttctggcatagcttgcacacgtcgcgttcggtggtcatggacaggttgtcgaggtcgctgccggacacgatgctggatgcggtgtgcgtgacgccgtcgatgtcgacggtcttgcctccgtcggcgtccgcgtcaccatcgtcgagtccgtcggcgatgtcggtgtaatgcatgcgcgcggtcagcgcggcaccgtatgcgcccatcaggccggcgatgttcggtcgggtcacctcacgttcggtgagcagctcgaaggcgcgcagcacggcgtcgttgaggaacgtaccgccctgcaccaccacggtgtcgcccagctcgccggaatcgcgcagcttgatcaccttatacagcgcgttgcgcaccacggaatagcacaggccggccgcgatgtcctccatcgaggcgccttccttctgcgcctgcttgacggaggagttcatgaacacggtgcagcgcgagcccaggtcgaccggatgcgtggagttgagcgcggcctgcgtgaattcctcaatcgtcagtcccatggactgcgcgaacgtctgcaggaacgagccgcagccggacgagcatgcctcgttgacggcgatcgaatcgatcacgccgtcggaaatcgccaagtatttcatgtcctggccgccgatgtcgatgacggcggtaacgcccggcgagaccatttccgcgccacgatagtgcgccatggtctccaccacgccctcgtccaggtgcaggccggtggtgatgaggccttcgccgtatccggtggcgcaggagcgtgctatccacgcgccttccggcagctggctttgaatctgcttgacgatgttgacagcggccgtcagcgggctgccttcgttggtggcgtacgacgaccatacgatttcgcggtcgtcgttgacgagcgtcgctttgatggtggtcgatccggcgtcgatgccgaggaagtgcggaccttgcgcgccttccagcgtgccgatgtgcacatgctcgcggtggtggcgcttgttgaacgcctcacggtccgcttcggtcgggaacagcggaggcatggtgggggtgttggccggcagattcttcaggtcttcaaggcttttcagaatatcggcgcaggtgcgtgcttcgaaatgctggccctcctcaagctggtccggttcgccggcgagcagcgcggagccgaacgccacgtacaggtgcgcgtcggtcggcacgatgaattcgtcgactttgtcttcgagcgcgcggtggaacgcctcgcgcagttcggacatgaagaacagcggaccgcccaggaagatgacggtgccgtggattggtcggccggacgccagacctgcgatggtctgcgtggcgaccgccgtgaagatggatgcggccagatcgggcttggccgcgccgtcgttgatgagcggctgaagatcggttttggcgaacacgccgcaacgggaggcgatcggatagagcgtctcgtaatgcttggccatgtcgttgaggccagccgcgtcggtgtcgagcagggtggccatctggtcgatgaacgcgccggtgccgcctgcgcaggaaccgttcatgcgctgttcgggagtcggcttcagatatgtgatcttggcgtcctcaccgccaagttcgataatgacgtcggcttgcggatattcctcgtcgatggcgcgggtctcggcgatgacctcctgcacgaacggcacatggagattatcggccaaggcaaggccgccggaaccggtgatggccagacgaatcggctcgtcgccgcggccacgggcctcaagttctttgtggatgtcctccagcaggcccgccacggtggcacgcacgttggcgtggtggcgacggtaatcggagaagagcaccgcgtcgagcgaatcggtctgatcgagcaccacggccttcaccgtggtggaaccgatgtcaagacctacgcgcaacggcttcgtatcgcaggtgttgtctgcggtaactgctgcttcgaccatgtactgtacctctatcgttctcatccgccgggttgcgtccgtgccgacacgaacgccctgccccggttatccaagtatgtaatggtagtctgtgcccctgcctaattcggcacggtatcgcataaagcgcacgacacgacgcataattagacaacgaatatagtcagcttgcctaattccaaccgtccgtacacgaaccgttcaaaaccattcaggaagccgccccctcccccgcagcgcggtccttgccgtagatttcgggaatgaaccgcgtctgatcgtgtagttccgaccacagcaccacctgcccgctttccaacgacttgggcacatcgatgatgcgctggttggagctgccgcgaaactgcagcagcgaatcgtgcagatccttgatataccggccatccacgagaatatcgatctgttcgagcagttcacgcttgtcggggctttcgccttcgcgcatgagctcctcccacgtgtagcccgtccagcaccagatgtccttggtgcggccgaaccgctcccggatcttgcgtgaaagcggcagcagcacgccggtgttgagcagcggctcgcccccgaggaaggtgatgccccgcacgtacggcaggctcagatcggccatgatctgagcttcgagccggtcgttgtattcgtggccggcgcggaaatcccagatcgacgagttgtagcagccttcgcagtggaatgggcagccggagacgtacagcgagcagcggattccctcgccgtcggtcatgaggaaccgcttgtagtcggcgatcatgttgtggctcatcgcgttcgtccattgtccggcgcgcgggttgctggcgcggtttgtcggaatgaacggcccgcggccggtttcgccggccgcgaaatcacggcgagacacagcgggatcggcgctgcttaccatacgttgctcctgaattgcctgttgttttgcgattattgcgattgattacttggcttcctcgaaccattcgcgttcggaaccgtcgtcaagggtgacatggccggtttcgccgctcatgtgcttgacgcggtgcgcgatttcctcatgtcggccgtgcaccatcgggcgctgcaccggattgccgaggtagccgcaggtgcgcttggtcacgttgcagcggtccgggtcggagttgccgcattcggggcacttgaagccttcttcggtcggttcgaagtcaccttcgaaaccgcattcgtagcaacggtcgattggcgtgttcgtgccgagatagccgatgccgatggtgtaggcgtagtcccacaccgcttcgagcgccttcggattggcctgcaggcacgggaattcgcagtagttgatgaagccgccggacgcgtagtacgggaagtccttctcgtagtcgagcttctccatcggcgtgggctgcagccacaccgggtagtggaaggagttggtgtagaagtcgtggtcggtgacgccgtccacttcgccgaacttctcgcggtccatgcggttgaagcggtcggtgagcgattcggccggcgtggagtacacggagtaatggtagccttccgcggtgctccaatccttgcacagctcgttcatgcgcttgacgatggacagggcgaattccttgccttccggatcccagtcgtggtcgcgcatccagtccttgccatagaacacgctggtcgcctcatacaggccgatgtagccgagggacacggtggcgcgttcgttgcggaacagctgatcaacgctgtcgttggcgccgagacggccgaatgcgccgaagcggaacagggtcggggcgttgaccggagtggcctgcttgcaacgcatgatgcggaactgcaatgcctgatgggcgacggtcatgcgctcgtcgaagatcttccagaagcggtccttgtctccgtgggattccaatgcgatgcgcggaatgttcacggtgaccacgccgaggttcatgcggccgtcctcgacatccttgccggtcttcgggtcgatccagccctgcaggaaggaacggcagcccatcggcgctttgaaggagccggtgatcttcacgatgttctcgtagaagatgacgtccgggtacatgcgcttggtggcgcattcgagggccaactgcttcaggtcgtagttcgggtcgcccggatcggcgttcacaccgtgcttgatggtgaagacgagcttcgggaagatggcggtgtgatgctcggaaccaaggccgcggatgcggttgaggaagatggcgcgctggatttcgcgcgcgaaccagtcggtgccgagaccgaagccgacggtcacgaacggggtctggccgttggacacacggttggagttgatctggtattccatggtctgcatggcgtcgtagatggccttgcgggtctggatcttcgcccagatttcacgcagctgctgcagacggtcggacgtcttgtcgaacggctcgtccatcggcagtgccggacgatccttttcgaagtgcaggcgcttcggctcgacggccttggccatgcgcacctgacgttcggcgatctcaatcggcagatcgtcgggcatgatctcgtgggcctgctcaaggaacttgtcgtagtccttcttggcgtattcggcgaaatgctcgtcggcgcggttggcggtctggccaccgtactggctggaggccacgtccttcatgatctgggtgatctgcgtggcggcgatggagatactgttcggcgaacccatcggggcgttgccgagggtgaagccgttggcgagcatatcccagtagttcggcagcgagcagttggactgcgcggtgaacggcgagtaatcggcgtcgtggaagtggatgtcgcccttcatgtgggcgttggacaccgcgtccggcagcatggagaaggcggatgccttggacaccgcgccggccagcaggtcacgctgggtggagtagacgttggagtccttgttggcgttctcacgcaccagcgcctcgtcgcggtccaccaagcggcgcacggcctcgttgatgtccgtggccttggcgcgctcgatgtccttgttcagacggtagttggtgtaggtgcgggccacgtcgtacagatggtcctcgatgagcccatgctccacgaggttctggatgtcctcgatcttcgccggaccgttgtaacggtccttgatttcggcctcgacctgattggcgatgtcgcgaatcagccgttcctcctgaggaccgattttcttgtcgaggtcggcgaaagccgatttcaccgcgctgatgatgttgatcggatcgaaatcgaccacacgcccgtcgcgcttctcgacaagcaccttgaccatttccggcgcgttctcggttttggtcgcaacgccttccagagtctgggtttccatgtatatttcctttccgggccggacccatccggccaggtttcatgcttcgtccgcatgcccgttcgtacctacagatgcacactctacgccaaggttggcactaaatgtagtgtcaccacgccgctagagaaactatatattctacttttggcgagatttcgccattttttgccttgtgtgacaaaagtaacgatttcatctcggagtgtcgttttgacacagccccacacaccgtactatcttcacgcacggagcattcgcaacactcgaacatatgttccatttgtccgcaagatgatggaatcttgacttatgacttggaacccggattacaacccaccgacggcgcagcggacgtcgaagccgctgccccgtctggcgtcggaaaccaccgccgacaatccttggccggtgagcctgctcagcgagaagttctacacggcggtcgaacgttggccctccgtatgggtggccgggcagatcacgcagatcaacacgcgtcgtcagggaagcgcctacatcacgcttcgcgacgaccagcaggacatcgctatggaagtcaacggcttcggacggttcgccgcggcggcggcgccgtttgtgcagggcgaccgtgtcatcatccacggcaagccgaacgtgtggatgaagcgcacgtcgctgtcgttgcgcggcgacgcgatcatcgcggccggcgcgggcggcagcctgaaggccatgatcgacgagctacgcaagaagcttaagggagaaggtctgttcgacgccgatcgcaagaagccgttgccagaatttccgcattgcatcggcttgatctgcgcgccgcaggcacgtgcggaaggcgacgtcatcaccaacgtgcgtctgcgttggcccgtcgtcggcttcaaggtgacgcatgtgcacgtgcagggcgagcagtgcccgtcggacgtggtggcggccatccggcagctggatgccgatccagatgtggatgtgatcatcgtggcgcgtggcggcggcgctttcgaagatctgattggcttttccgatgagaacgtggtgcgcgccgcggcggcggcccacactcccctgatttccgccatcgggcatgaggacgattggaccctgctggatttggtggccgacctcagggcctccacgccgaccgacgcagcgaagaaggtcgtgccggacgtgcatgatctgctgcagctgattcaggtgaacctggaccgcatgcgcgtgcgcatcgacgccaccgtctccaacgagaccaggcttatcgaaggctacgcgaaccgtccaagcctcacccagccgctcaccatgttggaaccgcatcagcgtttccttgatgacgcacgcacaagaatgcggatcggtctgacccgtattcttgacgacgcgagcctgaccatcgagaaagcgcacgcgtcgctgaccgcgctgagtccgcaatccacgcttgaccgcgggtacgcggtggtgcaatgcgccgacgggcatgtgcttgacgacgcggacaaggtgaagacgggcgaccagctgaccatgaccttgaagcacggcatcgtcgtgtctgaagtgaaaaccgtaacgaaggagtagcacatgagcaacgaagcagcaccggcatccagcctgaccgacaaggaacgcgaagcaatcgcgcagatgccatacgaggaggcgcgcgacaagctcatccaggccgtgcaggcgttggaggcgggcggcctgaacctcgaccagtccatgcggcagtgggagatcggcgaggcgttggccaagcgcgcgcagagcctgcttggcgaggtccgagccaagctcgacgccgcgcaggccgagcaggccaccgcggccaacaccgcaggaacgcaagacaatctggcctgagcatccgtcgcggcacagccgctcccctcacctacggacgttccaccggaacgtccgtcaaacggcttgagcccgaacaatcaggtccgattacccgtcatgtcgagtccatattgtgtgtacaatggtgactcgttgcctcagtagctcagtggatagagcacttctctcctaaagaaggtgtcgtaggttcgattcctatctggggcactttttcatatccccgtacattgtcggcgcgcaccgccatcggcagcatccaagatcaatcgcacgtccgcaatccggacaacaccatctcaccgccaccctccagcacaggcacaatgagcatccctctgttatagtggcaaacggatacttaagcggttgagtgaatgtatccaaaaggttcccccttctgctatggaagcatcggaaagcaaccgcacaacccatacatcacctttggaagaccaagggatcagcatgcaagacataccatattcctctattgtggaacggctggcgcacacgaatccggtaggacagttgcccggaccgctctcctacaagctgctcgaccagttcaccatgccgatgctgcccacagaaccgcaatgcacgaacgtcatcgcctgcatccgatattcgaataacatgccggtcgtcaccgtctagccgcggacttagccgacccgcacaatcgccagcagcgccttgtggtcgctgccgtccactttgactgtgcgcacctgtccggcctgcatgccggaatccagtacgatatggtcgattccggcgaacgacggcacgtaatcgacattcgcaggccatgagaatttcaatccctcgccggcctgacgggaggcgtcggagaaacggtttcccagaatgttgcggaacggcgtatggtcgtacgtcgcgttgaaatcacccatgaaaacgtaccgtcggctagtgtcgaaacgtagtttcgccagttcgtcgagcgaccgcttccactgctgccagtaatcgttcgtcggcgacgtggtatgcacggatacgaaacgcacctgcgtggctcccccattgaacgaaacggtgccgcccggcatgaacgacgcgctcgaatcgacatcgtcatcggaagggtcgtcaagcggactcgccgaccaaaggccgttgccgtacacgccgtccgaactcgacacctgcgcatagggcagatacgaggcgatgccggcacggttcagatcgtccacgaaagcgtcggtcgtctcctgcaacgcaagcacctcgacgtgttcgctgcgcaccagatccacgatctcacgcgcatcggcgcgccctttgtacacattgcacgtcatcagccgcgcgtagccgtcatccgtgttgacggtttcgccggacgccgccgcgactgcggcacgtggcagtttcgaaggctggtagaagaacggatactgccagaacgtctgcaacgcaatcgccagaacggccatcacgatggacaccgtacgtttggagatgatggcgcagacgagcgcgattacggcgagcagcgtgaaccatggcactagggagacgacgatcggcatatacggcaacgcctgcagttcttccggcagcatgtgcgtgacagtgcccagcagcgcggcgagcgcgaatatgaaggcaatcaccgcgcagatgaaattgcgtacgcgatgcgttttcgtcttattcagcgtgcgtagcggcttgaccggtctcgttgcggccggttttgctttagcccgattcgctttggccgacgcttgcgatttgcccgttgccggcccttgcggctggcgtgtttttgcctgagccataccattcccttgttttttcggaacgcacgtccgcgaccatccatgtccgcccgtgtccgtttatgtccgttccgttgatgttccgacggtttccttcacgccttcggcttagtcgtcgaggccgagctcgtggcggatgccgtcgatgatgatgcggctggcagtggtgccgcgttcacgcgcgttttcctgcagcatcattttcagatcggatggaattttgaaactcatgagcacacgttcgccgttgccgttgccattgccacggctgcgggtgtcctgcacgctggtcagcggagcggtggacgctgccttcgcaccaccgttcggttttctaatggccatcaggcgatcacctcctcaagttcgctgtagacatcctcatacccgttgagattgctggggaatgcatggccgattaccttctgcatgcccaccctcttgggtaccgaggcatcgaagacgctggcaccgcgttcgcggatgagattgaccgcgttgcccgccagtttgttgttctccactttgagcagcagcagcgcgtacggcttgccggccgcgtcgaggctttccgcggtttccagcgcgtggctgagttcgaatgggccctgcgtcgccggcacgatcacgaaatcagacacatcacaggccacgtccaccacgttgccggccggcgggcagtcgatgatgacgagttcgtcatccgccatggttttgcgcagtcgtttcagtttgccgatattggcggagtccacggtgaacggcagggtttcgccggcgtcttcggcgtcgcccgcccatgtggtggcgtcgccttgcggatcggtgtccagcacggacacgttgcggttgtgccgtgcggccgcggtggccaacgccatggcggtggtggttttgccgctgccgcctttgaggttgatgaccgagatgatcatgaaggttcctccgcttcgacaatcaatttatataagacgtatatactttttatatattggatagacgacagtcacgctgacggcgtaacggcattggcaatgtaaaaaatagcggcgacgcactcttgccagttgctttgacgggtaacgaaaaatcccgaggagctcagctcaactcgggattcgaaaagagtaaacgcggcgacttgctactctcccacaccctctcgagtgcagtaccatcgccgtgctaggccttagcttccgagttcggaatgggaccgggcgtctcacctaggctatgatcaccgcaagagaaaacaatacgcgaacatgcggcaatcggcaaacttcggcgtgtcgcgcactgcaatcgcattccccaatcgccaatgatcgccagtaatcgcgcgaatgccggcaatcgcaatgcatatgcgctacagtcgaagcaatgccgcaacaattgcggcgtgcttacgaaagaaggccagcaatgacgatcgcctcctgcggttccgtttccgcaaccactttgggtctgccgaattccactgcgattcccgccgagaaggcgaggctgccgaaaggcctgttcgtggcgaagattccggtttccgccaaaacaaagcagcgattggcgaacgacatcgaatcaatcaccatgctgtcgctgctgcaggcgcgcaacacgaagcttgccgccggtacgcgcgtgccggaaatactggtgatcggcctgcgtttgcacgaaccaaacgccgccgttccgacggatatcgtcgaattgattgcgatgcaacgcaagtcgggcatgctgttcgtttgcgtacgcgacgccgatttcgaaggtacgacgcgtcaggagtgcgcgttcgccgtccgtcgagcgctgccggcacgtgccgggcacacgaccacatccaaggtgttcgcttccgattggcagccggccggcgaggccacgctgaacgccacggatccggcggtcgattccatggacgccttgtgggagtcgctatgctcgcaggtgattctggacgacccctcccccatcgacgtgaacacgcgtcttgcccgacgcatgcagattgcacagctcaccgcgcaggtcgacaagctcacccgcgaccatcagcgtgccaagaatcccgaacagcgcaatgaaatctacgcgaaactgcacaagatgaagcgccagttggaggaactgcaagggcaataataccgccataatacaaagctcggctgtaatcgttgtgattgcatgcgattacagcaaccgcaacgcctatagccgagccgtaagcgaggtttggcaacgtgaccaaagcgcgctctcaacaacgcgccacagccgcgaagccgctagaaaccaagtctggtgcggccgaactggtcaagccagcgcagaatcgcgccttcacgcagcgcccacgggcagatttcgatttccttgacgtcaagcgccttcatgatctcatcgatcaccaggccgccgccgacgatctgatacgtgcgttccggcgtgacgcccggcaatgcggtgcgctggtccggggcgatggccgcaagacgcggtagccaatcctcgagctggtcgatcgtcatgatcgacgtgtccacacggcccggttggcgcatcaccgcaccggcgagacgggccagggagcgaatcgtcttcgacgtgcccacggcatgcatcggatgcttcgacttggggaacgccttgaccattggctcgaggatcttgcggatgttcttgcgggcagcttccagattgtcatcatccgcgacgccgctttccggcaggaactcgcgcgtcacgcggcctgcgccggcaggaacggacagtgcgactgtcggatcctcgtcggagcccatggccacttcgagcgagccgccgccgatgtcgatgacgagcaaacggccggcatcccagccataccaacggcgggcggccaggaaggtgagtcgggcctcatccacgccggacagcacggtgaccggctggccgatggcctcttcgatcttgcgtaggatcttgcctccgttcggcgcttcgcgtagtgcggaagtggccaggaccagcagctgggtgatttcgtattcttcggcgagtttcatcgccttttcaaccgcgctgagcaaggcttcgatgcctgcttttttgatgctgccgtcatctttgagatactgcatcaggcgaatggtgcttttggtgctggcctcgggctcggggcgcgcgcccggagccgcgtcgacgatgagcatgtggacggtgttcgaaccgatgtcaagcacgccaagtcgggtggcgtgcgaatgcaatgtaaccatggttcacagcttaataacttaagcgattaacctattgcacgacatgccttgataacctttgcaaatatgcccaccctcggaaaggagggtgggcacccaataatcacagtgcgggaaacgattgcatcggcgtgaaaaatcgcgcttcaggcatatgtttcagccgaatatctcaaccacgcacctcagccacgcactttggctacgaaatcaccgagtcgcttcaatccttcgcgcagggcttcgcgggaagccgcgtacgacaggcgcacgtgcgtatccgcggtggcctcgccgaaatcgcggccaggcgtcaacgcgatatgcgcttccttcagcgcacgttcgcagaacgtccacgcgtcgagaccggtgccggaaatgttgaaatacgcatagaacgcgccattcggctcaacctccagcggcagaccgatctcggccagaccgtccaccacaatgcggcggcgctccagcagttcctgacggcgttcctcgcacacggccagcgtttccggcgtgaagcaggcgagcgccgcatgctgggtcggcgtgtgcgcgcacaggaagaagttggtggcgaggtcgtccatggcttcgagcgcgtattcgggcacgaccatccagccgagcctccagccggtcatgccgaagaacttggagaagctggagcagacgatggcgtccggatcgcaggccagcacggatttcacgtcggatccgtccggttcgcggtcggccaggtcgaggtaggtctcgtcgacgatgcgccatgcgccacgctcacgggctaggtcgcacacggctttcagggtgtcgaaggcgatggtggtgccggtcgggttggacggcgaagtgatcatgacggccttggtgcggtccgtccagtattctttgcacagttccggcgtcaggtggaatcgggtggcggcggacgccggcacgtccacgactttgccgccgaacgcgcgtaccagctcgcggttgcacgggtaggacgggtctgcgatgagcacttcgtcgtcatcgttgaccgtcagcgcggcggacagcagcagtgccgtcgaaccgcctgcggtaatcgcgatgcgtttcgggtcgacgtcgacgtggtgacgttccttatagaaatcggaaatcgcctggcgcagttccggcaggcccatcgccgcggtgtacggcagcggacggccgtcatactgttcgcgcatggcgtcacgcacggccggcggcgcgccgaagtccggctcgccgaggctcagcttgaccacatcggtgccgttggcgatcatctcatcggccatggctccgaacaccatggcgcggaacggattggcaatctgcgcgcgcttcgacaactgcggctgcacgccattctcaacattttccatattcctgtttttaccacgtttcgtacaacgccgcctgccgactgtcattccccggaatcgtccgcctttccggaatcgtccacgatttcgcggtaaagccgttccaaccgttcgtcgcgcaccttcttaccgagctcgcattcccacaccacgatgactttccagccgtccgcttcgagttcggcgcgctgcctcgcgtctcgttcgtgattgcgcagcagtttcgcggtccagaattcgacgttcgatttgggcacgcgtgtggctttcggacagccttcgtgcatgtgccagaagcagccgttgacgaatatgatcgtacggtatttcggtagtaccacgtccgggtggcctgggtatcgcttgtcgtttttgcggaatcgcaagcctttggcaaacagaaagctacgtaccatccgttcgatggatgtgtctttgccgcggatgtgggacatggtgtagctgcgcgtgccccgctcgtatttttcgggtttgccggtttttctaggtttgccggttttcttgggtttgccggtttttccgggtttggctgtctgcctgcgatgctctgccgtcacggcttcccattatggcaaaagggccgatcaatcgttttcgcataacgcgtgccgccgtcgcatgtggcgtacgctggtcattgcaacgtagcaaacaggcagttcaaaacaaggagatttcatggcacagatcaatgtggcgattctcggcgcgggccgtatcgcgcagagcatggccgaaacgttggtgaaaatggcggcggatgaccggtaccgtgatctggtcgcaccgtacgcggtggcggcccgcgacggcgagcgcgcagcggcgttcgcggcgaaatacggttttccggtgtcgtacggatcgtatgaggagcttgtcgccgatccgaacgtgaatcttgtgtatatcgccactccgcataacttccatgccgagcaggcgattttgtgcatgcgcgccggcaagggcgtgctggtggagaaggcgttcggcgcgaacacgcagcaggcgcgtgagatattggacgtttcggatgagaccggcatgctgtgcacggaggcgatttggacgcggtatatgccgtcgcgtggcatgatcgacgatatcatcgcgtccggcgtgatcggcgaggtgcaggcgatcgacgcgaatctgtgctatccgaccacggcgaaggcgcgtatcaccgatcctgcgctggctggcggcgcgctgctggacgtcggcgtgtatccaatcaatttcatcgacatgatcatgcataatgcgccgatcgcacgtgttgaatcgtcgatgcaaccgtatgaaaccggcgtggacgcgcacaattcgatgacgttctattaccagaatggtgtgatggccaccgcgcaaagctcgattctgtgccattcggaccgtatgggcgcggtgtggggcacggaggggtatctcacgtgccagaacatcaacaatgtcgaggcgattgacatgttcgacggctcgcatgccgtcaccgcgcattatgacgttcccgaacagttgaccggctacgagtatgaggtggcatcgaccgcacaggccatgctggacgggcgtaccgaatgcgatgagatgccgcattccgacacgttgcgcatcatggaatgcatggattcgctgcgtgcggattggggtcttaagtacccgttcgaagcgtagcgatgcgatcgatgacgtgggcgtgacgcgctccgcccacgttataattgccccttgcggcggtttggaaacgcatggaaggagcgtcatggaattgctgaggatgctgaagtacgtgctgggcacggaagatgagacgcagcagccccggcaaacgcaatcctctgccaagaatgccaacaacgccaaacctgcgcggaccggacagaccaagcagacgggacaggttgcgcgacgagtcacgcaaccgcaactgcaaccgcatgccacgccgcaacgtcaatcgcaacgccgtcaatcgcagcaacaccaatcgcaacggcctgcaaagctcaccccgcaaccgctgttgccagccgaccgcatcgacaaagcgcgtgacatcatcggcaatatcgaaaagcacgaattgagcgacgagcagatcagcgcgatcgccggcgcaggtcacaacaccctcgtgcttgcgggcgcgggaaccggcaaaaccaccaccatcatcggatatatcgcatggctgctcgccacgaagcgcgccgcccccgaagagattctcgtattgtcgttcaccaaggcgtccgcgggcgacatgtcgcaacgcatcatggcaagcaccggcaaaacgatccgcgcatgcacgttccacagtctcggcctggaaatctgccgtgcggccaccatcgccaaccgtcccatcatcgacggccatgcgtcgaacgccgtggtacgagacacgtttgaccggctgctcgcacagaacatcccctaccgtctgctcgcattcaagctcatgtcgaaggagctgttcggcaagtatggcgccgccgcgaaacgtgaggatttccaactgccgacggatgattacgctttcaaccagtacaggcaaagccttgtcgaaaacgcgcagaccatcatccagcacatgcggcagaacaatatcggcatcgacggcatgcgcgagctcaatgagaggcgcggcggcaaacatatcggccgtaatcgtgagatgctgcagctcgtcgagccgctgtacaacgcgtatgtcggcaatttccgcgcgacccagggcatcgattttcccggtatgatcaccgacgccattcgctgcgtaaggcgcggcgcgtaccgtcacctgtacaaatacgtgctcatcgacgagtatcaggacatgtcgcggccacgttacgagctgatccgcgcattgcgtgagcagagcgatttcacgctgttctgcgtgggcgacgactggcagtcgatctaccgtttcgccggcagcgacattcatctgattctcgatttcgccgatatttggcgcgattgggggccgacacgcatgttccagatcacgacgacgcgacggttccggcagagtcttatcgatgcgagcggcgcgttcgtcatgcaggacaaaagcctgtacgccaagcaattgcgcaatccgagcgacaagaaggattattcgctgaaggcgcttggcggcgcaacgcaggaggagcgcttcgacgcgatcatcgagcagttacgcaagctgccgaaaaccgcgtcggtacttatgctgggacgttacaaaagcgatctgaatctgctgtcacgcaacgatcgcgacggattgttccagattgacgagcacactggtggcattgtgttccttgagaagccaaagatggatatcgagttcatgaccgcgcataaatccaagggtctgcaacgcgacttcgtttttctgctgtgctgttccggcggtttgaaaggcttcccgagcgcgattccggaagagccgctgctcggcctgctactgccggaagtggaacgcatgccgcacgcggaggaacgccggctgttttacgtggcgatgacgcgttgcaaaaagaagctgtttttcgtggtggaccagtcgcgtccgtcacgtttcatgtacgaattgcacgacaagatctgcccgaacatcttccgcggcgtgaagctgccaccgcagtgcccgaattgcggtgaggcattgcgattgcggcacaccggctccgacccgtcccgcacgttctacggttgcaccggcttcccgaattgccggttcacgcagcagtgcaagtgaaagagtgaacgaacaagacacatactccttttgtgtcgcacgattctatttttcggctcttttttggaatcgtgcgacaaacattcggcgacacatacccccaaaccacgttttccaagccaaaaacacatgaaagatacacttagaaggtatttgtggggttcaatttgtgtcacgattcaaaatttcaccccaaaatcggaatcgtgacacacgtatcacactccctgtcgcatatttcgccgcgcatctactcaaattgagcaagcaacgtttatcctggaatcaacaggatggtgagaatggcagaacggaataactggacgcgtgaacaaaccatgatggcgttcgcactgtaccgaatcctgccctctggaaaatgggaccagcataatctaactattcagaaactcgcagaccatatccatcgttcgccttcagcagttgttttcaagctcggcaatctagcctcccttgacgagaacaggatgaccaaaggcctaaccaaccacagcaaattagaccaaaaaatatgggacgagtacgcggaacgcggcgatgctccggtgttcgaatctgcccagctgctggcatcggcattgaacggcgcggacgaccatcccgacacgcacgccgattccgtcgtggaacaaatcgtcgcgccacgagtcggctacgaccgtccggctgtggtcacagaacgaatcaaccagcagtatttccgcaacacgcttgtccacaactaccgcgaccgttgctgcatcacaggaatcgcgatcgacccgctgctcatcgccagccacatcaaaccatggaaggattcgtctccaacggagaaagtggccgcatcgaacggcctgttgctgaacgcgttccacgacaaggctttcgaccagggtctgatcaccctcgacaacgatttcgcgattcatgtctcgccgcacgtcgagcacacggagatcaatgacgaatggctgtaccgttacgatggacggcgcatctccctacctgtcgtctgcagcccatcccgagaattcctcgaattccatcgagagcatatttatcaactttgattccgaagcacccctacaattagctatcacggtaatccccgacgaggaggaatatgtctaaaacagcgaaatcagtcaaagcgatttgcaggaaatacgataagttcctatgcgtcgaatccccggactcaaatgcactgcttttcccatcgattgcagtttccagctttcgcaagcccgatatagaacaggcgctggaaaagcttttggaaatcacaaataatgacgagctcgcaatcagcaggcagctcgccgaaggacaaagtacgaatccacgttattatctttgctattgcgattacgaaatcaacgtccttgccaacggacagcgtgccatctggctcactcagcaagaaatggcataccacaagtggattccggaagaccagaagatggcagaccttgtcatgtctccgcttttcgaaaaaagtccctatacaacgaagacagcagtccaactacgggccaacgatgcggttggcagaacattggaagaaatcgatttcaacaacaccgaaaaacaagggaataaaagctatccaggcaatgtaattgaacatgtctggttcgaccatcccgccgacaacatttctgcccccgatttccccgaggctgaagtcgagcttaaagtctccccaatcgatatcaagaaaagcaaggatggtccttcttgcattgcaggagaaaggctagtactcaataccatcaattacgctaaagaaagcactgccgatttcaggacaagttcgttttggaagaaaaacagattcattgaattaatgcagtatctgcgtcgaatcgcctcagaaaaagggcagtctgaagataagcgcaaatataagatcgaatatgcccaccttttagctatggactgttttgcagaacccaattttccgcaaaacagtctcctgcctctcagcgaagcgaccatgctcagaatcgaacaggattggaacacgattcatcagttcatagtcgaaaaccgggcggatgaactgaccgaaggtatgaccgatacccttgcagcatgcactaaaggagcgaataacaaacagaaaagcaggcagagcaatggtgcaagagcaaaatccagagcttactgtttcaaacaaagtttcatgacgtcacttttacaaaactatgcatctgatgtccacgaaacgacttctctcatcaaagatataaagcagctgcaaaacagaagctgcgatagcattattctggattatttcaacccttttaaaggaaaatcatttacggaaatcgcggaacaattccatttcaccatacctaaaaacgcatctcctaaacaaactaatttcatgctggttgagcatatgcttggttcaaataccagtatttccaaagaccccaatgatgattacgtatcgtttgacgccgaagagcttaaaggcattcgagtcaaaacgctgccgcttttccatggaaaaccttccgaacaatttaaggtccaatccattcccgatttcaacgatctaatcaatcaaaaatgggataccgataactgcgccctgcatcaacttctggaaaccacaaaattcctcgtctttgtttttgacagccaaaaccccaatgaaaaagacaagaatccagaaaacatctactttaaaggtgccgcattttggtatatgccggcatccgatatcgacatagtcgaacaagtctggaaggaagacgttgaaaaactcagaaacggagtgactcttcgatacaagggcaatcgagtttacaataacttcgtcaaaagctctgcacatcgcgtaattcacatgcgtccggatgcacgcaaagcacagtacaacaagccgacgctccgtgcgcaaaattcccgtaaactgcccgcaaaagcgcactggataaataggcctgccgaccatgaacgctatacggaagaatatatgaccaaacaggcttggtggattaacggagcttatctctatagccaaataaaagacagactataagcgtttgacggacactgcccttgcatggcaaagtccgccaaacacccgttcctaccgagaaccataagcccggaaaccttgggattccaatctttcattcgatttcgacattaaccgtctttgcatgggctttcgctatgctacgtcgctcattttcgataatagatcgaacgtccgcaagcaaatcatctgtcacctcaggcttcaggacatcaccatcgatggcttcacgcatccttcgttctttgtatttcaaacgtttgtatacccggctatcgataaaaccatattccgtcggatcattaatggtttccatgatgtgatagcgcgtatattgaccatccggtaaacccaaacgatggatacgatctctcgactgcaacatatacgtcagattgaaattaaattcaaaataaacggcatcatgcacaacatcttgcaacgaaaccgattcgcccaacgtctgaggattggatacaagcaccgcaggcccattcgggttacggaaatcagcaataaaatctttacggacatccactggagtctcgccataaatcaaacgattatctatatcggaatcatcgagacgcgaggaaatcttttgcaaagtattgacgaacaacccccaaacaataaccttcttaccctgatttacaagatctcgaatcagcttcagtccttcttcgaacttcggcgatttcatattatccaaatcaaaatcttcataacacttattcgaaagaatcggagtgacggccgtttcttcatgcattaatgcccgattgaaggtcttctcatctatttcttcagaatactctccattggattccaaacccagagttcggaaatcaatcttctctttcagtaaagaaggatttgttgatgcttgcataagcctaatcaactttgccaaactggatttttcctgcgtccaaatcgcgagcgccaactcaagttgtccagatgaagcgggagcttcaataatgtcatcagggtcagcgggcggtaccccaagttggcccttattcgttctccagaagaatgggtacagcttttcattaatccgatcgactaaatactgatttgctttcgataattcaggaacgtcccagccaaagaaaaccggatattcttttttgtacaaaagatgcaagaagttatagatatcacaatacgaattaggaataggcgtacctgtcaatacatatcggaaaaatgctttatcgcacaaatccatggcggcagttgctctagttgcattaacgcctttaatcctatggacctcgtcaaaaacaatcattgtttgcccatcaatcaaatcgataagctggtcatggtatttcgggagggattcataattgacaaggaccaaattcgaaaccgcccatcgtctacgtaaatcgccgtcaaaatttccatcctgaacatcaacgactcgcagctttttcttaggaccaaaggtcttttgaaattcgcttttccaggattcgaaggcgttgattggagaaaccaccaaaatcctgctaacgaattcaccaaacttagccttaccgctattgagataagcgaatacgcccaagaccattgccgttttaccggcgccgggaaccgaaaaattagctgctcgtgccatcttgtacatatagaaagccgactgcaaatgcaaagtcttcaatggacgacttactgattctgaaataacattacggaaaagtgcgaactcatcttcgaatcgattaacattttccttaagagcaacgcccatgtatcgatactgttcaattgaatatcgttgctgtttcaaatcttgttctatgcgcggatcaatccagaaggcaactttgccttccgctcttttccgagttttctctagacattgttcaaccacagcatagggaagatcatcaagcatttgatgcgaatgctctttaaaatatttccctccccaatctcctcctattctcaaatgtctgtctcgttcggatctctgctcttctgtggtatcaatgaaccagacgtctccgtccttatagataaaagcccatccctcaaaaccttcaggcaactgcgaatcttccttctgatcaaccatgccgggacaatcctccattccctgatattgagcgagttgttcatataccaaatcactcacgtcttcggtaatcaccccatcttcgcgagaagaccatagccgaccaaaccgatcaacctccgcttgcagacgctgcctgacacgactgctctcatcccaacttacatccacaataatcgactcataattcgaactgagtccgcctgtcgattcattcgcggatcccgaaaaaagaactttatttccttccgaatcctccagtaacccgaatttgtcgtggaagattcctttgccctccttcaaaaaggcaattttcacatccgctttttcttctgcaatcagttttgccaacaaccctaaatgcttttgatcaatatcatcggcatcctgacattgcagtttttccctaagacgattacgccactcatatccttgttttatttcatcaaaatcggtctcgctgatgtgactggatagcaacagctgataacgaccatcattacaagccaattgctccagcccggcggcaagtagctgaatccctttaagagaaaaatatgccgataccctgcaatatcgtttcgcctcagacaacgttggaatcagaaaagagtcaaccacctgttgatccgttgtctgatactgcgtatcaattttcagagacaagaagctcatagcagattacccgtctgagataaaacatcataatccttacgaacgatcattccgattttctccaaatccgcagccacgtccttggattgctccaccgtaaggttttccaaagtagcagtatcaatgctttcaagcgattccacacacgcacttacagtttcgactactttttgaagctcgcctctgtactcgttcatctttcccaaacgtcgactagaccgcataaaatcattcgacgcagccttaatcccttcgctcgaattcagaatctgcgaaatctgagatgcatcagagacaggtgtatcctggaaagcatcatatatcgtgtcaacattgtcttccgtaagacaaacccaatcatccttcttggaaaccatggattgaagctctttacgaataagacgtgtgatatctccaccctcattcgcatccgtcccagaataatgcatcgacagcaaagcgaaaaccgcactcttgacttccccatcgtcaagtagcttatttttgtcgagaacccttctcacctcattcatcggtccgtcaagccgaagctctttggcaatgtaataagcgtccctcggagcaccaataaattcaagatacgaagaaatcagcttcgcttccttaatatcgttgtttattccccttgctcgttctttgccgatacttttcgcatactcctgaggagtcattattttttcgacgtaaacggtgttatacacatcgaaaattcgatcgatcggatcatagtcctgtcggtcttcttttcccatctgcaaatcaagctcaagctgcttgattgtttttttatcaacagaattggtgatatcaaaatcaagaatcgcagcttcaaagtattgttctatgcctttgctcttttgaattcggcgcaatgccgtaaaccggcgattgccatcaatcacacggccgtcatccagcacgacaccaggctcctcttgacctctatctgaaatcgattcctgggtcgccttcatgcgctgttcattcgatttaaagataaaactctcaaacaaatcgttatactcaggattttcatcatccaaggcggggttcaagaccacctctggatgcccactaacgtatttttgaagagctgtactaattcgcccattttgattgttgtaataaaggtatttaaggggaatacgatatatggcctcaagccgctgcactccatctatcgtgtacttacgtctcgcgtcggtcaatttaatcagtccatcagcagcgagcttcttcaacgaaatcatcgcaggcctttccctttttccaatacttttttcctattgctttcgcaaagcaagccataaatattcaatcaaatatactatggccaagaatttgatagaggaatatcatcaaatactcgaatcatgactagcacgaatgtcttcaagacaatgcttcgcctgcttgcaccaatttcatttcacattgccgttcactttttgattctcacgaatcagttcggccacataatgtcgatcgagccagaagcattgcttggtaatcgattcgccattaggcagacgcgccacgtcatcgctgttctgccctttcggccttaaatggcagactccgttgaagctcgctccaggaagtaaattggttcctcgtccgtaatgtaccgacccaccgctcagcatcaattcatgcagccgctcccagaccggacggacatactgttcgatatccttttccggcatattccaaaggaatcctccaacaagacggtcattaccggccacatgttgcgaatacggtaccggagatttaaatgagacaataaagaacttgttctcttcgaaatactcgtacaggaacgagtcttcccatttcgcatcaaaggatgctagtccctgccactcttcctctgtaatctggcgaaaagacatgttttccttcgggagcccatccggatacaatacgacagtcttcagcttggtcacattggccttgcggaattgttcaatcgtatcgacgctacgcccttccgcaccaaccattttcatgacgagccggctcttgctggctttcgaatccgatttcgaaatacccaatcgaagagcgatgtcatcaacacttctcccgatgtacgggctcatttgttgccacaggaattcagaaagcgtctggttcgacggaatcggcaaactgtattcctcaatgcggcttaccaaagcacgttcggcaatcgacgtcatgaaagatgatttgaagctgaacgcacgctgtttcgcacgtatccgcgccttaccagagccggctggcgcgggagcatctctcatactggaagcattcgcacccttcgtgcatgcggcaagatagtttgtgtccgattccgaaagctgatttgcatgccccgaggcaactttctcgtgaatcgtctcccaatcatctcgaatcgtcgccaaatcgttttcatcataatgcaagacaacagatttcaagaccttgcagtccaagcgtgattgggttttcttgtcttcgcggtcatcgtagtagtacaccatgatgatgttcttcgacttattccaaaaccgggaatcttcaaaattttccttaggcagattctcgtaattgatgatgtcaaggacaagtctctccttggcaactgtcttcgtacgtttgcccttgccggaatgcttcagtggggtcactttaagctcataacgcgtatcgccaacgaggatatcagcctcagcatctgagttgacaggataatgcagaacggattcctcaatgatattgccaagcgagcccttgtttcctgccgaatcgccacgacctgtttcgtcaagttctcgaaaagtcttcccctcagctgcaatcaacagtttcgtgacttcttccaatgatgaaaaactacgctcttcgttcaacatcgaactagctcccacatctctttcgaggccattccaattcagccccaactcttttgcatttaaccaccgtaagccccttttataaacacgacacactgaatttgatcgattcctcatgattagataagatattggccagtagtatctcgaacgatcgttcggatcgcaagagttaaaggagcgcgagagctgtaatgagcaaggaaatcaaagtcgttgaactattcgccggcgttggcggattccgacttggacttgatggttacagcaatcccaagtatcccgatttcgagatgaagccagccggcaatttccacaccgtctgggccaataattgggagccagatgggcgacccaccaaacaattcgcatggcgctgctacgaaaagcgctttggcgaaggaagctgcgtcaatgaagatatcgcagtcgttgtcgaacaaatcaaaaatggcgaacgtgaattgccggaattcgacatgctcgttggaggcttcccctgccaagattattcggtcgcgaagcccgcaagtcttgcatctggcattgaaggtaaaaaaggcgtgctttggtggagcatcaacgccattcttgaaatgcgccacccgaagtatgtacttcttgagaacgtcgaccgacttctgaaatctcctaccgcacaacgtggccgcgatttcgcgattattctctcttgcctatatcgcttgggctattctgtggaatggcacgtggtgaatgctgccgattacggcatgccacaacgtcgccgacgcgtatacatttacgctgaacatgacgctccaaaatgggatttggaaaaccagctcttccatgtgggggtcgaagcacgagctttccccatcgaaccggatgagcgattcggagctgaacgtttctccgtcagcaaagacccttataggtccacgaaagaattcggcatcggagacaaaatctcacgattcaaggaagccggcgtaatgcagaacggtaaggtgcttacacgccgagtcaagcccatctacaacggcccacagcgtacgttgggtgaattcctcgtaccgatcgagcaggttccggaagaattcttcatcactggagacaatctcaagtcatgggaatatctcaaaggcggcaaacacgagaaacgcaccgctagtaacggacatgaatacgtctactctgaaggtcccatcgcattccccgatccgttggataagccgagccgcaccattctcactggagaaggcggccgtggagcaagccgcaccaagcatgtagtcatgcagaatgggcggctaagaagactcgttcccgacgagctggatcagctccagcgtttcccgaaaggctggaccgacgacggaatgacagacggacatcgcgctttctgtatgggcaatgccctcgttacggaaattccgcatcgcatcggcaaagtcatcgctgaagacaacgattcgaaacggtaaatcaaacgaattccggtggctgttggacggaacggaacgtactccggaatggcagaatcgccattttgtgccggttttcatccgtcgtaaagccgaggagcaggagaaatcctattatttcatcggcagcgcggttgcattggatgatgtgcgcgaatcggtgaaccgcagcgaggacggcagtgagtcaaaggtggtcgtttccacgctcaatctcatcaagccggtcgatccggagctctaccgccatctcaccggcaagtccgcgctgtaatccgcggtcgttttgcaattccttttgcctatctcgagtcggatacgccaggcacaagtgagtcgtccatcatcggcgtcagaaacacgacttatcaaaatcagacgcattcacacagaccataatcaactacacatgttcatatgaacactagagcaacacgaatttccaaaataaaaagaacacgctcaatgttatctttttccatttcttttaccccatggcagattgcctatattgcaacgaattaacgcacacaaccacaaatatggcttatcttcagcgatttcaacgcccattaatcgtgatatcgttattcatggacagaaaaactatccaccacacatgttcgcttttcatctaaagagaacacgaaaacaaacattactcatgttcacaaatacaaggtaaaaggacaaagccatggccgataagaaccccatcatcaccgtagatctcaacatgttcagccaagacgccgaggcgaagaccactgaagccaataaagtcgccaagagcctcggcatcagcgacgaggcactcgccaaagtcgaagacttcaaacgaacgcttaccgagcataacgcttgggatctgccgttcatgggctacgtgaacgaggacggctacggctacgcctacgtaccggacgcggccatcaccatgaatccctattgggacgcgcataaggaattcatgaatctgcccgaagacgtgcagaccgccttcgccatccgcatgctattcacgcatcgtccggtcgatcgctacggcgcggatatgttcctgcactaccaccgtggcttccaagtgaacttcatcggctccggcgccaacaagtactgatcgggatcgcccgaatagttctcgtgcacaaaaccattccgaaacagacaacccaaacgacaaggtggtttgcacatatatcgaacctatgcgcaaaccaccttcatcgactcatttcgcgccgctacagcttactgaccgtccgcataggcacccgcatcaaaaccgtcgacatccagaccatctgaaccaggaccaaattcccgtccacccggtcctccgaggaactcacgagcggacatgccattctccttccgggacgcatccacagcctcctgcagcacctgacgcacctcgaaaccgttaatcacgttcttcagtgccaccacgccgttgccagacgactggtcacgcgtatccagcacaagcgtgctcataccgaaaatacgctgcaggaacgtacgctccacactgatgtcaacgatacgaaacagcttgatcaggttgaatctctcattcaagataccggttttgacgctcaattcccgatcggtaagcgtgtatacggtgaatgtgaatggcgtacggcaccaattacgcttacgctgccgccacaagacattgccacttgcaaccttcataggtaattctctttcttacctgaccataacgggcctttatggacccgcctaagtccacggaatacgccacgactacgtgacgtatgcaacaacaatcgcaattctaccggccaggacacccaacttatctcgaatcacggagacagcggcaacggcacgaatcgcaatcacaaccaagagctcataataagcgcgcagaagtgtttcacagaatgtttcatgcatcgaaactggaactttcggcacgagcgccatatcatgctataggcttgggcgtcagtagcgaactgataagacatattcaaccacaacaccgcctcacctagatgcgcaatggaaaggcatgcaatggattctggacagggcagcttcaatcgcaggcaggatgccgacgatctcaccgattacgtcaacaacggatggctcagttccaacgaattcgacggaccgaccttcctgtggaaccacatgatacgcgaagccagtcgagaaggttccgaccaacgtaacgatgtgccggtcgccaatctttccgacgcggacgtggtcatcaccatgcccatgcaatggtatttcgacgccctcgcctccatggtgcctaccgcggaacgtaccgatacgggcgtggagattccacgcatcgatatgccgacgttttcgatcgattcgcaggcgctgtccggcgtggacgcggtggtcggcaacgcggtgatcagcacgcgatggcttgacgcggtcggcaatctcgccaaagctgtggagatgaccgcaaggttcgtcggcaatgtggccgaccgtgacaacgagggtttcgactacctgaaagatctgattcagaccgtacgcgtgtacatggatgccgtggcctgcaacgccgatccgatgacgggcgagcaggcgttgcgcatgatcacgcaggtggcgtgcaatgaggatttccggctcaacgccatgcagatggtggagctgctgtcttgcggactgtcgttcgcgcaatgggatgatacgcgcatgttcgcctatgacgcgttgaacaagggcattgccgcgatgcgtgatttcgcagcgaagtccggtaatggcgatgcaagcagcacgactggcgacactatgaacagcgtcggcagtatcgacagtgatgttacgggcgatacgggtgcacgcgacgccaccgcaacgcaatcgcatgaccttcgtgatacgtcctctgacgcggacagtgcgcatagcacgaatagtacagacgctgcggacggcgcggataccgcgaactcgatcacgcattccacgggcgctgccggcgattccactaccggcggttcgcccaccctctcccccgaggaactgaacgatctcgccatgcttgacccatcattcctgtccaaacagcagcttgcgcagaccgcgcaaaaccagttcgaccatgccgtgcagttcctgcggcacgatctgatgcggatcagtggcgatgccgaggaggccgatcgtttcctgcgcgacaaccatacgtccgagccgcttgccgacgcgtacgcggcgcggctgatcgctgccgaacggtggcaggatctgctgaatttcgtcgatctggtggagcgtgacgcaccgaaccagtgcacggtcatgttccccgaggaagtggtgccgtacgaatgggagtcgattcgtgaggccgctttggaggcgttgggccgcggcggagaactggtcgcgatgtatcaggagcggttggatgacacgtacgatcccaacaccgagctcaatcgtatgaagcttcaggcgtggactcaagccaaggaataggcggcgcacggctcagcacatccgccgccagtttctcatctatcgcaggcttccactctcattcccatcagtatttccaccatcgcttccacaactgacgcgcaacgtggccaattggaacggatgcaggctcagcatcgctccttgcgccgttcttgccacggacggatcaccgtcggcaaaagccgcgggcaattcggcatccagccgcgcatcctccataatggaacactcgcgtaccgtggccttccccaaagcggcgttgacggcaagtctcgcatgggcttcgccgccgaccgcctcatagacgcgcagtatcagatctccggaaccgtcatcggcaagcttgacccagtcaagcaccatgacgccatccaccgggttgagctgcgccagcggatcgaacgccggcacggcaggcagcacggccgcgttgagacggttcgcctcgtcaagcacagccggcatactggcatccgccacaacgttccacgcgaactcatgcacgcccttgtcagtgttcggatcggggtatagcggggacgacagcaacgaaagtcgaatcatcgtgccacgcaccggcccggaagccgtgttccggtgaatcggcgaaacgtcggaaccgtaggtgctggcgttgacgaccgcagccgcatagccggcatcggcgacgcgtacgaaccggtgcgtgcagctttcgtatttcgcctcgtcggaacgtgtgttcttctgaatgggccgttccaccatgccgtactggcattcgtactgcgcccggtcggcctggatagccatgggaatgtcgactttgaggaatcgttcggatgcccgccaatccactttggtccggaattcaaggcttttcgactttggccgcaatgtaatgcaggcatcgatggacaccccgtcggcggtgctggacacgtgcacggtggctccgccgcgttttgtctccgtcactcgttccacatgcgagtcatcgatgccttcggcgctgaggaaggcatcgcgctggatgtcccatgcgtcccactcgtatggctcgtcgcggagaagctcgtaatgcccgattccactgccgtcgggcaccagttcgtgtccattatcaaggtcgatcagtgaacggaccgtaccgtctggtgcgatgatggcacgtagcaaaccgttgtcaagtatgattcgaccgtcgtcacatgtcgttgcgatggtggattcatcggcgaccgcgtcggtgccgttcgcgtcatcatcctgcgttcccactgccgcggtgcgagcaatccacgaatcgccattctttgccgtatatgggacgatggccgcgttcgatcgcatgtcggcatcatcccgcgccgatgcgatggaagcacccgcttcagcggcgatatcacgcagtcttgtgatgtcgcgcacgtagtccgcacgtgcctgccgatgcacccatgcgatcgccgatccgggaagaatgtcgtggaattggttcagcaggagcgttttccagataccgtcaagttcctcacgtggatatcggtattttgggttgaacacgctggctgcggcgcacagatattccgttgttctcagcaggttttcttcccgcctgcatccgcgtttcatttcctgttgcgatgtcagtgtggcgcgatgcagttccagatacagttcacccttgaaaaccggggtttcgtccggagcctcatcgacgatatcgtgtcggacgcggtcgaacagttcgtccggagtgccgaaatcgatgctcggagcgccggcaagatcatggtccctgcggatacgtgcgaccatttcgcgggtgggaccgccgccaccatcgctgtatccgtacagcagtatggcgttgcgcgacaggtccttgtcaaggaagttgcgctgggaatactgcagttcctgcatacttacggtcgagccgtacgtgtccgacggcgggaagtgcgtaaggattcgcgatccgtcgatgccttcccattcgaaggaatggtgggggaatttcgtggtgtcgttccatgagatcttctgtgtgaggaaccattcgaaaccggcacgacgtgcgatttgcggccatgccccgcaataaccgaaactgtcgggaagccacagtccttttggttccacgccaagatgctcacggaagtaacgcatgccgaacgtgatctggcggatcagcgactcacctgtgggcagcatgttatcggattcgacccacattccgccgacgggaatgaatcgtccttccttgatgcgctgcagcatgcgcgcgaacaggtctggatgttcctgttccagccacgcatactgttgggcggaactcatcgcgtacgtgaaatccggatcctcgtccatcagggcaagcacgttggacaccgtgcgggccactttacggtgggtttcgcgcacgggccacagccatgcggaatcgatatgcgcatggccgaccgcgacatgatggatgacgctggaatatgcgggttcggataataccccggcaagcttttccttggctggctccagagttccggcgatatcacgctcgtcatatgtgttgagtgatcgttgcagcgctttggccagctgccaatatcgaggatcatcatccttgagttccctcatcagcgaggtgacggtttccaagtccatcagatagtcgaacacgttttggttgaaagcgcacacgtccattgtggtgagcacatagtcggatggacgaccgtcggcacgctcccccagattcatcggcgcgaatggcaggtcagcttcgaccagtggattcgatgcggcctcgacatataccgtgaaacgaccggcatcatcaagctccacattcgccacgccattggcatcgataagcggaatccagcaattgtctggattcaccgctttgatgacgctgccgtcagggcgatagcataatccttccgcttggaagcccgggccacgatgtcgtttccatcccagatctacaaccagttcgacggctctgcctttgaccgactcacggtcgatacgtccacgaacctcgaaccatgtggtaccccatatcgtgccccaggcaccaggaaccatgaagtcgagaaaatccactttgttttccctgacacgtgcaagaaagtcggcgctctgttcgggttcgccttcatcggcgaaagcgcgtaactgacaatgcgataatgtttcgtgcacatatggcacaagtcgttgccgcatcactcgattgacacgtctgagttgctgatctggaagaagaaacatagctatccccttggcacatgattcctatggtgtatccatggtgccacaacacaatctcaaatcaaaaaatatcaaagagaaaagtggttctcaaagcggacatccggtggagactccggataaggaccttcgacgagcccgaaaggcgttgccgggaggcccgggaggtgatgaaaaaaatgggggttcccggagcgacgcccgccgggaagcccgaaaagagaggataaaaaaggggcctcccgggagccaaaggctcgaccgggaggcccgatacgtttgaagcggcggcgtgctactctcccacaccctctcgagtgcagtaccatcgccgcgcctggccttagctaccgggttcggaatgggaccgggcgtctcaccagggctatgaccaccgcaaaaccgcgatcacggaacgacaaccaaaacatggcggccattccggccattcaattatcgtgtggcggtctgggaaccggctagcggacgcgaggcaaagcctaccgttgtatcgttcagtgaccatcccaacgcatattgccgtccaggacgatccagcacaggaaagacgcggaaccaatcccgcaaaaggatcggaatgttatgtcgccgtcgcccgttagtaccggtcggctccacccctcacggggcttccacctccggcctatcaaacacgtgttcaacatgcgggctacaacagttcaagaccgtacggaatcctaatcttggagcaggcttcccgcttagatgctttcagcggttatccctcccgaacgtagccaaccggccgtgccgctggcgcgacaaccggcataccagaggttcgtccacccaggtcctctcgtactatgggcaggcctcctcaggattccaacgagcgcagaggatagagaccaaactgtctcacgacgttctgaacccagctcgcgtgccgctttaatcggcgaacagccgaacccttgggacctgctccagccccaggatgcgacgagccgacatcgaggtgccaaaccatcccgtcgatatggactcttgggaatgatcagcctgttatccccggggtaccttttatccgttgagcgatgccgcgcccgtgcgccggcaccggatcactatctccgactttcgtccctgctcggaccgtcgtcctcgcagtcaagcccgcttgtgcgattacactcgacacccgattgccaaccgggctgagcggacctttgagcgcctccgttactctttgggaggcaaccgccccagttgaactacccgccaggcactgtccctgacaaggatgacttgtcgaggttagacgtcaaacgagaacagagcggtatttcaccttgcggctccgcgatggctggcgccaccgtttcaaagcctcccgcctatgctacacaatccgcgcctaacgccaataccaaggtatagtaaaggtcccggggtcttttcgtccttctgcgcttaacgagcatctttactcgtactgcaatttcgccgagctcctggtcgagacagtggggaagtcgttacgccattcgtgcaggtcggaacttacccgacaaggaatttcgctaccttaggatggttatagttaccaccgccgtttaccggggcttgaattcaccgcttcgtccccgaagggattgacggatcctcttaaccttccggcaccgggcaggcgtcagtgcatatacagcggctttcgccttcgcatgcacctgtgtttttggtaaacagtcgctaccccctggtctgtgccacccaccaaagctccggacgcaaggtccttcaccccagtgggtctcccttataccgaaggcacgggagtgatttgccgagttccttgaccaggattcgctcgatcgccttggtattctctacctgaccaccagtgtcggtttggggtacgggcggccatggccctcacgccgaggcttttctcgacggcctggacaaccggatatcgaaccataacggctcccatcatcacacctcgccatgcacgccatgcggatttgcctacatgactggctgcgtgcttgaccacggaaaaccacctccgcggccggctcccattccgtgtcacccctgcgctgacctactgcggctacgctcccaacaccacgcggcgataccaacccgaaggaaggaaccaccacgaggcggaggttagtactcaccgtctcggttttgccggtccatggtcggtacgggaatatccacccgttcatccattcgactacgcctgtcggcctcgccttaggacccgactcacccggggacgacgaacgtggccccggaacccttggtcatccagcggacgggatcctcacccgtctctcgctactcatgtctgcattctcactcccacgaagtccacggccggtttccaccgccgcttcgcccctcgcaggacgctctcctacccagcaaccatgaagattgctgccgcgtcttcggtggtgtgcttgagccccgctacattgtcggcgcggaaccactagaccagtgagctgttacgcactctttcaaggatggctgcttctgagccaacctcctggctgtctatgcgactccacatcctttcccacttagcacacgcttcgggaccttagacgacggtctgggctgtctccctctcgacgacggagcttatcccccgccgactcactgccggaatacacgtcaacggtattcggagttcggctgctgttggtacccaacaagggcccgcaagcatccggtagctctacccccgcgacgcaatcgaccgacgctgcacctaaatgcatttcggagagaaccagctatcacggaatttgattggcctttcacccctagccccaggtcatcccccggttttcaacccaggtgggttcggtcctccacgcggtcttacccgcgcttcaacctgcccagggctagatcatcccgcttcgggtccaggacaagcgactaaaaacgccttttaagactcgctttcgctacgcatacgccacacggcttatgctcgccacccgccactgactcgcagactcatttttcgataggcacgccgtcaccccaccagggaggctccgacggtttgtgggcgcacggtttcaggaactgtttcactcccctcccggggtgcttttcacctttccctcacggtactggtacgctatcggtcagacaggtatgcttagacttacccaacggtctgggctgattcacgcgggattccacgaggcccgcgctacttgggacaacacgatcggaagacggctcacgtccaggtacggggctggcaccctctacggccaggccttcaagcctgttcccctggcaagccgttttatgactcccgcccggcccgtcggaaccgggacacgtgatcccacaacaccggcaacgcaacccccgacgggtatcacgcgcaaccggtttggtctgatccgctttcgctcgccactactcacggagtatcccttcctgcaggtactgagatgtttcacttccctgcgtacccccgcccataggcggtgccggcccatgacggccggcgggttcccccattcggagaccctaggatcaaagccatgttggaggctcccctaggattatcgcatcctcaaacgtccttcatcggtactgtctgccaaggcatccaccatacgccctcgcaagcggcacaacagcaaaaccatcgtcccacccgcgggtttcctgatagcaagatcgccagacgacaaatcttaacactaaaatgatcacaaaacgatcgatctcgaaaccaaactcaattgaagagtttggcgaaatcgcgataagcaaaaagaaacgttctttcagtttctcttgctcgcgtccactatccagttctcaaaccaccacgcgccacacgatccgaccagccacccaggaccggccaccacgcatgggcatcgaaccgcgccacagaaaacccgtggggtggcggtccgggagcccaaaagcatacccataccactcccggacgggacgaatcccatccaagccattgatctcttccacaccagcatccacaacaacgacgccgactgccggcgcccatgtggctcacactgtccaaaaacatggactgtattctccgtagaaaggaggtgatccagccgcaccttccggtacggctaccttgttacgacttagtcccaatcacgagtctcaccttagacggctcccccaaaaaggttgggccaccggcttcgggtgctacccactttcatgacttgacgggcggtgtgtacaaggcccgggaacgcattcaccgcggcgttgctgatccgcgattactagcgactccgccttcatggagtcgggttgcagactccaatccgaactgagaccggttttaagggatccgctcccctcacgaggtcgcatcccgttgtaccggccattgtagcatgcgtgaagccctggacgtaaggggcatgatgatctgacgtcatccccaccttcctccgagttgaccccggcggtcccccgtgagttcccaccacgacgtgctggcaacacagggcgagggttgcgctcgttgcgggacttaacccaacatctcacgacacgagctgacgacgaccatgcaccacctgtgaacccgccccgaagggaggccccatctctggggctgtcgggaacatgtcaagcccaggtaaggttcttcgcgttgcatcgaattaatccgcatgctccgccgcttgtgcgggcccccgtcaatttctttgagttttagccttgcggccgtactccccaggcgggatgcttaacgcgttggctccgacacggagaccgtggaatggtccccacatccagcatccaccgtttacggcgtggactaccagggtatctaatcctgttcgctccccacgctttcgctcctcagcgtcagtgacggcccagagacctgccttcgccattggtgttcttcccgatatctacacattccaccgttacaccgggaattccagtctcccctaccgcactcaagcccgcccgtacccggcgcggatccaccgttaagcgatggactttcacaccggacgcgacgaaccgcctacgagccctttacgcccaataattccggataacgcttgcaccctacgtattaccgcggctgctggcacgtagttagccggtgcttattcgaaaggtacactcaccccgaagggcttgctcccagtcaaaagcggtttacaacccgaaggccgtcatcccgcacgcggcgtcgctgcatcaggcttgcgcccattgtgcaatattccccactgctgcctcccgtaggagtctgggccgtatctcagtcccaatgtggccggtcgccctctcaggccggctacccgtcgaagccatggtgggccgttaccccgccatcaagctgataggacgcgaccccatcccataccgatagaatctttcccagaaggacatgcatccaactggagcatccggcattaccacccgtttccaggagctattccggtgtatggggcaggtcggtcacgcattactcacccgttcgccactctcacggccggagcaagctccagccgatcccgttcgacttgcatgtgttaagcacgccgccagcgttcatcctgagccagaatcgaaccctccacaaaaaaacttatgcggaaagccaacacgtgactctcatctaagaaaattgacgatcgccttataaggaaaggcgcatcgcacaaaaacctcaccgtccttcaaggcctcccggccactcgcaaggagcggacgatgaactggcaatcattgactataaagaagtagtacaaatacgctcttgagttctcaaaccaccaccactcacccacctcgcaatccggagtgaaccggaccactcgctgagcggcagcaagagataaacttacagcacgatcgcgatccgcgcaacccgggccgcatgaacaacgcgtgaaccgttggaaatccaacgttccatcggcgtgtcgaaacttgacaaaccgagaggcaaatacctaccgacggcgtccacagtgtttgccgccgatgccaaatttgccatccacgccccacggaccacgaccttcggcacgaagcacacccaagtgatgtttcatggcgaccaacatgatgtgcgtatcttccaaaccgaggtgacgttccgacttgctctcgtcaagcgcaccctggcgtttggcgtacgcgtccaacgtgttgttgccgtatgggtgctcatcgtcgggaatcgacccctcatcccaacggcggctcatcggcaacgtgtcgatgatcgtgattttgccggcacgatagctttccgcatatccggccacgttcagcatgaagaagctatgttcgaatcgtgcgttgtgcgccacgtaaggctgctgctccaatcgctgcagcaatccgatctgcgccgccggccactcatcgaacaagcggaacgaggaagcggcttcggcaacggaacgcgtgcgcacgtcgataccggtcaagtcgagaatcagcggattgccaagcgcagcgttttcagcggggacgccgaaagccaaccgcgactggccgtaagcgtcgcccgcctcgtaatagccttgctcgtattggtagccagccggagcgtccgcaggccgtggggaaatcatgttcatgtattcgaatccgacgtcgatgatgtacacgcgcgccggatccgtgcccgtggtttcgatgtcgatgcccatgacgttgtccacgtcacgaccgggcaggtaagcgtcacgccaatcggacttgcggtattcggacaggcggctggtctgcttttgatcgacggcgttttcctgcgtgccattcgccgaaccggtcgaaccagaaccgtaatcgaacaatgtggaaccgccaggactggtgacgccacccagattcgcgcgagacacggaatggtcgctggcgtgcttctgccttttctccgcggcgcgacgggccgcacgagcgttgacgatgtctgcggtgcaatcctggatatcatccagcaccactcccccggcagctgcggatgaccccgattgcagcaccgggaccgtcacccgctcacgtcgttcttcggtaatcgtccacagtcccatggcaacgccgatttggcgcaacaccgcgatctcgtcgcacaaccgacggttcgcataggcgagcgcgcgtggcagacggtacgaggtgatgagtcggtcgaaatccgtcatgaaagtgctgttgcactgcgcgatgacaggttcgagccggtcgcgaatcgcaagatcatctttcagcaggtcatgcagctgctgcgcgaacggtcgggcagacggctgcgatgtcgaggacgattctgacgtaacattgccggccgacgcggtacgaagcgccgacagcaaatcgatatgctgctgcgcggcgacgccgatgccgtgccgtaagtcgagggacgctatccactgccagtcgatcggctgttcgtcggcgtctttcggcatcgatgccgaccattgcccgatgtcctgtttcgcatcgtcaagccagggttgattcgtcgtcgattcgctcatacctgcacatcgtagccgatgtccaccttcaattcgcggaattcgctggcgaatccaatctgtcgatgattcgtagcggcccgcaaaatacgggaagcgtctctcaggcgtttgcttgagagacgcttccacttgttctgacacacggctatccggctattcagtcattcggcttttcgcttttcgtccgcgcgaaaccatgaccgtaatccgcgcgatttgaggctactattcggttacagttcgaagccgagttcggccgccgcttcggtcggtaccggatcctcgcaccagaaatcctcaaggttctcattggtggtcaggcttcggatttcggcctggtcgatgtacagttcaccgctcaaatggtcggtttcatgctggaagatgcgggccggccagccgtgcagatgttcctcatgcttgttgccgtcctcatcctgccaacgggcggtgatgtcaagccaacgcttgcgtacggcctggtaaccgtcgaagctcaggcagccttcgtagaagctgcgggtttcggtgccgatcggttcgtagctggggttgatgatggcgtggaaggggaattccgcggcttcgcgcggatcgccatcgtcgccttcgcatacgtggtcttcgacgacggccaaagccagaccgagaccgatctgggtggctgcgaggcccacgcccggcgcttccagcatggtggtgcgcatggtgtcgatgagcttgtcaagcgttttgcggctcaactggccgtcataggcgatggtctgctggcgtaataccggttcgccggcctgcacgatcggcatgattttctctttgccgccggttttgatgagcttttcgacctcgcggttgagttcgaggtccactttcgagttgtgtccgaacatggggcatatctccttgcgggctcttacagggtgagttcgtcggcgacgaccttggcgaggcgatcgcacacttcgtctgcctgctgctgggtttcggcttcggccatgacgcgcacgagcggctcggtgccggacggacgcagcagcacgcggccggtgtcgcccagcagcttctcttcgcgttccaccgcggcctgcaccttggcgttggtcttggcggccatcttgtccacgttcggcacgttgatgagcgtctgcggcagctgcgggaagtcggcggccagttccttcaggctcttaccggatttgacgacctcgttgcacagggtgagcgcggtcagggtgccgtcgccggtggtggcgaattcgcggttgatcacgtggccggactgctcgccgccgagcgaataatcgcctcgcagcatctcttcaagcacgtaacggtcgcccacgttggtctgcacggtcttgatgcccatggaacgcagggccaacttcagaccgaggttgctcatcaccgtcacgacgagggtgtcatggttgagcttgcccgcgttcttcttggcgcgcgccagaatgcccatgatctgatcgccgttgaccatgttgccgtcctcatccacggcaaggcaacggtcggcatcgccatcgaaggcaacgcccatgacggcgccggaggccttgaccatggcctgcagctgctcaggatgggtggagccggcgttcttgttgatgttgtagccgtccggcgacgcgttgatgacggtcacgtcggcgccggcgcggcgcaaggcttccggagcgaccacggacgtggcgccgttcgcgcaatcggccacgatcttcaggcccttcagcggcgtcggctgcgacttgtccggaccgaccggcgcgatggcggaaaccagatggtcgatgtacaggttggttgcggtggcggtgtcatggctgacacgacccacgccggcgccggtaggacgatcccaatcctggccgagcaccgcttcgatctcgtcttccttggtgtcgggcagcttgaagccgccgcgggcgaagaacttgatgccgttgtcgggcatcggattgtgggatgcggagatcaccgcgcccatttccacgttgagcacggacgtcaggtatgcgacgcccggcgtcgggatgatgccggcgtcgatcacgtcgaagccgccggcggacatgccagcggacaatgcggcggcgaggaaatcgccggaaactcgtgtatcacgaccgaccagcgcacggcgacggctttcgaattcgctccgctcgtcatcgcccagcacgcgcaccgcggcgtcacccaaatcaagcgccagctgtgccgtcaaatccctattcgccaatcctcgaacgccgtcggttccgaacatacgtggcatgagtctcaaatcctcgctatctgcaaacgatatttccgtgacctatcgtactcaaccgtgccgccgaaaccagcaggtgacgacgcaatcgcataacacttcacaattcaaagcatttcacggcgcgcaatgcccttttcgtgtcgcacgactttgatttcaaggcggaaaatcaagtcgtgcgacaacacttgataaagaaataccccctaactatcattttccgttgaaaatcagcgaaaaataagagttagaggttatgaaagccagcacgcttgtcgcacaactttgaaaaatgcctccaaaatcaaattcgtgcgacagccttcgacgcaaaatgccccctaatccttattttcaagcgaaaaccggggattagggggcataaatgccgatatacccgtcgcatgactttgaaaatcgcacccaaaatcaaagtcgtgcgacgacatgacggactctaagcatgaacactccggtcgttccggtttccagacggaatcattccgactcttaaacggaatcatgccggcttggagtgtgcggaacgttcagatcgttcgaatcgccccacatactccaagcgccatcagaaaagcgctatcagagcgcggcgttgaagtcgcgtactttcagcgtgcggtgagaagcctcgacgttgccacgcacaatgcgctgcaaggcgttgtccgcgtccttatgggaggcgagccaggcgtcacccagctccacgagcttcgccggatcggcatagcccggatacaggccttcgagcagcgcttcagccatgtggaaggtcttgtgctcccaaatccagtcggcgacctcgaaatacttctcggcgtacggttcggccaaatcggcgcgcggggtggccgcaaagccaccggccacagcctcgagctgcatgttggtcagctcgtcgttgtgcagggcctcgttccaagcccatgccttcgcttcggcggtaccggccacggcgcgtgcgccataggcgaactcacggttctcagtggtttcgcgcttggccagttcggcgtcgattcccgcctggtcgatcgcgttgacggtgctcagcgcgttgatgatggtccagcggaagttgttgtcgatttccagaccgtcgaatgccacggaaccgtcgagcaggcccttcgcgttggcgacgaacgcctcgtcgcccggctcgccgtagcccaggtaggcggtgacgagctggaactgttcgtcggagccggccttggcccaacccgccagcttgaacagttcggcggccacgtgcttcacgatctcggcacgctctgccggagcggtgtaatgccatgcggtggtgctgacctgtgccagcgcgtaacggaaggtggtggactcgtgttcggtggcgagcgcggccagcgaggtgtcgatgaactgtcgtgccggcagttcgccgtcgcgggtcatgtcccacagggcgagccagagcacggaacgggcgagcgcatcgtcgaagcggtacaggttgcttgtcgcgaatgcgaggctcttgtcgtcgaaacgcagcttcgtgtaggtcaagtcgtcgtcgttcaccaggatcagcgacggacgtgccttgccggcggcagcatcgacgaccgtcagttcgccgtcgacgtccagttcgaaacggtcggtgcgcacgatcttaccggtttccggatcctcgttgtagaagccgacggcgagacggtgggcgcgcagcacgggatgctcggccggagcggtctggcgcagggcgagacgcttgatggtgccgtcctcgttctcttcgacttcggtggcgatggtgttgatgccggattcctcaagccactgggcgctccacgccttcaggtcgcggccggaagtgagttccagttcggcgagcaggtcggcgagggtggcgttggagtaggcgtgcttgttgaggtagttgttgatgcccttgaagaacttctcacggcccacgtagtacacgagctgcttcagcacggaggcgcccttggcgtaggtgatgccgtcgaagttgacgtaggtgtcgttgaggtcgttgatcggggcgacgatcgggtgggtggtgctcagctggtcctgacgcagcgcccagctcttttcgccggagctgaaggttgcccaggcgtccttccattcggtggcttcggcggtggcgagggtggacgtgaactcggcgaaggattcgttgagccacaggtcgttccaccacttcatggtcacgtagtcgccgaaccacatgtgggcgagctcgtgcagcacggtgaccacacggcgttccgcgtaggcgtcggtgaccttggattcgaacacgtactggtcgcggatggtgaccatgccgatgttctccatggcgccggcgttgtactccggcacgtagatctggtcgaacttggcgtacgggtacggcacgccccaggtcttggcgtagaaggcgaagcccttcttggtgatgtcgaacaggtagtcgacgtccttgctgaaggccttggcgagcgcctggcggcagtacatggccatcggcacggtgcggccgtcctcattggcgtattcggtgtgccattcggcgtacggtccagcgcagatggcggtgaggtaggagctcatggtcggggttggttcgaacacccacagcttggtggtttcggcggcgtgatcgccgagcgtgccttcctcggtgacggtttcgttgtcggtcacggaggaggtgggcatgttggacgtgacgatccaggatttggctgcgagcacggagaagtcgaacacggccttcaggtcgggctggtcgaacacggcgtagacgcgacgggcgtccggcacttcgaactgggtgtacaggtagacgttgccgtcggacgggtcgacgctgcggtgcaggccttcgccggtgttggagtactggcacatcgccttgacggtgacctcgttgtgctccttgaggcccttcagctcgatgcggctgtccgcgtatgcttcggtcgggtcgagggtttcgccgttgagggtgatctcgctgacttcgttggcgatgaggtcaaggaagcttgactcccccggcttcgcgtcgaaggtgatggtggtttcggagccgaaatccttggctccgcgggtcaggtcaagcttgaccgtgtaatggattggcgcggcgatgatgcttttgcgttcttccgcttcgattcgggtgaggtttgctcctggcatgtcactccttctttctggtaacagaaggcggcgcgatcagttgtgccgatcacgtcgccttgattcaatttatggtaaatttacggcttatttcgcggcgttcagtcccatcgcgtcatccacgtcctgcgcgatgtcggcgacgacggggacgatcatcggcttgcggtgcagctgtcgtgccacccagccgccgagcgtgcgtcgcatgatctgctgcagcttgtaggtgtcgcgcgtgccctgcatcatcgcgtcctgcagctgctcgacgatctggtgacggaccttgtcgaactcgctttcgtcttccgcgaccgcgttgaggtagatcttcggaccggtgatgacatccgcggtctcggtgtcgacgaccacgaagctggacacgaagccttcggtgccgaggatgcggcgcttctcgagttcttcgtcggtcagttcgccgacggaatcgccatcgacgtagacgtagccgcacggcacggagccgacgaccgcggcctggccgtggtacaggtcgacgacgtcgccgtcttcggccagcacgacgttctgcggatcgacgccggtcttgacggcgatcatgccgttggccaccaagtggcggttttcgccgtggataggcatggcgcacttcggcttgacgatgttgtacatgtacagcagttcgccttcgttgcagtggccggagacgtgcacggcggcgttgtctcggttgaccacgcgggctccgagctgcacgagcttgttgatgaccttgtagacgccatgctcgttgcctgggatcagggagctggcgaggatcaccgtgtcgaactcgttgatggtgatgtcacgatggttgccgtcggcgatgcggccgagcgcggccatcggctcgccttgggagccggtgcacatgtagacgagcttgtcgtcctgcacgtcatgggcctgcttcaggtcgatgacagtgtcctcgggcagacgcaggtagcccaaatctgctgcgatggacatgttgcggaccatggaacgtccgacgaacacgaccttgcggccgtacttgtgggccgcgtcgacgacctgctgcacgcggtgcacgtggctggagaagctggccacgatgatcttgcgagtggcctgtgcgaacgcctggtcgagcgccggaccgatggaggtctccggcttgacgaagcccgggacctcggcgttggtggagtccatcatcaggaggtccacgcccttttcgccgagcttgccgaattccaccagatcggtgatgcggtggtcgagcggcagctggtcgagcttgatgtcgccggtgtcgatgagagagccggcgggggtctgcacgaacacggcgagcgcgtccggaatggagtgcgtgacgttcacgaattccaggttgaacgggccgaccttgagcttgtcgcgtcccttgacctcgacgagcgtcgggttgatgcggtgttccttgcacttggcctcaacgaaggcgagggtgagcttggagccgatcagcggaatgtccgggcggagcttgagcaggtacggcacgccaccgatgtggtcttcgtggccgtgggtgagcacgagcgcctcgaccttgtcgagacggtccttgatgtagtggaagtcaggcaggatgaggtccacgcccggctgctcctcttccgggaagagcacgccgcagtcgatgagcaggatatgtccattgtattcgaccacgttcatgttgcggccgatctcacccagaccgccgagcggcacgatgcgcatggagcccttgcggtacttcggcggggcgatcagcacctcgtcctgctgcggcgcggtggattgcggcgcggaatgcgacgggcgacggttcgaaccgttgccgccacggaatccacgggagccgccgttgcgcgagccaccgttgccacggctgcgggtggaggacttggccttcttggtggcggtcttctcggacttcgcggccttggtggtcttggatgccttgactgcggtttcagtgcgcttggcagccttgctgccgcgcttgtgtgttgttgtctttgtggtttcttctgtagccatttcctagttggatttctattactaattgtctccgcctatgcggaaacgaggaatttgggtgcctgtcggcgttcatgcgcgacaggccagtcgcatcatgcgattcggttcacagcagtcccgcggcgcgcatgcccttttccgcgcgcacgagttccgcttcgcccggaccgacgttcggcaggcgcatttcggtggagtcgaggattccacgcaccttcagcgaggccttggccatcacggcctggaagccattgccgttcatcgcttcgacgagcggcgccagctgcacggagatgcgctgcgcttcgtggatatcgccacggtcgaacgcgttggcgaggtcacgcatcggaccggcggccgcgtgtgcgatcacagagatgatgccgacggcgccgacggacaggaacggcaggaacaggccgtcatcgcccgaataccaggtcagaccggtctccatacgcttgcgcaccgcgcctgcgatgtcgccggtggcgtccttgacggcctggacgtggtcgagctcggccatacgacggtaggtttccagctggatgtgcagtccggtacggctcggcacatcgtagacgatgatcggcttgtccgcggaatcgttgaccgccttgtagtggcggaacacgccctcctgcgacggacgggagtaatacggggcgaccacgagcaccgcgtcggcgcccgcctcctgggtctgctccaccatgcgcacggtgtgcgcggtgtcattggaaccggcgccggaaatgaccggcacgtccacgacctccttgacggcctgaaccagctcgaccttctcctccatatgggtggtcggcgattcgccggtggtgccgttgaccacaagaccgtcggcaccatccgccacgagctgcctcgccagctgttgcgcggcttcgaaatctacggctccgtcggccttcatgggggtgaccatggccggaaggatacgtccgaagggagcaggatcgagcagatgcattgtaccgtcgtcagtcttagggcttgtcatacggctaacggtacttccctctgcggacgctttcgatttcatgagacgcgaaaagtcacattttggaaggcctgccgacgacgaccgcgacgacgcactgcaggaaagcgacgaacgtgaacaccatcagcggcacatgatggccgccggtggtctggaccagcacgccgaacataagcgggccgagcgaggcgatcagatagccgaacgactgcgcgacgcccgacagcaccacggtttcggcgctgtcatgcccgcgcagcgcgatcagtgcgagcgccaccaccagggacgcgccctgcgcgcaaccaccgacgaacgcccataccggcatgagatgcggcaacagcagcatgccaaggccggcgatcagcatgggagcgctggcggtgagcgccgcgcagacctggttgccgcgcacgttcatgagcttaggaatgaccaagccggaaaggatgccgatgccttggaagatgaacagatgcacgccggcggtggaggcatcgtagccgatggatgcggagatggacggcatccaattggacatggtgtagaaagcggacgattgcagccccatgaaggccgtcacgtaccacgtcatcggacggcgcagcacgcgggcgaacacgccatgcgacgattgcgcggaacatgccggtcgctgtgcggaatgcgggttttgtgcgttggccgtcgtgctgcgatcgccaatatcatcgatatcgccagtatcgctggtttcgatggtgccgccggcggaagcgataacgactttgcgattgtgcaggatacgcaacgcccacagcgcggcgacaaccagcggaggcacactccagaaggcgagtgacgcacgccaaccgccccacatctgcgcaagcggcgcggacagcaaacctgcggtggcgctgccggcggtgatgcagccggaatagacgccggtcgccatcgcgacatggccggcgtagtcacgtttcgcgattaccggaaccagaacgttgccgacggcgatggcggaagcgaacaccaccgtgcccagccagatgccaacgccgccgccgaacgagcggatggcgtcgcccgccgcgatgcacagcagggccagcagaatcgacatgtcgatgccgatgcggcgtgcaaggaacgtgaccagcgggctgaccacggcgaaggcgatcagcggaatcgccgtcaatacgccctgcacgccctcaccccacgcaaggtcggttcccatttgggcgaggaccggcccgacggcggcgatggcgggccgcagattcagcgatacgaggaaaatcaaagccacccacaatccggtggaggaccggtcgtacgccagcatgtttcgttttgaattcattccgttcccattcccgcttccacttccgtttaccgccgttccaacgggacgtgccacgcctagattttccctatcaatcttcaagctcattgagcgcatcgaagcaatcgttgatgccttcgatacgcgcgtgcacctcgtcttcggtatcgacgaggcattttccgacttcgtccaccatcagggcgatcagggcgaacgccgcggtgaagctcgtcagcacgtgggagctcagcaccactttgaagaaggcgacgttacggccgatgacggcgttgcgcgccgaaatgtcgccaatcaccaccacggtcaggccgcgctcaagcatcacgtcgatgagccgtgagaagaagggaagacgccggcccacgccgatgatgacgattacgtcgcctgccgcataatcaaccagatcttcggctatggactggcctggattcggcagaatatcaacgtttccgcgtagccgcatcagctgttcgcgcatgtgcagcgccacgggatagctgctgtggtacccgaccaccgccacatgcggggccgtggccatggcttggcatgcggatgacagttgcgcgcggtcgatgccttcaaacgtgcgtttcaggctttcctcgtcacggcgcagatggtcggcgaccaaatcgtcgcactgggtgtgccgtgaaagctccggagagccaggacgatggacgcgacgcacgtcacgtctgaattcgcccgcgttcgcatagccgagcttgcggtacaggcggctgagcgtcggctgcgagatgccgctcaactgcgacaattccacggaattgcagaccagcacgtcggtcagatgacccagaatgaactgcgcggcctcacgttccgtcgcagtcagcgaatcgaaggattcccggatgcgcgccaccaagccgaggtccgcggcagcattgccttcctcgtccatggcgtccttcgaagcccccatattgtctgaaagcataattccagaagtcacgctcatcgcccttccctgcagtacattctcacgcggcgcatccgttctcctgacgatgctaccccttgctttccgggtttcaccaggtttggccgccgacaactgtcacgacgaatgaagaatttcagatgccgtaagcactgaaatgcatccatcacaggcagtggcggcgcctcttggcaacgcgacccaccatcaggagatgaccgaccatggcaaaaacagattaccccacacaatcaacatcgcatatcgggcggattcggcatagaagaaacggtgccaaaccagcgaaatgggcgactaacgcggcaacaaaatccccgactgttgcgaacactgttgaaccggcatcgcgcccggccgaatgcgaggcgaacgcggtgcgcaagatcgtacggctggtggcacgcaccggctgccgcacgcatattctgcacgtgtccagcggtctgagcgtggacgtgctgcggcgggcgaaggccgaaggactgccggtcagcgcggagacctgtccgcattacctcacgttggattgcgaccatattcccgacaacgccaccgcgttcaaatgctgtccgccgattcgtgatctgcatgagcaggacgcgctatgggcggggcttgccgacggcacgttggatggtgtcgtcaccgatcattccccggccagcgcggatatgaaagccggcacgctcgccaccgcgtggggtggcgtttccagtctgcaggtcggattccgcgcggtgttgacgggtgcgatgcggcgcggcttgagtttgaccgacgtcgtgcggtggatgtcgtgcaacaccgcacggcttgtgggacttgacgatcgtggcgatataacgccggtattgcgggccgatttggcgattattcgcccgtacgaacggtttgttgtggatgctaccgctttggaaagccgcaatccgatctgcgcctgcgatggcatgacgcttaacggcgtcgtcacgcgcacgtttgtagcggggcgggacgcgctctccggagtgcgggaggggaatcttatcgttcgtccgtgaatcggaatccataaatcaaccattcaacaaaaatccccaacccgccgatggccggatgtcattcgatgtcggcagattggggacggacgagaatcaggtctcagcccaggtaggcggccgggttctgggcgaacttgtcggcgcaaccggggttgcagaagtagtaggtgacgccgccgtattcgcgggttgcggccgcggtggccggatcgacgctcatgccgcaaaccgggtccttcgcaacgttcgccgcggaatcgcccatattcgaagccatgccgtggccgtcatgaccgccgcagcagtgtccggcgcccatcgtgcccatgttctcggcttccttcttggccttgtgatcgctgaacagtcccatgatcgttcctttccgactgtgctggttgccattatttttgctcggatcgggcttgcgtacccgatacgtcttgtttttcgccgcctccgcgtccggatcgaacaggcgcagccggcttgcgttcgtcaccacgcacaacgacgagaacgccatcgcggcgccggcgatcatcggattcagcagcgttccggtgaacggatacagcacgccggccgcgatcgcgatgccgatgctgttgtagccgagtgcgaagccgaggttctgcgcgatgttgcgcatggcggcatgcgtcaggtcgagcgcgtgcacgagccccatgagcgatccgcccatcagtgtcacatccgcggattggacggccacgtcggtgccggtgccgatggcgaatccgacgttggctcgggcgagggcgggcgcgtcgttgatgccgtcgccgaccatcgccaccgtatagccttgcgattggagttttgcgatttcgtcggccttgcgttccggccgcacgccggcgatcacatgacgttcgtcgataccgacctggcttgcgatggcgcgtgcggtggtcggattgtctcccgtgagcatgacggcttcgacgccacgtttgcggagcagttcgatggcttggcgcgagtcggctttcggcacgtcggcgacggcgacgatgccggcgagatggccgtcgatggccgctaggatcggcgttttgccttgctgcgacaggagttccatgtcggcgatgatggcgtcgaggttcgtatcgtggatggtctcggaggcaatttcggaggtatcggacgtaacgtcgggcatgtcgacgtcaaggtcgtcgatcaggtcggtgttgccgacggcgacggtgtgcggcagaccgcggaaggtgacacgcgcggtgacgccacggccggcaatcgcctgaaaatcggtggtttgcgcggcatccgcggcatcgacatgttccgcggcggtcgcgacgatcgcgacagcgagcggatgctcggaatcacgttcggcggcggcgacgatcgtcaggaaatcatcggcctgccgacgccacttgccgaacggcagcacgtcggtgagggtgggtttgccggcggtgatcgtgccggtcttatccaatacaacggcattgactttgccgcatgtttccaacgcttcggcggaacggaccagcacccccatgcgagccgcgcgaccggtcgagaccgtcaccgacaggggcgtcgccagtccgagcgcgcacgggcaggcgatcagcagcaccgataccgcggcgaccagcgcgtgcgtgacacgcggttcggggccgaacgcaaaccacagcgcgcacgaccatacggcgacgagcaccacggccggcacgaaaacgccggagatacggtccgccaatcgttgcacgggggctttcgagctttgtgcggcggtcaccatgtcgatgatctgcgcgagcacggtgtctttgccgactttcgtggcgcggtagcgcagcgagccgccgccgttgatggtggcgcccgtcacttcgctgccttcggttttggcgaccggcatggcttcgccggtgatcatcgattcgcccacggtggaggtgccggatatgacgatgccgtcgaccggcagctgctcgccgggacggatggcgatgacatcgccgacgcgcacgtcatcgatggcgatgctggtttccttgccgtctcgcaccacgcgggcggttttcggttgcagacccgccaatgcgcgcatggcttcaccggtgcctttgcgggcgcgcgcttcgagcagctggccgacaagcataagcgtgacgaccacaccgaccgcttcgaaatacggttcgcgcgcgttctcgggcaggacgttcggtgcgaaggtgaccacgcaggagtaggcgaatgcggccagcgcaccaaggctgacgagcgcgttcatctccggcgagcggtgggctatcgcggcgaaaccgctgcggaaaatcggcaatgccgcatagccgacaatcggcagcatcagcaggaattgcagccagttcggcatcggatacagcatgagcatggtggagccgaacacgggaatcgtgcagacggcggccacgacgagacgggcgacgagggcgcggatgtccgtttcgccggaatcgggcgtttgggcgtttttttgcgcggtctgtgcgtctgtttcatcagaatcggacgtgtggccaccgcccgtagtcgagtgcatgtctgaattgccagaatcgggcatgctggtattggcagcggtagttgcgataccggcggtagcgtcagcaccggcgcctgcgtgcctgcccggcagcacacgcaacatgccatgcagcatgttcatgccgcatgcgaagggatactcacccggctcatcggggtgcaacgtcagcgtggtcgtgcggaaggcgggcagcgcaagatcgaccccgaaatcggaaaaaacgacgtgcgacgaacattcgccgtcttccttgcgatcgaagatcagccgcaacggcatgcccgcttcggcttcgatgacggctgggttatacccgcctttgacttcgacgaccgcttcctgcacgccgtcgcgcaacggcgcacgatacgctttgcgcggtgcgaagaagaaccacagcacgcccgccgtgacgagcagcgccataataagcgcgattgcgatgtgcatattccagccgccttccgtccgtaattggctttcgatttcggcaaacaccatcacaatatacccctatagggtatattggcaagaaggacgagcaaacttcagccgtagataaaattttcagcgcagcgaggaggacgatatgaacgccacacaacatgggtacgcaagcgaccagaagaggatcatcgcacgattgaatcgcatcgaagggcaggtgcgcggcattcggcagatgacggaaaacggcgaatactgcatcgacattctgacgcagatttccgcagcggacagcgcgctgaagtcggtggcgctactgctgctcgacgaccatctgcaccattgcgtcgccaaagccgcggcggagggcggtaccgtcgccgacgaaaagctggcggaagtcagcgccgccatcgcacgccttgccaaataatcggaacagatacgccataaaaaaactgccgacggaagacacatgcacccatcggcagtttgaaaaaagaattacgattacaggtcgaggaagtggtcgaggccgacggtcagacccgggtaggttccggtggagaccttgcgcacggccagcagcacgcccggcatgaaggagatgcggtcgaagctgtcggcgcggatggtcagctgttcgccggagttgccgaacagcacctcctcgtgggcgttgaggccgcgaagacgcacagcgtgcacgtggatgccgtccaccacctggcctcgggaaccgccgtcggtttcggtggcgtccggaaccgggccgagaccggccgccttgcgcgcttcggcgatgccctgcgcggtatggaaagcggtgccggacggagcgtccaccttggtcgggtggtgcagttcgatgacttccgcggattcgaaatacggcgccgcgacctttgcgaaatggtcggcgagcaccgcggaaatggcgaagttcggcgcgatgaacacgctctggccctcacgcggagccgcggcgagcgtggcacgcacctggtcgagcttctcttcggtccagccggtggtgccgaccaccacgtcgacgccctgcttgacgagggcgagcacattgcccagcgacacgctcggcacggtgaattccaccacgacgtcggtgttttcgggggtaattgcggccaggtcgtcgcctgcgtcgagcgcgagcgcgagttcggtgtcggcggcggcattgacggcgtcgaccacgtgcgagcccatgcggcctttggcaccgactacggaaaccttgatcattgcagctccttgatgttttcgcggacgcgcatgttgcgcatgtcgtacgtttgccgtgcgcatgtgttcgaaatcgcgtgtccgcgtccataacgtgttccacttatgaatctaaagagacgcttcgacgcgaaggcaggcggctatgacgcttgacgatcgaacgtcggtcagccgcggcgacgcgccagcagccagccaatcagcgcgaacggaatcgaacagcccacgaacacggcgggcaggctcaatcccacgcttggattgaaatggtcgagcacgatgccggtgatcatggagccgaacgacgcacccatcgtgccggcggtgctcacccaggacaggccttcggtgagcgattcctcgggcacggtctccttgacgaggaggttgccggaggcgaacaccggcgaaatggtcaggccggtgaggatctccaccagtcccatcacgatcaggttgccctggcacaggtggatcaccacgaagccgacggtcatcaacgcgaggaacatgatcatgtgacgccaacgggagcctttgagctcgcgcgagccgaagaccagcgcgcccatgcaggagccgacggccagcatggccagctgcacgccgagcacggagtcgaggtgcagcgatttcatgacggcggtcatggacgtgtcgaacgcggtgaacgccatgttgaacacgatgaacacggcgaggagcggcagcacgcccgcataggtgagcacattgcgcttgttgcggtcgcggccgtccgtcttgagccggtcgaggtcgaaacgattcgcggaagcagcggtaccagcagtaccgttcgcagcggcaccagcggccgccaatcgcacgtccgcatcgtcggcatcggccgcgacgaccgtgatttcgcgcaataccggcggttgcgtgtcgcgcagcgcgaagaacacggcaccgccgaccgcgcaggcgatggtcggcacgaacagctgcgatacggggtgcacggacgcggccaggaacgccgccagaatcggtccgaagatgaatacgatttcgtcgatggcggattcgagcgcgtacgcggtgttgagcagctcccccttgccggcgcggtcgagcacatacgcccaacgggtacgtacgagcgcgccgaacgcgaactgcgtcatacccatgaccacggccagtacgaacagcagcggaatcggcacgcgcatcagtgcggcgaacgcgaagcccagcatgacgatgacctgcaccgtcaataccaccggaccgaccttgcgttggccgaaccggtcgaacaggcgcgcgtacaacggtgtgacggctgcggtggcgagcacgtatgcggcgctcatcacgccggcgatcgtccaattgtcgtacatgtggttgagtgcgagcacgatgccgagtcccatcatggacatcggcagtcgtgcgacggcaccggacgcgcagaacgctttcgttccaggtatggagaacagccgcgcatacggcgatgcggtgtccggtgatgtattcgggctgacggttgcgtcattcgcagccatgatcgaaactccttaactgttgttgcgtccggcatgtgcgcccgcccacacatgctgcacgagggtagcggcgttcctccacaacgctgcctgcatagcggtttctcccgcaggcaggccggaaagcgccgctcccccgctttcttcggtcaaggagccattgcgcaccggcactagtcgttgtcggattgctgcggaattccgtagctcaactcggcaaggatctcttcttctgttttgtcgggggcatccagctcccggtcggcctcgtgaggctcactcacatagtagagacaggcgtcgattgcatccaacggcaccccttccatcgccgcgagcagcaggcggtacaggtcgagctgtgcgagtttctctttgatttcgtccggtttgcgtggttttacgccggttttccaatcgaccacggtgtagcgtttcgtctcgtccgtttcgtcgagaccgccgaagaacaccgcgtcgagtttgccgttgacgatggtgccgagctggggcatgtcgacgacgagctggcgttccgcccatgctggacgtcgttttgcccacggcgaagcgacgagacgacgctgccaagcggccagtttccgttcgtctcgcaattgggcgtcctgcgattgcacgccgccgttgtccgcgtcgacttgcgtatcacctatcaatgcgatcagttccgcacgcgactgcgcggccataccggcagcaccttccgtaccgccgatgccgtcgacgtccgcatccgccatgatgaaacgctcagcccatgcgtggaaccgcgtgccgagctgtgccgccggcgaggcgacgtgcggaatcggacggaccagaccacgccagtaggcgcgggagtcacgctcgcccatggaaccggcgcgcgcttgcagcgaggtgacgttttggcggccggcagcaaggatacgttcgcctttggcacgcacggcctcgtcgaaggcgtcctgcgattcgcctgcgtcagccgcgtccggttccggcatgagatgttcgtcggcgacgagcagtttggcgagacgcagcagtgagtttccggtttccggcgatggcgtggcggattcatcggcaacgtcgccctgcgttcccgtggattcagcgatattcggttcgttggattcgacggcacgtacctgttcggccgcggcacgcagcttgtcggcgacatcggcgctcagatcgcacggccaaggcaaagtatggtcgtccgagaccggttcgagcggcgtgttccacgcatcgcccaccacggcattctcgaaatcgcgggcgtgttcgcctacgaaatagccgtcgggcaggtcaagtcccagcgtgtgcggggagccatccacatcgtcggacaggttgtccggttcgcgtaccgcggtgacgattccgttcatcgaatcgcgcgtctccagccagaaattcgacggcgcggcgcttttctttccctccgccaggcgggagtcgcggctcgtctcgttgcatccgctgtatacgagcagcgcctcgtagcgggcgcgcgtcaacgccacgtaggcgagacggcgttcgtcggcgtgcagtcggcggccgtattcctcctgttgcgtcaggtacaggcttgccggatccattccttccatatcgtcgacggccatggttcgcaaggtgccgaacacctcgtcgtcgatcacttccgcatcgtccaatccgtcgagcgattccacgggattgcccccgatgggcgcgtcgtgcgggaatcgtggcaggatatccgcgtcggcgcgcaccggaaccggcaccgcggacgggtcttccagccaagtgtgggctttttcgaagtattccggcggctcccatacgccgtcgcgccgaccgcccggatggtcttcgtccgttttgacgctcaggtggtcgccttgactggacgggaaggtgccgtcgcgcatgccgaccacggccacggcgtcccattccaggcctttcgactggtgcacggtcatgagcaccacatcgacgggggtatctggtgcggtggcgttgtcgtcggacgcgtcacgcagcgaatccacccacgagatgaacgcgcgcaggcttggcgtgccctgcgcggcgatttcctgcaagtaggtgtccaccagagacagcatcgcgtcgagtgacgaagcggcatgcgatgtggcacgattgccggcatccggatgccgcatccgttcggcgagcagcaggtcgatgtccagtccgagcgcggtgatggccgtgcgtaccacttccggcaacggatggccggccgtgcgctgcacctgttggatgacgcgaccggcgtggatgacgctcgcggctcccgtacggctcaatacgccgtcgacgaggtgccgcagatcgccgcgcagcagcacgtcgatcaggaagacggcgttgggcacttggtcgcggtaggcgcgcacggtggcgcggatgtcggcgtcggacggattcgcatccgcctccacgatgccggccgacacgagcgcgcggtagcgttgcgcggtgttgagccgttcggcgatgccggcgagcgcctgcagatcgtcggcggacaggccgaatcgtggcgtggcgagcagccgcatgagcgcggcgctgtcggtgtggtcgcatacgacgtgcagcagggcgaggatgtctttgatttcgggacgttccaggagtgcggcctggccgacgacgagtgtggtgaggccggcttgttccagtgcgtcctcgtaggctggcatctgcgttttggagcggaacaggagcgccacgtgcggacggttgtctttggctccgtcggcgagctcgttttcggttggcatgtgcagtgcgatcgcttgtttggcgaagcgtacgatggcgtcgatttcctggccgaatgtggcgtagccgagcacgccgagcgtaccttcgggagcattgtcgatgttggcgagcgggggcacgtccacttcgcgcataagcgagctgccgcgacgtctggcgggcaggcgcaatggtttcgtcagattgttggccgcttcgagcaccatgcgcgagttacgtcgggtgacggtcagcgtgtagggcttgtcggtggcgtcgtggccgaagtcgtgttgcagcatgcggaatgcgcctgggctggctcctcgccatgcgtagatcgattggaaggggtcgccgacggcgttcaccgcgctgcgatgggtggaatcggcgtggaacagtgcggtcaggagggccgcctgcgtggtggaggtgtcttggtattcgtcgagcagcacgtgcgtgtagcgtttgcggtaggtggctccgatggaggggaatcgggtgacgagttggaatgcggcgatggtgaagtcgctgaattcggccatgttgagggcgcgtttttcggcgtggtagtcggccacgaggtcgagtagcaggtcgcgtttgcgggccgtgccggccaattgcgcggtcttgtagacgcagagttggtggcattgggcgcggtattcgcgcatgcgggtttcgaaggcggtgtcggattcctttttcttctgtttcggagccttgcccactttcggctcgtcatcgggaacgtcctcgtcttcaagcgctttggccacttgcgccacgaacgccttatcccatgcgcgcacgcgttccacggcttcgtcgaagctggtgcagtcgctgccgatcatggctcctgcgatggcgttggatagggtgaacacgttgccggcgatggtggagaatttgccgagttcgtcgccgccttggtcgaaggccatgagctggtccatgtgcttgtcgagcacggtgtggatgagctgcagcgctccggcttcgctcaatggctgcgtgttttggtcgaagccgacgagcaggccgtattggcgcacgatggtttggaagaacgcgtcataggtggagacttccggtttgaggaaggcgacgcgtgtaccgcgtccggcttggttgcgtgtcacggcagcggagacgcgcgaaagcagttcggaggcggctttgcgcgtgaaggtcaggcccagaatcttctcgggactgatgccctggtcgatgagggtgatgatgcggcgggtcatggtgtaggttttgccggagccggcgcccgccaccacgaccacgtcctcgtatgagggggcttggatgacggcggcctgttccggactgtcggtgaatttcggcgtggcggccggcacagtgcccatcgcatcgccctttgcggcggccccgttcgttgacatgcttccgttcataccgttactcccgttcatgccacggtcctttcgaatacggtgttctgctcgccttggcaggccgggcagaccccactgccgtacgttctgcagtatccgacgtgttccacggtcggacgcgcggtgatgcgggtggcccggctcgccgcggccgcatagaagacgcgggagatcatggtcagcgaccataccgtcatcttcgaccgcgattccagaagttgcttccaatgttcttcgctgacctgcgccggccgttcgacgtcgtcgaggccgctggtgaagacgctggccattttgggcacgtatttgcggggtatgaaatcgcccgcgttgatgcttccgccggcgaacagcgcctgctggtggtacgcttcgtcgccttgccctttgcgtggcgcgggggccgcgtattccatgacgtggaacagggcgctttgggtgatgtccggcatggttgcgatcgcctgcgcgccgcgttttccgccgtgttccgggaatgcgaggcccagctggtagcagacgagctgcaggtcgctgaacagggagcgtccgttcggcactttgccggttttgtagtcgatcagccgtacctgttcgcggccgtcggcggtacggcggtgttcaagacggtcgattctgcccgacaggcgtacggtgagccggtcgctcatgccggtttccggccagccgccgacgagcgcgcccatgatggcgatgagttcgtcgcgggagatcggagcgttgccgtcgatggcgttgtaggcgtcgaggatgtcatcgaagtcgaatcgcgcggcgaactgccgttccgcttcggcatggtccaacgttcccacggtgatgttttcggtgttgttcgacgggtatcccgtacggttcgacttgacgaaatatgtggcgatgttgcgcaatgcgaccgacgccttcgcgtccttgccgagcgccttgtaccgttcctcggggtcgtcgatggcgttgaggtcgccacgtagggtcttgtatcggccgatcatccattgggtgatttcgtcgatgttgtcctcgtcgcttactgcggtgtggttttggggcaggtcgaggccggcttcggtggcctgttgcgcgacggtgtggatgagcgagccgaagctggtggccgcgctgcccatgcgtgggccggcgaaacggttctccagcatccagcacaccgggcacgcccacaaactgtccacggcggatggagaaagggtgaccacgtcggattggccgtctgttttttcgatggattccggttgttcgataagcttcgccttgtcggcatgctccgtttttccgtcagattccatcttgccgtcgatttccgtcatatcgtcggctcccgcatgtcccgtaaggaacgcccaattgtcgggattcgcggcggcgatgccatgcgatgccaacaacgccaaggcttgcgcggcatcgcgcgcttgggggaatcggccggcgcatgggccagcacgcttcgcgcggcggcgaccaggccacgcgggtcggcctccagtcccgcgtattcgccggcctcgccgaccgccgtgtacacgcgtgtttccgcatcggcatcccggtcgcggtcgaaccattccggcaggtagccgtagaggaagtcggacggcacatggtcttcgttgaggaccgcgcttaccgtcacgcgctcatcggcgcgggtgagcgccacaaggaggcttttctgttcggaggcgagcaccgcggcgagctgcgcgttttcgcggcctgcggaggtgacgatgtcgtcggacagtcgtccatgcagcatgatgtcggcgagttcctccccgccgaacagggtgttgcgcggtgagaggttcggccattggccttgttggaacgcaggcatgaatactagtttccaatgttttccggcagctccggcgggcgtggtgagcgtcacggcctgatcgatcggcgcggtgtgcgccagggagtcggcttcgatggcgagcgcgcggacctgttcgatgaacgcgtcgatggtgtgcgctgccgtcacgccgttcgattcgccgccggacgcgtagctgaacaggcgcatcgcggtgtcgagccggtcgttggccgcgcggccttcggcgttgttgcgcaacgccgttttctgccagatttcggctttgccgaacgcctgccatgcacagtcgagcatgtattgcggttcgtgggatgtcaggcgtgcctccgaccgcagggtatcgtcgagcgctttccacaggcgtgcgaaggcttgcgcttgggggtctttgcggcccagtacggaggcgatcgcgtcgagcacgcggtcggtgtcgccttccaatagcaggatgtacagcgcgttcatgccgaaggatggttcgtccgcgtcctcagcggcacgctctcccgtcatcagccggtcgtcggtgtcgattgccggcaggcccatgtcggcagcgttttccgcgtccgacgccgatgccgccgcgcgtgcggtgtggaaggcttcgacgtaatcgttccaatcgtcgatcagctgtggcagcagcgcgcgtccggacgtgtcggacgtggtcggatcggctgtatcgtcatgcaaaaccgtggccagcgagccgagcgcgttcatcgccgattcgaccacgcacagccgagccggacgttcgccgggggtggtgatcagcggcgagttcatgattgatgcgacgcgtgagcgcacgtatgcgccggccgtgtcgaggttcatggacgaggtggcgatgccttgccgtttcagttcggccagttcgatcatggagaacaggccctgcacgaacggttcgtccttgagggggcgggtcacgctcgaatagcgtacgggcacgccgtcggcgcgtagccgttcgccgaacgtgcgcacggtggcgttgtcgtgggcgatcacggccatgtcgttccagtcgcggccgtgttcgagatgttcggttttgattttccacaccacgtcgtcgagttcttcgacggtggaacggtacatcgcggcttcaagactgccgtcgtgcgtctccggtatggcgatggccggcattttgccggggcggttcgccagcgcgtcgtcggtcgattccgtgctggcgatggtcaggctcacgcggctcgtcaccgcggccaggtccgtgccttcggccatatgggacggttccagccgtaccagtcgcgcgcccaatcgcgattgcgccatgttgaacagatattcagggtacgatccgcggaacgtctgcaccgcctcgtcggggttgccgacgagcagcagacgcacgccacggttgcgcaatgcggtgagaaagtcgaagccggcgagtgtggcgtcctggaaatcgtcgacgatgacgagtttcggcaggtcggacgtttcggcttcgttcacggcggccgcggcgtcgatcatgagctgcgaggcgtcgagacggtattggtccggatatgcctcgttgatggcctggttgtattcggcgcgcagcgcgaaggcgagccgccattgcacgcgcagtcgttcgcgtcgttcgtcgagcgtgccgtgctcgtcggcagcgcgggaaatcagcgcgtcttcgagttccggtttcgcgccgatctcgttcatgcgggcaagcatgtcgcgcagctggttggcgaaggcgtcggtggcgtcgtccaccaccatgcccgaccagtcggcgaccacgaagtaggtgcgcaatagcgcgcaggtggagcattcgtcgccgtgctcggcatgttcggcatgcctggcgagcacacggcggatgaccacgtcctgttcggccccgttgagcagtttcggcaggggttgtccggcatgcgatcgcacggcggtcatgatgcggaacgcgacggctggcagggtggtgacggggcgcgcctgcgagatcgcggacagttcgcggatcacggtgtcgccgagccggtcggccacctgtctgccggagaccgtcatcacggcgtacgcgtcgccatgccgcttcatcgcggcgaccagcatgtccagcgcgaaccgggtcttgccgctgcggggtgcccccgcaaccaatgtcacgtcatcgagatcgtccacatccatcatgtctccccagcttagccgaacggtccgtcctgcactcatatatcaccggacaaaacggccggacaacgcagccggacaaacacaacagacgccccaaaaaagcggtcagccagaagggacaaaaacctgcgaacaatccgcgatgcggaatgcggctactgcagggaggcccacaccgtggaggagatgtcgcggatctgagcctgcgcggccgaggaatcgggcacgtcggaactcatgacggcaatcacgtacggatgttcgccgtagacgatcgcggaatcgttctccacgcccggagcctcaccggttttgttcgcgcacgccacgccttgcggcagtccggccgggattttggcgcggcgggtctgcctggacatgatgtcggtcatgcgtttgctgtagccggcggacaccagctgcccacggtaggcggcggcgaggaatcgcccctgatccgccacggacgtctgcttggtggaataattggacagatcgcccatccggctgttcaaatgcgattcgttgaacccgtattgcgcggccaccgagttgaccacgccgaatccggcgttgatgtttccggagccgagccgctccaccagcgcgttggtggcctcgttcgaactgactgtgatcatctgttccagcaacccgtccagcgaggcgtcttcggcgagcgtgccctccgacaccttctggaagacggcgagcatgaccatgagtttgacgacacttgccgaatacgattggtggctgttgaccacggctgtggccccgctgtcgaggtcttcgacgtacacctgccaggaaccttggtattgcgcggtttttccggataattgcgattgcagcgcggccagcagcgtctgccgttcggccgtctgcgtcttgcgttcgtctgctttcggggtctgcttgcgatcgagcgcggtatgctccgccgccgtttcgccacgcgtggccggcttggtcggttcgttcggttcggccgatttggcggagccgtccgcccctttgacggcgggggtctcagtcttcgccacggccgcagcggaagaggccgcgccatggcgtcgcgctcccgcaattgcaatggcgcagccggcgagcgccacggcgaccacgcaaacggctgcgatcaccgcgacggtgattcggcggcgcccgtcaaacgcggccctggattgttccgaagcccatcgggggtaattggagtgacgtcccatatcggcggcttaattcctgagcatagtgttccacaccttgtccagcatgcgcgatgcgagctgggcggccacggctctgccctggttctgcgtcataaccgccacggagaccttcttcttgccgttggagatcaccatgaagtagttgtaggagtctttgatgccttggccgcggtgcgcgtgaacggtcgcgccggacggaatgaccacgccttcggaggcgatgtcgtagttcatgaggccgtcgtctccgttctccgccatctcattcagcatgcgggccgcgtcatcgggcgacgcgtagttctcgtagccgttctgcgacgctttgacgtctccgtagtcgcgttcgaaccgcgtgcggtagtacttgttgtcgctgagccattcgttgaggtcgctttcgccaccgaccgcatcgatcagcccgttggccgatccgttgttcatgccggtcagcgaatcggcgtacgcgtcgggcctatcaccgtaggtgtcacgatagtcgagccatgccggcaggtacagaccggcggcgacgaacgacaggctcgcgttgcgcgacgaatagctgcgcagtccgtcttcgttcatgaccgaaacgcccacatcgatggtggagtagccgtcgacgatggaatcggtcgagcttttgtccagtatgcgattggaccgccggtcccgttccttcgaagcgtcggttttgccggatttgcctggcttgtccgattcatccgactcgccagccttgcttgatttgccggatccgccggttttatccgacttgtccgactcgcccgatttgtccgacgatttgccgtccgccttcttggctttcttcttcggcttcgtcgtttcctgcgattgcgtggccggctggaccccgttcgaattcgacgtgttcagataccagacggttccgccaatgagaatggcgatgaccacgatggccgccacgatgatcatcccaacgccgcccgatttgccttgcttcgcaggtggcggcaatgggccgttcggcacggtcggcggcacagcgggcgacacggtcggcgatacgaccggaggaacgaccggtccgggttgcggcgtcaacacgctggagggtgcgccgtcgaccatggtgccgtcagcgttgccatccaccatggttccgtccgcgggacggccgccggcctgcgtctgcaatgtcagaccgcagttagtgcagaatcgtgcgttctgatcgttgtgaacgccgcaggatggacaaaacatatgccttccccctctttccccaatgcttctcttccggtatttcaacagccgacggggacaggcaccgcacgcccggcgtctaccctttggaacctccgcggcacacgggcaaacccccatataatatagcaaggcagagcgcggtgcattatgcctgtcccaatgcgagccggcagacgcccatcgcacacagaggaaagaggaagcatggaagcctcaaggagcattccccctcagattcccggctacacactgatcaaacggctgggctccggttccgaagccgacgtgtacctgtaccagcagctttccccggcccgtcaggtggccatcaaaatcagcaagaacacgctcgacccacgtgccgcggtccgcttccgttccgaagcgaatttcatggggcagatctccacacacccctacattctttccgtctatgagaacggcgtgaccgtcaacgggcgcggctacaccgtgttcgaatacgctccgggcggcaattacaagacgttcctcgagcatggccgtctcaccgccgaccagatgctcaccgtcggtatcgatctggcgagcgcgctgttcaccgcgcatcgcaaaggcatcatccatcgagacatcaagcccagcaatattctcatcaacgcgcacaatatgcccatgctcgccgatttcggcatcgccgggaccgtctatgggcgtccgggtgtcggcttcaccatcgcgtgggccgcgccggaggtgcttgcccaaggcggtggcggcaatgaatcgtccgatatctattcgcttggcgccacgctgttcgccatgctgatcggccaatcgccgtacgagtatttctatgccgatgtgctgggcgattcccaacggcaggtgcgggccgaacggctcaagtccgtcattctcaacaatccgctgcccaaactcaaccgttccgacgtgccggccgaagtggaatgggtgttgcgtaaggctttgagccgtgcgcccgaggatcgttactattccgcgttggagttcgcgcgcgacatgcagcgcgtgcaacaggccttgtatggccgtgccgtgcagaccaccgtcgagggtgtgccggattatccgcagaacatgtacgcgcagacttccacattcgaccagtccgccccggttgcgaagcagcatgcccggtgggtgaagccgttggccgtcacggttgctgcggcggccgccgtggtcgtgatggcgttggcgttcgtcaccgtcgtcatgccgaatatggatgcggcttccgacaacagcaaggtgcaggtgcagaaccatggcgcccagaaccatgccgaggacgatcccgattcggcgatcacgtcgggcagtgtgccgagcgtgcaggatcttacgggcgaatacaccgccgacagcaaagtgcggttcacgtgggtcaatccttcgccgaaggatggcgattcgtacgcgtggtcgctggtcggcgattcgggaaccgacccgaacgcgcagggcaccaccacggagtcgacgagtatcgaaatcgatccggccgacggcgcgcagacgtgcgtgcaggtgagtctggttcgcgcggaccggcagatgtccgagaatcccatgatcgcgtgcgcggccaagccgtgagtttgcggccggatgcgggtgacatgaaccgatacgaaccaatacagcccggcatgcatgcgggcaaacaggtaggcgcatgcggttggatgcgcggtcaagcaaagtttgggcacaatcagggaagagccagtcgatgagcaagcataggaacgccgagaaccagtcggcgcaatcgtacgaacggcagttgcgattcgggtcgatgctgcgcaagctgctgccttccggcagtcgccggtggatcacgccgatcgtcatgctgctgctgttgctgggcatcgtcgccggggccgtcatcgtcagttcggtgacgcaacgtcacgtgcagctcgacgatggcaccgtgtgggtcacttcgctcaaagaccgcaaggccgcccgtttcaacgtgcgcaaccgggacgccgatgcgggcgtcgcctccactgcggcccggttcgacgtggcccagcatgatggctccaccgtgatctccgaaggtacgaaggccagcaacatcgaggcctccaccgtcagcgaaagcggcaacaccaccatcaaatcggatatgcggaccgtcgtcggaggcaacaccgcggcgttcatcaacgtcaagacgggcaatgtgtgggtcgggtcagcagatgatgtgaaatccatgaatccgaccaccgattcgccgaagatgaagctggggtcgggtggccgtatcgcggtgacgcatgacggtgtcgtctacggctatcgcgcgtccgacggcgcggtgctcagtgtcgacggacctcagggaacgcccggcaaggatgcgacgatcaagggcgccacgaatgtcgaatcgttcaccgtggtcggcaagacgccggtcgtagccggtgccggcaaggtgttctggccgaagggcagcgcggatatcggcctgcagggtcaggcgacgttgcaggcgccgtccacggatggcaggcagactggctgggtggcggtttccacgccgcggggcatcgccatggtcgatttgggtagtaaaaaggtcacgcagctgccgaatgccggcaagggcgatgccgcgcagccggtgtccaccaatggctgcgtgttcgccgcgtgggcgcagaaggccaacaattacatcagggtgtgcgcggcgaacgacaaggacgcacagttttcctcgttggaagatgtcaatcccacctcgcagctcgtgttccgcaccaaccatcgtctggtggtgctcaacgacgtggtcaacggcaatgtgtggaatccgcaggagtccaccaaggtcatcaaaatccagtggaacaaggtggagaccaagcagtcgaagcaacagcagcagaacaacgacagcgccaacaaccagcataatttcagcaagaactgttcggcgcagtcggggcagatcaaggccgtggacgattcgttcggcgcgcgcgtgggatcgcagcagattctcgacgtgttgcgcaacgacgagcagaccgactgttccgtgctgcgcatcacgtcggtgagcgctccggatggcgcgaacatcaccgtctcccccgtctatgacggccggtatctgcagctcgacgcctccggtgccgccgcgggcaacgtgtccttcagctatgagatttccgacgggcgcgggcagacgtccagcgccaccgtgtcgctcacgctggccggcggcgacgaccatgcgccgctgcagagcgacactccgccggaaatcgacgtggagcagggtgcttcgtacaccgcgaacgcgttgggcagcttctccgaccccgacggcgatccgctgaccttggtgtcggcatcgccgcagaacaccgatcaggtgacggtgtccacgcgagccgacggacaattggtcttcaacgccggttcgatgtcgtccggcagggcgggcatcgaggtcacggtgtccgacggccagcagaccggcatcggcatgatctacttctccgtgaagccggcgaacacgctgggcgcggtcatcgaccccgtggtcaaacagaccacgcccgacacccgcaccaccatcgcgctcaaaccgtacgtgcacggcacgtccgtcgaaccggccgaattgaccgcggtggagacgccgtccggcgcggccaccaccatgaacgccaccgacatgtcgatcacgttcaccgcctccaatcccggcacctactatgtgccgtacaccatcacgcagggttccattccgtcgaccggtctggctcgtgtggaggtgcaggcggtggccggagacgccgccaagccgatcgcggcgaacgatgtggcgctgctaggcgcggacaataccgcgattgtggagccgcttgccaacgacgtcgacccgatgggcggcgtgctgtcggtgaccagcgtcaccgcggacgcgcaaagcggcatcaaaaccggtgtggtgagcaacaagcgcgtctatatcaccgcgcgtcaggtgccgaccgagccggtgcggatctcctacaccgtggccaacgcggccggatcgtcgaccggcgtcatcgtcctgcagccgccggcgctgaccacgtcgaattccgtgccaaaggccgagaacatcaccacacaggtgcgcaccgaaggcatcgtgtccgtggacgtgctcgaccatgtcacgtattccgacggcaccacggtgagcctgcagaacgacttgcagtatgacaagaacacgttcaagggtctggtgttcgtgtccggcgacaccgtgcgctatcaggccaccagacaaaccggctccttccccgtcacctacacggtgaaggacaatctcggcaacgcggcctcggccaccatcaccatcaacgtgcatcagaaggacgcgtccaacaaggcggctccgacaccgtccgacgtcgaggcgcaggtggcggccgggcagaaggtgcagattccgatcacgctcaccggcatcgacgctgacggcgatgacgtgcagctgctcggcttgggcaacaaagcgccgaaactgggccgtatcagcgagatgggcgccacgtatctggtgtatgaggcgtatgccgattcgtccggaacggacacgttctcctacgccgtggaggattggaccggtcagagggccaccgcgcaggtgcgtgtgggcgtgttcaaatccggagccgattcgggtgtgtacgcgcgcgacgacgagatcacgctgcgtccgaacaccgcggccaccgtgccggtggcgcagaacgacatttccggggacaatactgatctgaccgtggccaaggacgtggaatcgcaaggcatcggcggcattcaggtcgttgacaacatgctgtcgttcaccacgccgaagcaggcgggcacgtattacgtggtctacaccgtcaaggacaaggctggcctgtccgattcggcgacgttgacggtgaatgtcgacgagaacgccgccatcgacccgccgaccgcgtacgattaccgtgttccggccgccgccacgatcgacaagaaatccgtggacgtggacgtttcgcagtggattgccaatccgtccggcaccgccgacgagcttcaggtgggcgtggatccttccgcgaccgaccatgcgcatgtcaagggcggcaaggattccaccatcatcaccgttgatctgaccgatgaggcgcgcgcggtgccgtacaccgtcacgaacacgacgtacggcatcacgtccaccgcgttcatccaagtgcccgcatatggcgtgtttccgccggttctgcgtccgaaggcgccggcgttgaaggtcaatgcgcgtgagaccatcaccatcaacatcgccgactacgtgcgtgtgggcgcgggcaagaccgcgtatgtggacggcgccgattcggtgagcgccacgaaggccgcggacggcgacctgtacgtcaacgaccagacgttgaggttcaccgcgccgaaggattacgcgggtcccgcgtccatcaccttcaccgcggtggacggcaagcgagacaagaacgacaaggtgaagatcgtcaattcggcggtgctcacgcttccgatcacggtgatcggacgtgaggttccgccgccgacgttctcgtcctccaccgtcgatgtggtggccggcgagaaggccactaccatcgatctgacggcgctgacccattcgacgtcgggcctgtacgaggatgagaagcagtactcgtattccggcggcgtgaattccggcagtgtggatgccagagtgtctccctccggcacgttgaccgtgtccgcggacaagacggccacgccgggcaccacggtgagcgtgcccgtctcgatcaaatatgcgaagggtacggtgagcgccggtatgaccgtgcgcgtcaccgcgtccaacaggccgctcgcccgcgtcaccgagaagaccgtgaaaatcaaggccggttccagcgagcaggtgaatctgctgtccgacgcgtacaatccgttccccgacactccgctgacggtgaccggatgcacatccgacggcgcgtcgaagctgacggtggattgcccgtccaacggcgtggtgtccatcagggcggcttccgacatcggcgcgagcaccaacaaggtggtcgtcaccgtgcgcgacgccaccaaaacaaaggaacgtgaggtgaccggcaccatcagcgtttcggtgatggacaagcctgatgcgccgctgctttccgcggtgtccggcgacccgcaggatggcgccgtgaatctgagctggacggccggttcggccaacggcagcccgatcaccgaatacaaggtgatgtggggcggagacgcgtccggcgagcgctcgtgcgggcagaagacctcctgtctcatcgacgggttgaagaacggcaagacctactcgttcaaggtgcaggccaggaacgaggtcggctggtccaaggattccaacgccgtcgagggcacgccggacaagctgcctgatgcgccgacggatgtgacggccagtgtgaagggcaacacggtgagcgtcacgtggaaggctccggacggcaatttctcgtcggtgaacaattacgaggtgactttgtccggcaggaacgcaccgtccaagcagacgacaaattccaccggaatcgattttgttttcgataacaacgcgattttcgacggcgactcgtacacggctacggtacgcgcccacaacaaggtgaattggagccaaccgtccaaggcgtccgacgctgtcaagccgtggggcaagcccgatgcgccgaagatctccgtgacgaacgacgacaccacgggaaccgtcaccgtcgaatccgtgggcaacacccacaacgcgggatgcaaggccgtcgagatttccggagatgtcagcgcaagcatcgacggatgttccggatcctacgatttcaagattccggatcatgatctcaacaccagggaatacaccatcaaggcggcggtggtcggcaaggagaaaacgaccagtgacgattcgaccgtacgtttcacaccgaaatacgcggtgaaggcgcccgaatcggtcagcgtcaaggggcatgacgacgtgtgcgtagtcagttggaaggagaacggccacgccgacgggttcacggtgagcgcggacggactcggctcctaccatgccggcgcttccgaacgatcgcacgatttcccgctcaaggaatggcagtcctgttcctcgggctccgtcacgcagcatttcaatggcgcggcaagcacctccaagtccggcagggccgatccggcatacgtccgcaaggtgaaggccgccgtcaaggcgccgatgctgacgtgggacgccaatgatccgaacatcatcaaggtcagcggcggatcggtgaacatgtacggccagcccggcaaaaccgtgatcaccttcaccgcggacggcaaatcctatgacgtcgcctgggcattgggctccgacaaactgaacgtcaaggatgtgctgccgaccggagccgattacgcgtggaaggcgaaggtggtgggcaccgacaccgcgctcaacaacgaggacaatggcggcacactgctggaccatgacaggtacaagactcccacgccgaaacccgaaccgtcggaaccttcagaaccatcaaaaccgtcggaaccatcggattctgacgcgtccacggaaggcgaagcggccacgcggaatgaccggcctgtggcatcctccatcgccctgtccaccgtcgacggcgcatccaagccttggatccgcggcctggcctactacgccagatggtgaaacggacgatcacagcaatcgcaaacacaacgaaccatccacacgagcaacacaacaagcaaggagcaacccatgagcaacgatttcgatgacgccacccagctgggttccatcggccataatccaagcgttcccagccaacccggccagcagcagccggcgttccacacgccgaatctgccggagcagccgcaagccgatgaggatccggagggcacgctgctgagcgcgcacggcaccacccaaccggcgttgccgcaacagtccgccccggcaacgccgaaccagccgcggttccgtcagccgatgccgcagaaccttcgccaaccggccgccaatccggcagtcgcaatgcccgcgcagcagcccgtccagccaacccaacccgtccagcccagccagcctgtacagcccgtcaaacaatcccagccggtcatcgacacgtccatgatgaccgcacccagcaaagacatcaccgaattccatgagaagttcgccaagctcgtagacaacgtctcccaggtcgtggtcggcaaggaagcacccatccgccaatgcgccacagccatggtggtcggcgggcacatcctgctcgaagacaacccgggcaccggcaaaacccagctggcgcgaggccttgccaactccatcgacatgtcgttcaaacgtatccagttcaccccggacctgctgccgtccgacgtggtcggcgtcacctactacgaccagaagcgcggcgaattcgaataccgcgaaggcccgatcttcgcgtccatcgtgctcgccgacgaaatcaaccgcgcctcaccgaaaacacagtccgcactgctcgaagtcatggaagagcagaaggtcaccgtcgacggcgtcacccacccggtgccgcagccgttcatggtcatcgccacccagaacccgatcgaacagctcggcacctacaagctgccggaagcgcagatggaccgtttcctcatcaaaaccaccatcggctatccaagccacgacgtgagcgtcaacatcctgaaacaggtcaacgtcaccgaccgcgccgccaccgtgcatccggtgctcaccggcgaagacgtgctgcgcatgcgcaacatcagcgaaaccgtgcatctcgacgacgcgatcctcgaatacatcgtgcgactggtggaagccacccgccacaacgaacgcatccaagtcggctcctccatgcgaggcgcgctcgccttgacccgctgcgcgcgcgtatgggccgcctccgacaaccgcggctacgtagtgcccgacgacgtcaaaaacctcgccgtacccgtgctcgcgcaccgcatcaccctcaccgccgaagccaccttcgccggaaacacccccgaacagatgatcggccagatcctcgaagacgtgccggccccaaccctgggcgccaacgcctgaaacacaatccaccccggcatacgcaccacacaatccgaaaggtcaaggaatgcggcattcgcacacagtgcagcgcagacggaccatccaacgatccctacgccgcctcaaacatcgcatcaagcgactggccacctcatacgtgtcgccgcttggctgggcggtgacggcgctcgccgtcgcctcgctggtggcgttcgtcctgctgggatggcatgagctgctggccatggcggtggtgttcgcggtcatgctggccgcggcggtcatgctttcccttggcaacacctcgttccaagccaccatcgacgtgtccagcagacgcgtcacggtgtcagacacggtgaaagtcgacgtctgcgtggacaatccgggccgcacccccaccacgtcggcgcgcggcgacctgcccatcggagacaaccacgaacggttcgccattcccatgctcgccgcaggccagtcacgccagacgactgtggaattcaccgccgtcagccgtgcggtgctgcccatcggcccgctatccatccgcaaaggcgacccgttcggtctgatccgccacgaaaagaaactcgtggaccagatcaacgtgttcattcatccgcagaccgtgctgctcagcaccctgaacgccggcattccacgcgatttggaaggtcagccaagcggcgaaatcgtcgacgacgacctcgacttctacggcctgcgcgaatacgagcccggcgatgacgtgcgcaacgtgcattggctcagctccgcgaaaaccggatcgcttatgatccgccaatacgaagccacccgccgtaccgacaccgctctgaccatcagcgtgaacccggatgattacatcgattcccaggaattcgaactggccgtatccgtccacgcctccatcggcgtgcaatgcctgcagcagaaccggccagtcaccgcgcatgccggttccacgcacgccattccgcgcaacgccacggaatttctcgatggctgcagcggcatcgaccctgacatcgacgacaatcccaacctcgcgcaaaccactctcgaacatgcccccgacgcatccttctacttcttcaccgtcggcaggctcaaaaccatcgacgacatcaaacacatggtcctcgcactcccccgctccgcaacctgcgtggtgcttcaagccgcaaccggccaaccgcgcgccatcaaacgctactccgacttcaccttggcaaccgtgggagacctcaacgacctccccatgatcatgggggtgctggcatgagcaccacattcaccaacaccgacaatttcaccggcaacctcaccggcacaggcaccaactccgccaacaccaacactggcatggcgaccggcacaggcaccggctcatgggcggactccacccactccgtcatctggatgtcccgcagcggcaagtccccagccatgcccaacaccaaccagccacacgccgcgcaatacgcaagcctcacggtcgccgccctgctgaccatcgccgcagccagcaacctcatcgacgtatacggctccgccctgtcttggacgagcgccgcaatccccgccaccatcatcggctcgctcgtggcgcttgccggtctcgttcccgcgttgcgcctgtggtggcagatgctgttcatggcgtgtgcgcagctggtggtcggcccggtcatcttcctgaatggcaccaccatcgcccatgtcattcccacactgcgcacgttgacgcaagggtggatgcggatgctcggctcgttcaaatacctgctggccatcgacccgccgaccggcaccggcgacggctcgctgctcgccgtgtggacgatctgcctgtgggccgcgctgctggccggtattttcgcggttgcggaggatggccggcttacgatggtcgcggtcgttcccgtcgtggcgaatcttgcgatctgcgcgctgcttggcacgtcgagcggtttctaccgtatggcgatcggcacgattatggcggtcgtgctggtggtttgggtcagcgcgcgttggaaactgttggaattgggccgttggctcagttccgtagtcatcgtgctgctggcttcggctgtggcgatcggcggatgcttggtggtcgggcaaaaccgcaccattctgcgcgaccattatgatccgccgctgagcccgtacgattacaccagcccgttgagcggcatgcgttcgtatatcaagaaccataaggacgatgtgctgctgaccgtcgacgatctgccggccggttccacggtgcgtttggcggttatggaccgtttcgacggcaatgtgtggaacctgtccgattccaccatggcttcggattcctccaactaccatcgtgtgggcgattccattgcaaacaacgccaccggcaagcggttcaccgcgaaattcacggtcgatgacggtttgagcgactattggctgccgatggccggcgcggcttccagcgtgaagttcgccacatcgtcggacgccgattcgttctactacaacaccgacactatgtcggcgatctacccttcgcgcacctctccgggattgtcctatacggaaaccggcgtcattccacggacgccgacgaataaggagatcgccaaggcgaatgcttcctccatcagccagcccaaggcggaggatgtgcccgattgcgtggataagctggccaccgcgattgcgggcggccagtccaagggcggcgaggccgcgcagtctcttgccgacaagctcagggaatccggctggttctcccatggtttgaatggcgattacccgtccagggccggtcacggcaactatcgcatcgaccagctgctcgccggcagtgcgatggtcggagacagcgagcaatacgcttccgcgatggcgcttatggcccgcagtctcggcttgccgagccgcgtggtgctgggcttcctgccgaagaacgacgagggcgagatcagcgacagccgcaccgagaagcatggcaaaaccaccaccacgaaattcaccggcaacgatgtgaccgcttgggtggagatcaagctggacggttacggatgggtggcgttctacccgacaccgaaggaaacgaaggttcccgacgagaaccagaatctcactccgcccaatccgcagaccttggtgcgtcagcctccggtgccgcttaccgatccgctgcgtgacgacaaccaagccaagggcaaaacgtcgcttggcggcagcatggccgacgagacgccgacgagcctgttctggcagcgtttcggcagaatcgtcagaaaagtcgccatctacggcagccctctgtggacggtgctcatcgtctgcggcctgctgctcgccatcaaggcgatcgccctggctcgggcgcgcaggcatggcagcgcatcgcaacgcgtcgctgccggatggcaggcggtcgcggcgcttgcccggcaaagcggccttgacgtccaaggcaccagaaacgagcaggcgcaggccatcgccgaacagatgggcttcgaagccgatacactgctcgcgctgggcagggaggctgattacgcggccttctccggaggcgatgtcacgcaggagcatgcggaacgctactggcatgacatcgccgaagaacgaaagttcatgctcggctcgctgccgacgttccgcaggtggcgggcgaaactatcgcttgcggacgtgttccacttccggaaaatccgcttgcggaaaatcggtgtgaaagggcgggactcatgaacgtcaaacatattgaggtcggcctgaacagcaatatcggcttgcgtaggaaagacaaccaggacagcgcctgcgcaggcaacggcgtgtatgtggtgtgcgacggcatgggtggcggcaagggcggcaagcaggccagttccgatgttgcggaacggttcgcgcgtttggccgaactgccgacgcgcgatcttgacgcgattgaagaaacgctgatccttgcccagcaggaggtgctccgtctgggtgagcagctcggcggcgttgcgggcactaccatcagcggcgtgctgctgccgacgcgtgtcggcgatgacgcgatatgttccgacgaacggtgttacatcgtcaatgtgggcgattcccgcacgtaccatatgcgcgccgacggcaatggcgcgtggctggcggattcgctgacgtgcatcacccgcgaccattcggaacggcagaacgccatcgattcggggcagatgctgcccgatgaggcgagccgttgcattccgcgcaacatcatcacgcaatgtgtcggcgcgcctgccggcatccagcctgactggtacgccgcgcatgcggacggacggttcatcatctgttccgatgggctgcatgcgcagatcggccgtgagcagcttgccgagatcgcggcggcgtacgccgacccgcagatggccgcggacatgttggtacgcgccgcgctgaacgccggtggccgcgacaacatcaccgtcatcgtggtggatatgcgttccgatatgccgtgcgacaaggattggaacgtcagcaagatcggcgatgacgaggatatcgacgatgtgctggacggtacgttgcaaacgttacgagtcattcaataagatggttacagaccacgagacaaggagatcatgatggtcgatttcgatgccgcggtggcggccgtgcaggatccgaacgccgatcccatgttcctggcgaaaatcgcgtacgagaatccggaattcggtgcgaatgtcgttgccaatccgcgagcgtacccgggtctgaagcgttgggtcgccgaattcggcgatgagcgcgcccgccagcagctggtggcgatgggctggccggttccgcaaaatggcgtgcagccgcatctgattgccgaaccgacggcccagccaatggccgaaccggttgccgaacaggtccaaccggaacagcagtatcagccggcagtggcggaacagttccagcaggagcagcagtatcagccggaacagccggtgaaccagcaatacggtcaggacgctgcctatgcggcgtccaacgaggcttcgaccgagtatgtcgacccatacatgaatcccgccgatttgtccgaagtggccgattattcatcgagccagccgcagaacaagccggaacagcagtatgccgaacagcagtatgccgcggcccaggaatcgccggcagacgcggggttcaccgcggaactggccatgaccaccaccgatcagatgctgatggcccgtatcgccagcgaagcgtcggagcttcgtccgtgtcttgcgcgcaatccgtacatctatccggaattgcttgcctggcttggccagttgaacgattcggccatcaacgcggccattcgtctgcgccagcagtgagctaacgccgattatcagaccatttgaaacataaggggttgtcgcgggaatctccgtgacaaccccttatcgtcttaccgctaaccgtccgcgccgacgctgccaacacaaatcgtcaacgcagtccgtcagcgtaatcgtgtcttcactgacaaacgccctcactgtttgcggaattggaagaactggtcgccgatacgcaccgtgcatggcgcctccagctgcatcggcttgtgttccactttggtttcgacatcgtcttggatgatgtacgtgccgttgagcgaaccgtaatcctctatccacagcgtgccatcctggtcgaagctgatcgccgcatggttgcgtgagattgtgcgcgtcggatcctccagcttgaccgatttggcgccggcgggcacttcggccgaaggcttgcgaccaaggagcacgcccatatccacgatcacctgctgtccggtctgctcgttgtccagcacgtacgtgtgcttcggctgcttcatggtgaaggcttcggaaagcacggtgccgtcccagtcgatatcgtcctcgtccgaaacggcagcgtcgcccttcgcaacggaaacatcctgcatatcgtggtcgtccgattcgttctgtgcggcgagccgttcgcgtgtttccaaggaatcggcggcattgtcgacgggttcggctgtgggttgcgccatcaccgtgacgtcatcgtcataccaccctggttcgggcggcggcgggtaaggtagaaaactcatattcccattgtagaaaggtgacgtccatgccgtctgacgatactcattctgcaatacgatgctcgcatattccatctcaaaatagtcctatgccgagtatggcgcggatatgcaggaaagcgtcagcaagaagaaggacattgtggatcagatggccgatctgaatctcaacgatatcgagtatgggtccgccgattacgaaaagcttcaggatcttcattcgaagatgtccgacatcgattcgccgaccctggatcagtccgatttgcaaaaggccgcgaaggaggccgatctcagcggttcgttgaaggatctggaaaccacgctttcggagaagatcaagtaacgtcaaaagacgactgcgaaaccctcccccgcgattaatccacaacctcgcaatcccacgacatatagatatagcgaaaggcggaaccgaccggtattggtcggttccgcctttcgctatgtcagatgattcgtctgtcgactatcgtgaggggaatctcacagggtgtcgcccagatcggtctggccgccgttgtcgtccaggaagtcatccgggttgaagtcatcgcccagcttcaggtcgccgaagtcgatgttggagaagtccacatcggacaggtcggtgtcgccgaaggagctgtcggtgccttcgccgcccaaaccgaagttcgggtagatggtgtcgcggatggccttgtcgggctccaccgtggcattgcggtaacgggcgaggccggtacctgccgggataagcttaccgatgatgacgttctccttgaggcccttcaggtcatcgaccttctggttcagggcggcttcggtgagcacgcgggtggtctcctggaaggaggccgcggacagccaggaatcggtggccagcgaagccttggtgatgcccatcagctccggacggccggcggccggcttgccaccgttcttcacggcttccatgttggcggccttgaagcgtgccttgtccacgagttcgcccggcagcaggtcggtgtcgccggagtcgatcacagtgatgcgacgcagcatctggtgcacgatgacctcgatgtgcttgtcgtggatatccacgccctgggagcggtacacggtgtgcacttcctccacgatgttcacctgtgcggcgcgcgggccgaggatgcgcaggatcttcttcgggtcgacggagccttcgatgagctgggtgccggcttcgacatggtcgccgtccttgaccagcatcggcgcacgacgggtcaccgggtagacgatcggctcgacggagtcgtcgtccggcttcagggtgacctgacggccgcgctcggtgtcttccaccttgaccacgccggcgaactccgcgatcggagcctcgcccttcggggtacgggcttcgaaaagctcggtgacacgcggaagaccctgggtgatatcggaagcggaagcgacgccgccggagtggaaggaacgcagcgtcagctgggtaccaggctcaccgatggactgtgctgccacgatgccgacggcctcgccgacgtccaccagcttgttggtggccagggaccagccgtagcacttggcgcacacgccacgcttggattcgcaggtcagcacggaacgggccttgacctcttccacaccgtgggcaacgagatcgttgagcacgtccatggacagggcgtcgccggccttatacagcacggtctcgccgtcggccgggtcgatgacgtcggccgcgagcagacgggagtacgggccaccgtcggcggccttgaccaggtgcaggttgccttcggcatcgcgttcgccgaccttcatggtcaggccgcgcttggtgccgcagtcctcctcgcgcacgatcacgtcctgggagacgtccaccagacgacgggtcaggtagccagactctgcggtacgcagtgcggtatcggccagacccttacgcgcgccgtgctgggagatgaagtattccagcacggacaggcccttacggtagttggacttgaccggtcgaggaatgatctcgcccttcgggtttgccaccaagcctcgcatacctgcgatctggttgatctgcatcatgtttcctcgtgcaccggactgcacgatgatggccaggttgttcttggaatcgaagtgttcctcaaccgcctcggagacctcgctggtgcacttggtccacaggtcgaccagttcctgacgacgctcctcttcggtgagcataccgatttcgtagttctcgttaaccttgtcggcttcgccttcgtacttttcgatgtactcgtccagttccggcggctggataacgtcggagaacgcgaaggacacgccggaccacggtgcgcgggtgaagcccagatccttcagggcgtccagtgtcgcggccacctgagcggtggagtaacgggtcgcgatgtcgtcgacgatcttgctcagacgcttcttcggcgcctgctcgttgacgaacgggtagtcgaccggcaaggtgccgttgaacaggatacggccgtaggaggtggcgaacaggacggagccgtcatggaaacgctcctccttgaccacgtccgggctgcccggttccggatcgacgaccttgacctcgcccggctcccagtccttcggcagcacgaagtcctgcggaaggcggatgagcaccttggcctgcatgtcgatctcgtgcttgtcgagcgccatttcggcctcttccagcgaggagaacacgcggccctggcccttggcgccgtcgatgacggtggtcaggtagtacagaccgaggatcatgtcctggctcggcatggtcacggtgtggccgtctgccggcttcaggatgttgtcggaagccatcatcagggaacgggcctcagcctgggcttcggcggacagcggcaggtggactgccatctgatcgccatcgaagtcggcgttgaatgcggcgcaggcaagcggcggcaggtggatggccttgccttccaccaggatcggctcgaatgcctggatgcccagacggtgcagcgtaggtgcacggttcaggagcaccggatgctcggagatgacctcttcgagcacgccccatacttcggagtcggcgcggtccacgaggcgcttggcgctcttcatgttctgcgcgaagccctggtccacgaggcgcttgatgacgaacggcttgaacagctcgagggccatcggcttcggcagaccgcactggtgcatgcgcagggacgggccgaccacgatcacggaacggccagagtaatccacacgcttaccgagcaggttctgacggaaacggccctgcttgcccttgagcatgtcgctcagggacttgagcggacggttcgaagcgccggtgaccggacggccacgacggccgttgtcgaacagggagtcgacggcttcctggagcatgcgcttctcgttgttgagcatgatctccggggcgccgagctcgatgagacgcttcagacggttgttacggttgatcacacgacggtagaggtcgttgaggtcggaggtggcgaagcggccaccgtcgagctgcaccatcgggcgcaggtccggcgggatgaccgggatcacgtcgagcaccatggcctccggcttgttgccggtggtcaggaacgcgttgacgaccttcagacgcttcagagcgcgggccttgcgctggccggtgcccgtgtcgatctcttcgcgcagctgcttggaggctgcctcgaggtcgaagtcctgcagacgcttcttgatggcttcggcgcccatgcagccttcgaagtaatcgccgtagcggtcttccatctcacgccacaggtcgacgtcgccttccatgtctcccggcttcagggtcttgaagcggtcgaacacggcgctcagacgctggatctgctcgtcgtagcgggtacggatggcggccatttcacgctcggcgctgttgcgtagcttggcgcgtgcggagcccttggcttcgccttcggcttcgagctcggccaaatcggcttcgaccttcttggcgcgctcctcgatttcggcgttgcggcgcttctcgaggttggcgatctcgttgtcgaactcctgctgcaggtccggcaggtcctgatgacgctgctcttcgtccaccttggtgaccatgtaggccgcgaaatagatgaccttctcgagatccttcggagcgatgtccagcaggtagcccaaacgggacggcacacccttgaagaaccagatgtgggtcaccggagcggcaagctcgatatggcccatgcgctcacgacgcacacggctcttggtgacttccacgccacaacgctcgcagacgatgcccttaaaacgcacgcgcttgtacttaccgcaggcgcattcccagtcgcgggtaggtccgaagatctgctcgccgaacaggccgtctttctccggcttcagggtacggtagttgatggtctccggcttcttgacctcgccgtagctccagttgcggatgtcgtcggcggtggccagtccgatcctcagtttgtcaaattcgttgacgtccagcactctattgtcctgtctatcgattcttaatgcttatcacgttgttcggggaccgaccgcggcgcacgctgtgtcatgcagcgcggccggtcctttcgatcactggaattcgggttcctcggcaacctgatcttccttggcggcagcgtcaggacgcgcaccaatgttgaagcccagatcatcggaggatgtggacggatcgtcgtcctcttccttcatgtcgatagccacgccgtcggcgttgagcacttcgacattcagggacagggactgcatttccttaagcagcaccttgaaggactccgggatgcctgccggcggcaggttctcgcccttcacgatggcgccgtagacgcgcacgcggccgtcgacgtcatcggacttggtggtcatcatttcgtgcagcgtgtaggcggcaccgtaggcctcgagggcccacacttccatctcgccgaagcgctggccaccgaactgagccttgccgcccagcggctgctgggtgatcatggagtacgggccggtggagcgggcgtggatcttgtcgtcgaccaggtggtgcagcttcagcatgtacatgtagcccacggagatcggcttcgggaacggttcgccggtacggccgtcgaacagggtcgccttgccgtcggggccgacgagcttgttgccgtcgcggtccggaagggtgcagctgagcaggcccttgatggtttccggacggacgccgtcgaacaccggggtggccaccggagtgcccggagcgcccttttcggcgccctgcggcacgtacttcttccaagcggcctcggcatccggatccagggagatgtcccagccagcgtgcgcgatccagccgaggtgcagttccagcacctggccaaggttcattcgagaaggcacgcccagcgggttcagcatgatgtccaccggagtaccgtcggcgaggaacggcatgtcctcttccggcaggatgcgggagatgacgcccttgttgccgtgacggccggagagcttgtcgccctgggtgatcttacggtgctgtgcgatgtagacgcgaatcatctggttcacgccgttcggcagttcgtcgccgtcttcctcggcgtcctcgcgggtgatttccttgaccgcgatgacggtgccggtctcgccgtgaggcacgcgcagcgaggtgtcacgcacttcgcggctcttctcaccgaagatggcgcgcagcaggcgctcttccggagtcagctcggtctcgcccttcggggtgaccttgccgaccaggatgtcgccggcttcgacttcggcgccgatgcggatgatgccacgctcgtcgaggttggccaccgcgtcctcgccgacgttcggcaggtcgcgggtgatctcttcggcgcccagcttggtttcacgggcatcgatctcgtactcctcgatgtggatggagctcagggtgtcgtcctgcacaaggcgctgggagatgatcacagcatcctcgtagttgtagccgttccacggcatgaaggcgatgagcaggttcttgcccagtgccatctcgcccttctgggttgccggaccatcggccagcacggtgccggcttccacgcgttcaccgtcgtggatgagcgggacctggttgtagcaggtggtctggttggaacgctggaatttggccagcttgtaggagctggtggtgccatcgtcgttcatggtacggatgatgtcggcggacacgtaggtcaccacgcccggcttctcggccaggatgacgtcgccggaatcgacggcggcgcgccattcggcgccggtgcccacgagcggacgctcggattcgatcagcggcacggcctgacgctgcatgttggtgcccatcagcgctcggtggccctcatcgtgctccaggaacggaatcagggaggcgccgacggaaaccatctgacgcggggagacgtccatgtaatcgacggagctgaccggcacatcgaccgcttcctcttcgccgactcgggcaagagcctgcttcttgacgaagttgccgttctcgtcgagctcctggttggcctgggcgatgacgtgctcggcatcgcggtcagcggtcatgtactcgacttcatcggtgacgtggccgttgacgaccttgcggtacggggtctcgatgaaaccgaacgggttgatgcgaccgaaggttgccagggagccgatcagaccgatgttcgggccttcaggagactcgatcgggcacatacggccgaaatgggacgggtgcacgtctcgcacttccatggaggcgcggtcgcgggacaggccaccggggcccagagcggacagacgacgcttgttggtcacgccagccagcgggttgttctgatccatgaactgggacagctgggaggttccgaagaactccttgatggtggcgttcaccggacggatgttgatcagggactgcggggtgatggcctcgggatcctgggtggtcatacgttcgcggaccacacgctccatacggctcagaccggtgcgcagctggttctggatcagctcgccgacctggcggatacgacggttgccgaagtggtcgatatcgtcgacgtccacgcgcaggtcaacgtcctggccgtcgcgcttgcccgggaacttggtctcgcccgcatgcagggtgaccaagtacttgatggtggcgatgatgtcctcgcgggacaggctgcggtcgttgacgtccttttccagaccaagcttgcggttgatcttgtaacggccgacgcgggccagatcgtaacgcttggtgttgaagtagaaggagtccagcaggttcttgccggcttccggagtcggggtgtcggccggacggatcttgcggtacaggtcggtcagggcctcgtcctgggtctgcacggtctccttggcgagagcgtccatgaccagcgggtagtccttgaaggcgtcggcaatttcatccttggtcatgccgatggccatgaggaacacgatggcggactgcttgcgcttacggtccacgcgcacgccgaggacgtcgcgcttgtcgatctcgaactcgagccatgcgccacggctcgggatgatcttcgcgccgaagacttccttatcggaggtacggtcctgggaacggtcgaagtacacgcccggggaacgcacgagctgggacacgatcactcgctcggtaccaccgatgatgaaggtgccgtgcggggtctgcagcgggaaatcgcccatgaacacggtctgggacttgatttcgccggtgtcgccgttctcgaattcggcgttcacgtacagcggcgcggagtaggtgtaatccttctccttgcattcctgcacggtgtggcgcggttcttcgaagtacggatcggagaaggtcaggctcatggtctgagcgaagttctcgatcggggagatctcctggaagacctcgtcaagaccggaggtgtggggcacggtgttggtgccgttctccagatcctcctggactcgcttctgccagcgctcgttgccgatgagccagtcaaagctgtcagtctgtacacccaacaggtagggtacatcaatgggctcgcggatggagccgaaattcacacggtccgacgccttgtgcagatcaatatcatgctggtcggcgcgtgcgatgatggtggtggtgttcgtcgtagcctcagccaatggacgttccttatcgctcgctaatcgtatcgatatgtttccccggaagcgctctcattggccaccatatgcctagtacgcgggcgcttcttccttgtcagcgtgcccgctatatgacacgcatctacgcaaagtcataagaatagcataacctgtagattttattccactgtgatgccgaccggctccgacttggttttcgcatgtcctttgaccgacagttgggccgaatacacgccacggtccacgttcggcaggtccgccgcgtcggcgcattcgctgccggaacgcacgcccggccaagtgatcgtctgcttgacctcgtcgcccttggctatcagccggtaatccgtgtccacggggcatacgttcgatttccagaccacgtccttgcccgacttgatcgtcagcaccatgcccgcctgggacacgtcgatcagacagccagccttgccggaaccgttgtatttcacggaagcggtgaagtccatcgtgccgcccacaccgaagctcgatgcggccggagtaagcgacagcgcgacgttggatgcgtcgcaatcggggacgctgcttttctgctgttgggtcggcgacggcacctccttgcgggagatcgcgtaaacatcggcatggtggatttcgcggttgacagcgacgacgccctgcgtcagcgaatacaggcagaatacgatgaagctcagcaccagcaccgtcgcgataccgaaaacgatgcggcggcggcgatacatcgcctgctgttgtttcgtacgtttcttaccggtccgcggggaggtcttgtaagccatggctcccagtctagcgtgtcatcctccgtgcggcaccgcggccgcacgcaccacgcatgccgtgtacgttacaccggcagccgcacccctcccccgggcaggatttcgatcagaccgtcctcgtcaagcgacgcgatgcatttgtccagctgcacgtggtctttccacagccgttcgacgctcttgcgatcaagcaccgtctcgccatccggcaggccgcgcagcgcgttcagcaccagcccgcgcacctgccggtccgtaccttggaatcgttggcgtggtcgcgtacgccgctgccccaatcccggtcttccgttgcgtaggaacgcgcattttccggcgatcggacaggcttcgcataatggcgatttcgcagtgcacaccgtcgcgccgagttccatgacggcctggttccacacgacggacgggcgatcgaaacgacggcatttcgcggaatcatcgtccggcagcagccgtttcgccagcgcgcgttccgcgggacttgcgctgccgccgagcgattcgacgccgacgaacgcacgtgacagcacacggcggatgttcgtgtcgaccaccgcgatacgttcgccgaaagcgaacgacagcaccgcgcttgccgtgtaatcaccgatgccgggcagagcaagcaattcgtcgtacgtatgcggcagctcgtcggcgtaatcgtatgcgatgacgtgcgcgcattcctgcaatcgcagggcgcgccgcggatagccaagccgcccccatgcggtgatcacgtcggatttcggggcgtcggcgagcgcggctgcgtccggccatcggtccatccatgcggtccaatacggcacgacgcggcccatctgcgtctgctggctcatcacttcggaaacgagcacgccccacggtgtggtgcggccgaatcgccatggcaggtcgcgcgcgttggtctgccaccattgcgcgagcgtcgttgcgatttcgtcagcatcggaagcatcggaggtgacggcggtggcggaatcggcaaagtcgtcaaagtcggcgtcacgtacggcggtgtcgtatgtggtgttcgtgtcgttcatcgttcctattcttagcatttatgacgaacgaagaacataccgataacgcgcagggcgcaacgcgcgacgccgagacgcaggcggccgaagccaaggtcgagaagatgttcgaatacgggtaccgcaagtccaattacggcccggacgaactggtgaccgacgcgcacggcaatccgatttccgtggtggacgcgatgctgagcgcgaaggacgcggcgaaggcggagacctccaccccgcacctgtgctactactccccgcgtattccaggcaacacgggttccgcgatccgcctgtgcgccgtgacgggaacgattctgcacctggtggaacctttgggtttcaatctgcgggataccaagctgcgccgtgcggggctcgactaccatgacatggcgcatgtggtgctgcacccgaatttcgaggatctggtggaatcgatgccggattcgcgcatcatcgccttcaccgcgcacgccaccaagctgtacaccgacatcgaatacaggccgaccgacatcctgctgttcggtccggaaccgggcaatatccccgatccgatggacatcatggccggcccgcatgtggccgagcaggtgcgtctgccgatgcgtccttcgctgcgtagcctgaatctcaccaactgcgcctccatcgccatctacgaagcctggcgacagttgaactttgccggcggtaagtaaaaacagttttacaaacgcaaaagagcccggccctccgtgcaggaaggtcgggttctttcgtaagaacgtcagttcttgaaggagtggatcggcgccggaatgcggccgccacgggtcacgaaggcctcgcagctggtctggttcaccggaatgatcggcgcgtagcccatgaggccgccgaagttggccatctcccctacgcccttgccttccaccgggatcacacgcacggcggtggtcttctggttgaccatgccgatggccgcctcgtcggcgatgatgccggaaatggtggccgcggtggtgtcgccggggatggcgatcatgtcaaggccgacggagcatacgcaggtcatagcctcgagcttttcgatcttcaggcagccgttgttggccgcgtcgatcatgttcttgtcttcggagaccggaatgaacgcgccggacaggccgcccacataggaggacgccatgatgccgcccttcttcacctggtcgttgagcatggcgagcgcggcggtggtgcccggtgcgccaacctgttcgaggccgatcttttcaagcacttcgccgacggaatcgcctacggccggggttggcgcaagggaaaggtcgatgatgccgaatggaatgccgagtcggcgggaggcctcctgggccaccagctggccgacgcgcgtgatcttgaacgcggtgcgcttgatggtttcgcacaggaactcgaagtccttgcccttggcctcgtcgagcgcgcgggagaccacgcccggtccggagacgccgacgttgatgaccgcgtcgccttcggtcacgccgtggaagccgcctgccatgaacgggttgtcgtccggggcgttgcagaacgccacgaacttcacgcaaccgtaggaatcattgtctgcggtggcgtgcgcgatgtccttgacgatgtggccgagcagttcgacggagttcatgtcgatgccggttttggtggagcccacgttcacggaggagcacacgatgtccgtttcggaaagcgcctgcggcagggagcggataagcatctcctcggccggggtcatggacttggacacgagcgcggagtagccgccaatcaggtcgacgccgaccttcttggccgcgcggtcgagcgcgtgcgcgatcttgacgaagtcctcggagctcttgcaggagcttgcgccgaccagggaaatcggggtgacggtgatgcgcttgttgacgatcgggatgccgaaatcgcgttcgatggcccggccggtggacacgaggtccttggcgtacgtggtgatcttgttgtagatgttctcgcagacctcgtcgacgctgtcggctgcgcaatccagcaggctgatgcccatggtgatggtgcgcacgtcgagcttctcctgctcgatcatcttgttggtctcgtggacctccatgatattcagcatggtttttccttacgattggtacgattcgtagcttcggttgcttgcatggcttacgtgtgccgcggatcagacgcggtgcatcttggtgaagatctcctcgcgctggcagcggatgcgcacgccgatctcctcgccgagcttgtcgaggtcgtcgacgactgtgccgaattcctcgtccgcgttggaataatccacaatcatcatcatgttgaagaaaccgtcgatgatggtctgggagatgtcgagcacgttgacctggtgcgcggaaagataggtgcagacgcgggcgatgatgccgacagtatcctgaccgacgacggtgatgattgccttgttcatggaactccctaaacgtgaggtgtgaatatccagttgccgtctcggcaaattgccggacgtgccctcaagtataggaaaggcacgtgccaaaacacccctctctcccgcttttcgcattacatggtgagacgccacacgcgcatgtcagtagtcaaacgtttacctaggtcgtcaccgcccacggattcacccgcgccgtgtcgcaacacagcatgacatgcaacatccgccggcaaattacaacgcagcgcacatatcgtgcccatatctcgcgcatatcgcgtacatacccctacacatacggcagcggccccgcacccgccgtgtcacaaggaacacgcaggaacggggccgccggatacggctctacgtcttagcgccaaataccgttcaatgcacgcgcatcaaccgcatcgatcttgccggacgacgcgatgcgaagctcaccgtcgccatcagcgccttggaacagcatgcttcctgccgtctgaccgccattgaggaacacttcgacaacattgcggtcgaagaacacctccacctggcgaacatcggtgatgccgctgtcgaagtcgacatcctccaccgcagtgcccttggccaccaggcgggtcacgccatcagtgcgctgcagcagcagttcggtcggcctgccgtcctgcgggttgacgcccttcgccagcaccatgatggcatcggcatcatccgccagatgcacgttcgcatagtatgcgttgccgggagccgtaacgaccatatccccgccatcgccgtgcacggcaagacgctcgccgagcagctcgcggtacacttcgctcaccggcttgctgtacagcctgccgtcacgcacatgcaattcgcgcggcagcgacatcatgccgttggccaggcacggctgttcgacacgcatctccggaaaatcggtgaaccagccgaatacgatgcgacggccgttatcgtcggcgaagctttgcgtggcgtaatatccggtgccgaaatcgcaccagtcgctggccttgacatccagtttcggaccattatcggtgttcaccaagtcgccggcataccaacgcacctgctggaaacgcccctgcttgtcgcggtagtgcatcagcgcgccgacggcaacggtcacgccgtcgacctggaacaggtcagggcattcgtaggtgcgtgcgatctgatggccgaaatcggcgagcaccggcccttcgtagcgccatgtcacgttacgcttgagcggcttcttcgcggagaacaacgtcatggcgggaacggtggcgttgttcggctggtcgacccccggcttgccctgaggagaataagtgaaccagccaccggtattctgggtgctgatgccgggaaccgcactatcggcggcgtctgcgccaaattccgataccggcagattggtggcggttaccatataggcacgatccgggtcgagcgcctcgccgcccatgccgcattcaaccttcggatcacggaagtcatagccaaaatcgtcattcgcacgcagcgccaccggcgattccacgcgaacatgcacgccgtcctcgcacaggcaggtggtctggtattcggtgacggaggattcgtcgccgcgggtttccagatgacgggtcaggtacaggcggatggcgtttgcctcgttgccggcgaccggattgtcatgctcgtccacggtcacggccgaaccggagaacgcgccgccgacgatacgctcgtcggtgtgcagttcgggctgcggttccaggaagactggcagatgagtccaatgcaccagatcacggcttaccgcgtgcccccaatgcatattgtcccagccgaaaccatacgggttgagctggaagaacaggtggtagcgcccttggaactggcacaggccgttcggatcgttcatccaacgtgcgaacggttcgaaatgcgcgcccgaacgcccgaaacggttgtagatctgttccagcgtgggctgtgcaggccaatcggtgtcgcttggattcatgttcacgtagcgaacgccgttgtcaagcaggtcatcgcattcggaaaggtagccgaagcgtacaaccaggccgcttgccgccacggtgacggtggatttctgcggcaccgcaatggagaaatgatgcctgcgttcggcgatgggcatggtgtgcgccgcgattgcgacgccgttgccgtccgcaacggtgacgacggcgttcccctcgccacagcgttcggcgaacagatcgagctgccggtagccgccggtttcgacggagatggaataggtattcgacatagtagacccctctacacgtgtgaaatgaatatggaaaatggatggaaatactcaaagacgcagtgccgtcaggaaacgatcgaatcgcgttcgatgatgcggcatcgcaacggtgtcatcgggccgttctccaaacgcctgatcgaatcctcactgcgtgcaaggctttccgtggcggcttcatcgtcgatcatggcgaccagctgatgcaccgcttcgaagcccatttcgtagtgaggaagctccaaggtggtcaacgcgggcttgagcacgtccgtaatgagcggctggttgtcgatgctgatcacggaaacgtctgtgccgatgccgaccgaccgctctctggccgcctcgtagatgaaggtcgcgcgcacatcgttgaagcagaagatgccgtccggcttgatctcgtcgaacacgcgaccggcttccgaagcggcgtttgtggcctcttccacgttgacgaccaactgctcgtcgaaggggatgcccgcgtccgcgagcgctcggcgatacccggcgaaccgctccccctgggcgataatggtgattgaggaaccgtagtaaacgatgcgtttgcagccggcctgaatcagccgattggtggcatcgtaccctgccatttcgtcgtcggggtagatcgagggaatcttgcgattctcgtcttcgctgtcgacgacgaccgtggggctgccttcgagttcggcggggatctccacaacacggtggtacatcatggcatacaggaaaccgtccacgcggtactgccgcagggccgcgatctcctggttctccagttcccgatcgtttcccgtgttgacggtgagcagaatatagccgagtttgcgcgctgcctcctgcgctcccaccagtacgcgcccggcatgtggcgaggtggcgatctcatcggtgataaagccgaggacatacgacctgctggtgcgcaatgtacgcgccacggagttcggcttgtatcccattgattgggccgttccgcgcactcgttgcgccaccgccttgctgacgcgattgcggtccttgttgttcatgaccaatgacacggtgcaactggagacgccggcctcttttgcgatgtctttgatcgataccaatggttttgccttgtctgcttggcggctttgtgaagcggattccattgtatgcccgcctttctttggcgacactctgccgttcagcttttcgcgtatcggatgcccggctgctcccggtcatggatgtccattcccggaatccggccgaacgagtacacgatccacgcagtgcagaacatcggcagcgacatgccgaacaccatgagcagacccggccattgcgcccaggcaaggatcgccagcagtgcgagtccgatctgcagcagggtgcacagcggacgggccacgatcatggtcagtgttgtgcggacgatccacagcggacgttcgtcatagttcgcgcgcaccacccagaccagcatggtgaaggccagcaataccagtgccagcacgaacagtacgccggaaaccgccacgtcgaacgttccgcgtgcatgccagttcatcatgtagtagtcgatggcgagcaccacccagcatacggccaacggccagccgaagagattcgcctgcttgagctcgtttttccatgcgccgtggaagatgccccatacttccttggcacgcatcgaccgatcctcagcacgcagccacgtgcggaacgtggtttgcgcggcggcgcaggatgggaagaatcccagcaccacggcacccagcagtgtgtgcacgagcatggcgatgttcaccacgaagatcgtgagcagcagacggcagaaccgttcataggccacggaaaaacgagcgagcatggcgaatccctttcaatcagcccttgacggcgccgagcatgacgcccttgttgaagtacttctgcaggaacgggtacagcaccagcagaggcagggtggagacgatgatgatgccgaacttgatctggtcggccgcctgctgttgggccgcggcgttgacgttcgtaccggtgccttgtgccaccagcagcaactgctgcaagaccacctgcaacggctgctttgtgtcgtcggtgatgtagatcaagcctgtcatgaagtcgttccagtggccgacgaagtagtacaggccgatgacggcgaggatggcggagcttaacggcagcacgatcttgaagaagtagccgaagtagctcaggccgtcgatctgcgcagcatcatgcagttcctccggaatggaggtttcgaagaaggagcgcgccacgatcacgttgtatacggagacagcgccgggcaggatgaacacccacatggtgttgttgatgccgagggctttgtacagcaaatagttcggaatcaggccgccgctgatgaacatggtgacggtgaacaggaacatgatgacgcggcgcggcttgaattcgcggcgggacagcgcgaaggcgcaggggatggtcacggccatgttgaccgcggtgccgaccaccgagtagatgatcgtgttgagatagccctgccagatgcgatggttggtgaacaccttcgcatagccggcgaaggtcacgcccttaggcagcagtgacacttcgccgccggccacagcgttcggattggagaacgatgcgatgaccacgaaccacagggggtagagcactgcgaccacggtgaacaccagaagcagcacgatgacaaagtcgacggccagatcacctggcgttttcttctgacgtacatgcttgttccagggaatatcgttcttgctttgggcaacggccccggttgttgttgcagacatgatgactgcctcctagaaaatgctcgtatcggaaacgcgcttggcgatcgcgttcgcggtgatcaggaagacgaagttgaccaaggtattgaacaggccgatggcggtcgaatacgaatactggccgttaataataccgatcttgtaggtgtaggtcgcgatgacctcggtggccggcatattcagcgaattctgcatcaggtagatcttgtcgaaacccacgttgagcacggaacccatgttcatgatgagcaagattgcgcaggtcggcatgatcgccggcaggtcgacgtaacggatcagttgcagacggccggcgccatcgatcttcgcggcctcgtacagcgaggtgtccacgccggcgagcgcggccaggtagatgatggagttccagccgacgtgctgccagacttcggagatccagtagacggcggtgatggcgctggtggagcccatcagcgattcgtcgccgaagaagcggcccaggatgccggagcccggggacaggaagatgttgagcatcgagacgatgaccaccacggagatgaagtggggcatgtaggtgacggtctgtacgaagcccttgattttcttggagccgatctggttgatcagcagggccaggatgattgggaagatgaagcccatgaccagcgtccacagggagatgcggacggtgttggtcatgatctcgccgaagagcgggttatggaagaactcgttgaaatatttgaatcctacgaacttgccgccggtcagacccttggtcgggtcgaattcacggaaggcaagctggatgccccacatcggcacgtaggcgaacaggccgacgaagaacagggcgggagcggtgaggatccacagctgccagtagcggcggaagtggtcggcgatgcgatcgagcagacctggtttcttgcggtcgggagccgcttccatcgccacggtccgtgcagcaacgccttgcgatgtttgtgcactcatgttggtctccaatttaggatgattgctagggaacaaaaatgcggggtccggcggcagtcacgggagagaaacgaacccgtgcgatggaccccgcggtattacttggctacttggtgtacttgtcgtaccacttctgccaaatcttgatgttggcgtcgaggccgagggtcggttcggacaccttcttcacgtaggcatcccattccttgtcgatgccgcccttctggacccacttcgcgatctggttgttcgcgtagttggagatggcggtgttgttgttttgcagggtgttggagtcctcggtattcgggcgcacgtaaatcggtacgacatccttgacgccgtcgacgcggttgcgcgcctcacgaatggccaaatcggacgcagtgacctggtcggcgttggtgtcgttgaccatcttcacgtcgtcgcgaatccagccaccgaagcggtcctgcagggcgacggcgcgggtatcaggatattcggcgtaggctttagccttgtcgatggtgtactggtggtcgccgtcatcggagacgatatccggaatagagccgaagaatccagccacggaaagcttctcgccgtacatggcgtcgatcaccttgtagatggcgtcctggttggctgcgttcgggttgacggtcaggccggaaccggagtaggcccagcggcaggcgtcctgggaataatcccacttgacctgggagtcgggcgtggaggcgtctttcttcagcggcggcagggtgacgtactggtcgccaagcgcgttgccgtattcggagtagttggaccaaccgaaggagacgccggtcagcgcggtcttgccgtcactgacggtctgcgaagtgtattgcgaggcgtcgcgggtgagcacatccttcgggataaggcccttggccatgagtccgtgcaggtaggagacgacgtccttgagcgcgtcggaggtgtaatagctcttaaccttgccgttgtccacataatagccctgttcggaagcgccgccgcccatgaaggaggtgaccacgccttcggagttcatcagcgccagagggctccacaggccgaagccgaggctgcggatattcatcggcacctcatcggccttgccgttgccgttcggatcctgggtcttgaatgcatcgagcacgttctcgagctcgtcccaagtggtcggcatctggagtcccagcttgtccagccaggtcttgttgataaacatgtgagtgccggaaacctcgtaacccttgccgcggtcggagggcagcatggcgatcttggtgccatcggtaacgtacttcgcagcgcccggctgggccttgaggaacttcttgacgttcggcatcttatccagatgcggcttgagatcctcgaagtaggtgctgtacttggccgcatccaccatgctgaacaagctcaagccaatgtccgggaattcaccggcggccatcttggcgctcttctgctgaccccaagcgttgtcggcgacttcctgccacttgatggtgcagtcgcaggcggcttccagatccttggtgtactgggtgtcctgcatcggatggtcggtcacgttgcgacgaaccagaatattgacgattggcttgccgttctcgtctgtggtggcctgcttgttgccgcaggcggcaaacgtcgtgaccatagtcgcgactgcagctattgatgccaacaggcgaacacttcttcgtgccatgattaggctccttcttccttgatgtttcctcctcgtaccgatgtaagacgcaccggtacgacctcatcagccgcttgctttgcggtgattaacactataaatcgttaatcgtttaatgtcaaacgttaatcgtttatctcaatagttagcgctctcatcaaccagtccccccagcgtcgcaaacgtaaacttcggctccatactgccgttcttgcagaacaccggaatcacccacatcgcgacacgccgttaatcgtataacgtatcgtttttcatcaaatacacgtacaacccgtccgttgtacgcacaaaagcgtagccgaacatgacggccaccaagtcgacacgtcgctacttacgaaaggtgctcccctccttcagaaaagaaggaggggagcacgaatacgatcacagacagcatcaggccaaacacgtagccgcaccgggagccgggatgaagcattcggcatcgtacctgctggtcatcgctgtgggatacgctggtgcgccatctggtccacaagtaaatcgtgcaaaacgcgcgttggcgcacgtcctttttcatgggcgtgcgccaacgcgcatttttgcatcggcttctgcgatcaggcctcgcggctcgcggaagccgcagcgaacgccggcaaggcgcgaggcgcgttgaagccttccttttcgaagcggtcagcaatcttctgtgcgatctcgtgaccctgacccttgtccaccaacgcgatgatggagccgccaaagccgccgccggtcatacgtgcgccgtacgcgccgttgacacgagccacatccacggcaatatccagctcgggcacagtcacttcataatccgcagcgagcgaatcatgagacgcgttgaacagtcggcctgcctcgtcgatcttgccgttggcgaaggcacgcacgaaggagttgacacgggcgatttcggtgatgacgtggcgcacgcgcttcttcatcgtgtcgtcttccagcttgtcgagcgtttccttgagcgcctggaacggatcgtcggacttggcgatgctgtcggcgaccacacgcaggttggccacgccgaggatttcggcagccttctcgcaagtggcacgacgctgggcatactggccgtcgttgagctgatgcggagcctgagtgtcaagcaccagcagttccagaccgtacttgtcgagatcgaattcctgctgggagacgttctccagcgggctcagctctggacggcagtcaagacgcaacgcatggccgaaagtgcaacgcatggatgcgttctggtcgagaccaccggtggacgcgcccgccatgtcgttttccgacttgatggcggcgttgatcagcgtcacacgaccggcatcggatgcgccataacccaaaccgtacacatcatccagcgccaaggcggtggagcaggtcatggctgcggaggagctcagaccggatccgagcggcacgcaggaggagaatgccgcgtcgaagccctgcaccgcatcgaagccggcttcgcgcaatgcccaggcaacgcctaccgggtaggcggcccagccttccacaccaccggcctgcagaccatcgaggtcggcttcggtaacgtttccggaatcaacgtcggaaaccacgcgcaccttggtgtcttcacgcggcttgagcgcgatgaacgtgcggtgcggcagtgcgatcggcaggcacaggcccgcgttgtagtcggtgtgttcgccaatcaggttcacacggcccggtgcggcccatacgccagccggttcctcaccgtaggtggctcggaacaggtcggtcgcgttcttcacaccctcgtcatgcgagagcggctcaatgaattcaacagcagtcattggtgttttgtcctttgggttttattggctttcagccttcgatatcgattggtccgagctcgtggaagcgcttggcgatgagttccggcgtggtgtcggacacccatgcggccatgcctgattcggagccggccagatacttgattttgttggcggcgcggcggaacgagaagaactgcaggttgaggcggtagttttcgcggcgcttgtcgtggatcggggcctgatgccatgctgcgatgtacggcaggtccatgcccttgccgtcacccttgtcgaagaacgcgttgccgcgcttgagcagggtggagtacatgacggccagatcccaacgctcctgatcgttgagctcgtcgagggtgagcacgtcacgcaccggggccacatgcacctcgagcggccagcgtgccgcggccggcacataggcgacccaactgtggttgcgcatgacgatgcgctccccggcctcgatttcggagttcatgagatccttgagcaggttgccgccggtcttctcatggtaggcttcggtctgcttgagttcggcttccatcttcggtgcgatgaacggatagcagtagacctggccgtgagggtgcgccagggagacgccgatttcctgaccgtggttctcgaacgggaagatctgctcgatgccctccatcttggagatttcggcggtacggaacgcccatgcctccacgacggtgcgcaggcgggagaccggcaggtccgccggcaggccgttttcgtccgggtcgaagcagatcacttcgcagcggcctgcggcgagcttcttctcccacagcgggttgccgttgacgtattccacggcttcggaacggcccggcacgcgaaccatcgacgggaagcggttttcgaacacgaccacgttgtagtcggtatccggcacttcgccatcctggtacggatcgcccggcttgcgcgcggccagcggattgcctttggccgtcgcgcccggaccggcggtgatcggacggttcatacgtgcggtcgccatcggaatccaatcgccggtcagtgggtcgcgacgcatttcgggagccgcatacggcacttcctcgccagcggcgttgagctggttggagaaacggtacggaagttggcgcggatccttcagttcgcgagtcttgacgccggagacgtattccggatcgtcatcgagatagaagaagtcgcggccatcggcaagcgtggtcggcgtgatacggatatgctccttcgcatattctcccggagtgtagttgacgaaatcactcatgtgattattcaccttcctgaaccggctcggcctggcgtgccagaacgagctctttgaccaaatcccttgttttcgacaccgaatcggggtccaatccgtcatcggtgatgaccgtatccacctggtcaaaacgtgcgaacagcgacagtgacgtgcagctccacttggtgtggtcggtcaaaattatcgtgcgatcggcaatgtccatcatcgccatatcggttgcggcttccagcgagttcggcatgaggaaaccgcgcggaatggacacggaatgcgtgcccaggaatacggtgttgacgcgcagcgaggcgaccactttgtctgcgatcggcccgacgagcgagttggaacgggtggtcacgccgcccgtcacgatgacttccacgtctttcgattcgagcgcctgcaccagctccgccaccggaatggagttggtgaggatggtgatgccggacgattgctgcgattcgagcagatgctgcgcgaacacgtacgccgtggtgccgccgccgatggcgatcacgtcgccgggggccacgtatttgacggcttcctgtgcgatggcgtccttcagaccgatgtccatctgcgactttacggaaaacagcggttcgctcagcagcgtgctggtgctgacggcaccgccgtgcacgcgcttcagcagacccttgtccgccagatcggcgatgtcacggcggatggtcatcgcggagacgcccaattccttggacagtgcagtgatgcgcaccgcaccacgggtacgcagacggctcaaaatcaaatgctggcgttgcgacgaaatcatatgaacattatcgcacatgttcactcaaaaatacaactgagttgagcgtttcgcgcgtgtttcgtgcaaagccgcaccacaatcgactcaaattcagcctaaaacgaacaaaaacgaacgtcctatatgccgcaccgacacacatcggcttttgcccaaaatgccatgcgaaaccaatgaaaacgtgcgagaataaggaaccatgacatacgtttccgaaaacttttggcacgacgcagtgaacaaagccaccaccgaccttttcacgttcggctacaagcacatcatcaaaccgcatttcatcttcaaccagacgcccgacgtggcccacagccagatgatcgatttctgcaaggtcacccgcaatattccaccgctgatgtggctatgccgcgaaatgctcgactacaccgacccgatactggaaaccaacgtgatgggcgtcgatttcgccaatccgttcggcttgtccgccggcctcgacaaggattgcgagatgccggtgctgctcgacaacgtcggcttcggtttcgaaacggtcggctccaccacgtcgcgcccctgccccggcaacccgcgcccatggttccaccgcctgcctgaatacgattcgatgatggtgcacgtgggccttgccaacgagggttccgcggtggtgattccgcgcgccgagaacgcatggacgaaggcgaagagcatgcaggtgtcggtttcgatcgcccgcacgaacgacagcaagaccggcgatctggacgaaggcatcgaggattactgcatttcgatgcgccgcgcggccggacgcaccgccatggtcgaagtgaacatctcctgcccgaacaccatggccggcgaaccgttcaaccaaagcccggaagcgctcgacaagctgttcaccgaactggacaaaatcgaccgtccgcagccgacgctcgtcaaaatgccgctcaataagacgtggccggaattcaaggatctgctggacgtgctcgccgagcacaacgtgcagggactgtcgatcgccaatctgcagaaggaccgcaccggcatgtccattccgcgcgattgggagggcggactgtccggctcgccgtgctacgcgaccagcaacgaacgcatcaagcaggtctaccgcgagtatggggaccggttcgcaatcgccggcatcggtggcgtcttcaccccgcagcaggcgtatgagaagattcgttgcggctcgtcgctggtgatgttcatcagcgcgcttatgtaccgtggtccgcagcagatcaccgtgttgaagcgtggactggccgaactgctcaggcgcgacgggttcgaacatgtcagcgaggcggtcggcatcgacgcgtgaaaactttttaattgcgatttaagttgcgatttaaaaagcggtttttaggcactataaaggcgattaataatcgcagataaatagataaatacagaggcgcgtctccgtgggagggcgggcgtcctgttcacgacacactcaaggccgttcggccaagcttacggtcgtgaacaggacgcccgccctcccactcgtttttttgttatgttgcgttgggttgtggctacttttcgcaataaaaaagaggaagaagggaggggaagggtcagcggaaggcgccgcggaggtatggcggctggtagggggcttcctcgaccggcacgtccagtttgtgggcggcacggagcggccaatacgggtcgcgcagtgcagcgcggccgatttccacggcgtcggcggcgcccgacttcagaatcttcttcgcctgcttcggcttggtgatgagcccgactgcggtggtgggaatgcccgcgcgactgcgcacctgttcggcgaacggcacttggtagtcgggcttcaccggaatggtcacgtcgggaatcaatccgcctgtggacacgtcaatcaggtccacgccgtgggccttcagaatcttagccagttcgacggtctggtcaaggtcccaaccgcctgcggcccagtcggtggcggaaacgcgcaccagcaccggcatggtatcgggcacgacggaacgaatagcatccacgacttcgaccagcatgcggacgcgattgtcgaacgatccgccgtactcgtcgtcacgctcgttgatgagcgggtcgaggaactgcgacagcaggtagccgtgcgcggcatggacttccaccgcgtcgaagccgatgttcatggcacgccaggcggcgtcgcggaactggtccacgatggtgtggatctcatcgacgctcagcgcgcgcggacgagccagggaaccgtatgcgttggcgcttgggcaaaccgtccgccatccgccttgctcttccggcacgctctgtccatcgaaaccgatcgcgtggcagccggtggaacccttgcgtccggcgtggttgagctgcaccgccatcgtggcacccgctgccttcgcgtcggccacgatccaacgccatgcgtccatctgtccgtcatcccacaatcccagatcgcacggcgaaatgcggccttccggcgcgacggcggtcgcttccatgatgatcatgccgaagccgcccatcgcacgcgaaacgtaatgctggtagtggaacggcgtcggcttgccgtcctgcgccaatgcggaatacgtgtccattggcggcagccagatgcggttgcgcacggtgacgccacgcaacgtcatcggatcgaacggtttgaccgtcttgttctgcttgccgttcttcttgtcttcgctcattgtcatctctcttatgaatcgttggtatcgcctgaatcgtcgatatccgcaccgcgttcccacgcgacgggcatggtaccgattgcattgtaagcagaacgcccgccggttggggcgggcgtttatggactgttcactttgccatgcgatttacgctccggtgacgtgggcagtcagtgcggtcagtcaatgcgggcagtcggcatgaatagccgacaatcgcaactattgatgctgctggtcactttgctgctcagcaggctgttgctgcgattgctgctgctggccttggttggtctgctgctggctttgctgctgactgttctgctggcgctggtattggtactggttgtatgttctggtggcgcccttcgaaaccgtgtacttgtcggcaccctttccgtaatcgttgtcgatcggcgcgttgatggcggcaagatacgtgttcatgaactgcttccacgccggcgttgcgatgtacatgccgtaccaggacgggcggtacacgccgttgatggtcttgttgtcgaaggtgttgttgatcgggtcctgcgcgtcggcgaccgcgacgaacgccgcgacctggttcggcacgaagcctgcggtggccatcaccgtgttctcgttggtgccggtcttggcgaaggtcttgcgattgttgtcaagctgcgtggtcgacgcttcgccgccaggctgcacgataccttggttcagcgcgtaagacacggtctgcgcgatgtccgggtcgatggcctgatggcagttcgcggacggcactttcaccttgctgccgctgcggtcggtcaccttggtgatggcgatcggagtgcattccacgccgttggcgcccatggtggcgtacacgttggccatggtcaacggcgacgcctgcaccgtaccgatggtcattggcggctggaacgagttagcggagtagatgtcggacgcgttggagatggcgttgtggtagcccatctccttggccgcgtcggcgatcgcgcacaggccgatgttcgacgccatcgaggcctgcgtggtgttgtgcgacttgatcagaccctgcagcgggctttccggagaggtggtgccgccgccggaattctgcaccctccacgggccgacgaaaccgtagccgttgcagttgaacttcgacgtgtcgtagacggtggatgtgacgagcgactcgttgatggagtggcctttctgcatccacgccaccatgttgatgggcttccaggtggagccgacgttgaagcccataccgccgccgtcctcctgatcgaccatgtagttcatggaggtcttggtctcatccgttcgggcgtcatccgtggcatcgtaggttcggttgataccgaacgacaggatttcaccggtgcccggcttcacggccgctatcatcacttcgaatccggacgggtctgtggccggcacggtgctgttcgccgcctgcatggccgcgttgttggcgttgcggtcgagcgtggtgacgatcttcagaccgccttccttcagcagcttctcgcgagcctcgtcgtccttgccgaacgccttgttcttcaggatctggttgaccacgtacgagcagaagaagccggtgttttcaatggccgactggcatccggagctcacgtcctgcaggttcagcgtgtccttcaacggcgtgttgatggcgtctttgaattccttttcggaggtgatgtagccctggtcgtgcatcagctgcagcacgatgttgcgctggtgttcggcttccttctggttggcttccacggaaggatcgaagttctgcggattcttggtgattgccgcgatggtcgccgcctgggtgacgttcagttccgaagcggagacgttgaagtagcgtttggcggccatttccacgccgcacaggttgttgcggccgaactgcgcgatgttgaggtagccctgcagaatctcggctttggagtatttcttttcgatctgcaccgagatcagcatctcgcgcagcttgcgtgccacggtgtcttccgtcgcatggtattcggcgatcggatcgtcgtcttcacgggcttgggtggacagcacgttcttgacgtactgctgcgtcagcgtggaaccgccctgctggtcgccgcctctgacataggtttggaagaacgctcggaacacgccctgcacgtccacgccggtatgttcgaagaagcgcttgtcttcacgggccacgacggcctgctgcatggctttggagattttcttcagcggcacgacctcgcggttctgcgtatagaattccgcgaaagcggtcttgccgtcgttgaaatacatcgtcgagcgttgcggaagcgaggtcacatcgaaatcgatgccttcgaccgcaagggacggaatgacggctttggccgcgttattggcggcgaacacagcgggcataaagaaaatactcgtcacaacgccgccgcccacgcataacgtgatgtatgcgattaccaatgcgagcacacgttgaacggtaagggtcttcttcttgggcatgacgcccattctaaagtggcgggtctactaaacacatgcccgccaacgcatgtgccggaagccgtcacgggtttctcacaaaacagacaatttcttaggaaaagttggaaatcagccgaaaaccagccgaatgtcatcgtcttgatcggcgaatcagcatgcccggctggtagatgatgatggaccggccttccctggcgatccatccgcggttagcgaaatccatcaacgccttgttcaccgtttcgcgtgaggatccgacgagctgcgccatctcctcctgtgtcagatcgtgcggcaccttcaggccggcttcgaccggttcgccgaatcgtgatgccagattgagcagtgttttggcgagtcgtccgggaacgtccatgaacaccagatcgcagatgcgttcgttgttgctgcgcatgcggtgcgccaatacctgcagcatgtccacggccacgcgcggatgttcgtcgagccagtcgaacagcgcgtcatgttccagccagaccacacgcgtgccgttggtcatcgccaccgccgaagcggtacgcggtccgccatgcggatcgaacaccggaatctcacccaacacttcgccgtacgcgtggatgctcagcagctgcacacgcttgtcggaggattgtctggtcagtttgacgcggccttcctccagcagatacatgcgatggtcggtgtctccctcgcggaagatgaaatcgcccttgtcgtattcggcatgcagcagatacggcagcagttcccgggcttcttcggacgaaacctgcttgaacagcgcggtgtgcagcaacgtctcacgctcatcgtcgaaaccaccaaaaccattgattccgttggttccattcggggtgaccatcgacgtgcctccgttccgccgtgcttctgcgttttccgttgtcgacatccatgccaacgctcgttaagtcgggcaccatcgaccattcgggctacattgtaactcgaacggcggcgtcgaccagtcgcgctactacctcgtctcggcccatgccggtttgagagcgcatgggatcgacatgttttgccgctgatttcaccgctttgtcggacattttctctcgtgagatgttcaacacgcgggtcatcttttccgcgtcgatgtcgtaggcgagcgtgacgtggtgcagaatcgcgccgggtccgccgtgggtgggcgcgaaccggcgttgcgcggcgccgccgagtttgccatattgtgtggcgatgtcgttgagtccggcgaatcgtacgttgaggccgagggcgcgtaacgcttcgacgagccagtagtcgcagagttcgtaggattcctcgacgctcatgccgtgggcgaagtcgagtggcgcgtacagcgagtaggtgatggtgttgcctggttcgatgaacatcgctcccccgccggtgcagcggcggactatgtggaatccttcgtcttgcgcggtgtgcacgttgacttcgtcttcgagcgactggaatctgccgatgaccacggccggctcggcccattcccagaaacgcagggtgggttcgcgggttccggcagccacttcgcgtgcccattcgacgtcgaggtccatttgttcctgcggtttgcgggggtcgtcgtgcacgatgttcggtttgagtgcgtgccagcgtcgcgcgtattccgcccaattgccggtttcggcgatttcgccggttccaacggttccagcgttttcgtcgctttccgcggttccagtgttttcaatgttttttgcgatttccgcggtttctgcggtttccattgggctggtatgccgccgaatgcgcaggtcgtcgcgtggttccactttcgtaacatcattaccgccgataccggcaatgcgatcggcgccatcgatgccgtcaatcgcacgttgaaaggcgatggcgatgccacgcgcgcccatgccgacgatgcgcacgtccggatggtgcagcatcgtccgttcgacggcggcggtcacgtcacgttcggaaaccatcgaaccgctgaggcaacgggccgcgcactgttccagcgcacattccatggaatgcaagagattccgcgttccggcatcgtccccgtcgaggaagaaatcgccgtcgatatggcattcgataacagtcgatgatgcagccggcccagcgtatggaaccgttttcacggcattcgtatgagccgaatcaatatagtccgaatcggcataatccgaatcggcgtaatccgaatcggcatgagaaagccggacagtcactccaacgagtttgccgcccggctgtttgtaaagtcctcgagtcatcaatcctgcagttcgacgccttgagcgtcacggtgccattgcgagccgtagtgggagcacagaatcaggatgccttccaccagtccccagatgcctgcgacggctgggccgatgatgagaatccagccgatgacggtcagcagcagctgtgccacggccttgccggtgttgcccaagtagaagttgtgcacgccgaagcagcccaggaagatgccaagcagaccggcggccagtttcgacttctgggcgtatccggccggtgcgacgggctggccgtatgccggctgctgcgcgtaggcgggctgggtgtaggcggattggttgtaagacggggccgcgtagccctgctgtccgtagttcgcttgattgtaatccggctgggcgtaagcgttgttggggtcatacgccggggctgccggctgaccgtacgacggctgcgcagattgggcgggctgggacggctggccatactgaccgtactggttgtacgatgcggcgttcggatcatacgccggagcagcgggcgtggccggctgagcgggctgggtatagacgggagccgtaccgtacgccggggccggagtcgccggctgaccgtatgacggctgagcggactgggccgactgtgcggtctggccatactggctgtatgcggaagcgttcggatcgtacgccggaacggcgggctcggccggctgagcgggctgagtgtatgcggcggagttctgatcgtatgcgggggtttccggctgcgactccggatggttcatctgcgcatcgttctgttgtggaatgtacggttggttgtagtcggcctgggctgcgttatccgacgttggattgttgacttgaccggcaccattgaaatcggcgttgttatcactcatgcctcaacaatatcccaaggtttgcccgtcatcgggcgtttaccactggcacgaaccccgaaaaacccctgaaaaatcccctgattatgcgaagacgcccaccgttccaaggaaaaccttgtttcggcgggcgtctcaccaaatggaacatccaaatggaatgtcagcgaatgccaatcacatgcgtgccaggatgtcgcgtcccacctcgtcggtggtgcgcgtggtggagccaagctcctcgatgtcagcctcaacggcggtatggatcttcttggcagcgtcgtcgaaaccgagatgctcgagcagcatggcggcggacaggatggctgcggtcgggttggccttgttctggccggcgatgtccggagcggaaccgtggatcggctcgaacatggacggatactcgttggacgcgttgatgcagcccgaagcggagtagccgacgccaccgaccacggcaccggcctcgtcggtgatgatgtcgccgaagaggttgtcggtcaggatcacgtcgaagcgggacgggttggacaccaggaagatggtggtcgcgtcgatgtgcaggtagtcgtgggagacctccgggtattcctcggccaccttgttgacgatgcgctgccacatgtcgccggcgttgaccagcacgttcttcttgtgcacgagggtcacgtgcttcctgcgcttcatggccagttggaaggcgtaacgcaccacgcgctccacgccgtaggcggtgttgatggagacttcggtggccacctcgttcggggtgccacgacggaccgcgccgccggcaccgcagtacaggccttcggtaccttcacgcacgaccacgaagtcgatgtcacccgggttggcgagcggcgacgtgacacccttgtacagcttggacggacgcaggttcacgtactggtccaggtcgaagcggagcttgagcagcaggccgcgttccagaatgcccgccttgatgcgcggatcgccgacggcgcccagcagaatcgcatcggtcttcttgatacggtcctcttcctcctcggggaggatcgcgccgtcacgcagataacgctcggcaccgagatcgaaatgctcgtactcgaattcggcgacgccttcggccgccttctccagagccttctgagcccacggagtcacttccttgccaatgccatcgcccggaatgacggcgatggtgtacttctttgcagaatcactcatagctcgcgactctagtcagtgattcatcaggcggaccaaacccgctcagcaaatggacacccgtcccatgccccacgtacggcgggcggatatccgtttgtttcgataggcacaaagaacgcaatgggcgcaatgcccaacaaagcgatggacagacatgaatgtgcacatatatggacgtacgcaccgcccacatacgcacgttggcgccgtggacagatggtccgcgacgccaacgtgtatgtggcgaatcggctgattcagttaacccaaggagtggattcctcggtgattgacccgaaatcggtgttcgggaacttgcctggctgacggaccaccgcttcgaacatggccagtccgttgagtccggtttcggtattggaatacgcgccgatctgcgattgggttgtggagtcggaagtggaggtcggcggcttgaccactgtgcccatcttcgcccacaacgcatataccgtgccatcgcggtcgatcggcatcagcgacttgccgttctcgtcgaacgagaggacgctcttggcgagcgcgtcgttgcggacggtgctccagccttggaattcgtagccgtcgagcaccggcacgttcgtctggtccacggttggggagatcagcgggtcgccgtcgtagaccttctggtccgcgtacagtttcgtgacttcctttccttccggagcgacaccgccgttgaggtcgaacttgatggtccactggtgtgaggtgcgtgtccattcggcgtacagcgtcacgtcgccgtaacccggatatgagaacgtcttgtctccgccgttgttgccaccggtcttgtcggagttgatggtgcctttgaccgtcacatacgcggtgacgttcgatcccgcgtcctcgccgcgggtgtacgcggccaccatgcgattgccgttgatcacataatggccgaccacatcgcccgatccgttgatgatgtcgtactgttgcccggattggaaggtcagattctcgggcagatcgtagacgaaggtgtcgcccgatttgacagtgacgctgttcggcacgttccaatgcagttgcatgtcgatctcatcgccgtagtcgacggtggtgccggagatgaacggcttttcctggccgccggacacgatggtcagcttggaggagtccttgtccacccagccgagctcgccgatgttgtattccacggcctgcgcatgaacgggcccaatcaatacgcatgccagcatggtcgccaatgtcaccagcatggcggcaaacgttttcacacagcgctttgacgccaactccttgtgcctatgcataatccctcgcttcacgattaagcacaacctaaggtggcggcatccactaccttgccccagctgcagccactgtcatgcaagcacggtgtcacgacgtcaacattgacgtatgaaacagtgtctttccttataaaagttaaaaagcgcggcataaaacgtttgacgttagagtgcccccccaaaaaaagggattcgcgaaacgccgaagggtgtttgcaatgtttcatgaaaattttctgaaacaaaaacccattgccgcaaacgattgcaacaatgggttttcgtcagtcatgattcttctacccccggaaaatcccccggagtaccctcggggccactcagccgccgatgcccatcatcgacagacaccaagcgttctcataggagacttcctcccattgcttgtaccgcccggacgtacccccatggccggcttccacctcgattttcgccacggcgtccacaccggcatgctgcagccgggccagccatttcatcggctccacatacagcacgcgggtgtcgttcatggatgtggtaatgaaaattttcggaaaaacggcagttctttcgtcattttcactatctggcgcattctcgtatggcgtgtacgacttcatatacgcgtacacatccgcgtcgtgcagcggatcgccccactcgtcccattcggtgacggtcaacggcagcgacgggtcgagaatcgaggtcagcgcgtccacgaacggcacgtccgcctccacgcccgcatagcattccggagccatgttggcgaccgcccccatcaataggccgcccgccgagccgccgttcgccaccgtacgcagcggcgaggccagtccggcacgttgcagcgcgcgcgtggcgtcgatgaaatcctcaaacgaatgcttcttgttgagcaggtgcccctgctcgtaccaggcgcgtcccatttcgccgccgccgcggatgtgcggcacggcgtacagcacgccgcggtcgagcatgctgatgcgtgacaccgcgaatcccggatcggaactgatctcgtacgcgccgtagccggtgatgaacatggcggaatcgcaggtcggcacgtcacgtcgccataccagcgagacggggatgcgttcgccgtcgcgcgcggtgacccacacccggcgttccatgtagtcgcgcggatcgaaaccacccagcacggtggcgcgcttgagcagacggtcctcgccggtgtccggatcgtagtcatgcagctcgccggggcgcgtgtagctggcgaacgagtagcgcatgcgcggcgcgtcatacgaggggttgccaccaacgccgatcgaatacaggcggcgcgtctcccccggcatgcggtcggcggtggcgccgtccgacgacgtcatcgcccgacgcgagacgccatgcacggccgatcccttgccttgcgcggcggcggccgcgtccagtttgccccagatctcggcgcgttcctcgttgatctcgtccacggattcgtcgacgtcccaatcgtcctccagcgcgtgcggcaccagttcggtgaaccgccatggccggccggccaggaaatcctcggcggcggcccgtttcgtcatcaccgcgatatgcggcaggctttccgcgcggtactgcagtgcgacgaaatgccgatggatcgagataccctcgatgcccaaaccatgcgcgccctgcagaatggcgggattgcagggattcgaatacggggtgccgatcggcatggaggaagcgccaggctccacgtcgtcgccgtgctcgcagccgtaaggcgatccgaccgccacgcgcacgccttcgcccagccggtatggcggctcgtgtgtccgcatgtcgatcacatcgatctcgaaattcggattcaacgcgttgtggtacaccacggcgagcggaatatcctcgccatgctcccccgcgacttcgaagcaggcgaagctcacgtcgtattccacgtcggtttcgcgcggaatgaacgcctggaaggtgccctctggggtgtccaccggcagcatcagcacctcggtggtggttttcgatccggtgccaatcacgatgttccgttcgtcgaaggacagcccgatacccacccagaagcgttcatccgcctcgcggtacacctccacgtcatccgcgacgggggtgccgacgtggtggcgcatcaccgcgtacggacgccatgcgtcgtcgagcagcacgtagaacacccattgcgcgtccggcgtgaagcaggcgccgccgatgccctcgaaccgctcctccaactcgtcgccggtctcaagatcgcggatgcggaaatcgtagcgttcgtcgccgctcgtgtcggtgccgtacagcatccagcggccgtccttggagatgtccatgccgccgatgcggaagaaatcgtggccttgcgcctcggcgttggtgtcgaacaccacctgttcgccgtcgagcggcacgccggcctctaccgtcggcggatcccaatcgtccgcgccgcgaatcggcacacggcactgcacggcatactgttcgccctgcttggtgcgggtgaagtaccagtagccgtccatgcgcgtcggcacggacatgtcggtttcctgcacatgcgacttgaattcgtcgaacaacgttttgcgcaacgatgcgagcggtgccatgcgctgttcgcagtagcggttctccgccgccacatagtcgcgcacatcctgcgattccttgtcgcgcagccattcgtagttatcgatgaacgtatcgccgtggaaggtgcgctcctttggcacccgcttcgcttccggcaccgccagtccattctggtgttcgtcgtgcgcgttcgtcgcttccttcacgttcatggtgttttccataccccgaaattcactcatgcacgcgattatactgacgacccacacaaacttgtgtcggccgtcagtcgccgttttgcgcggcgcgcaggtacggcagcatggttttcatgatgttcgatccggtcgttcccgtgaataccggcacgtcggtgaccggcatcggctgcgtggccacgcgcccggcgacggaaccgaaattgccggtcacttcgcgcggggacagctgccggatgccgatcgccagcacacgccccgggtagcggcgtgcgattgtggcgtatgtggtcggatccttctgcccgtcgtcgccgatcagaatgaacttcatatcgggaaaatcggccatgagctgttcggcgtattcaagcttgtgctgcacgcccgacggaatgaaggttttcggcctcgggtcaaggtcgcgcagcagcagcggaccttccggaaaaccgtggttcgtaatgaaatggcggatcgagctttccacattccatggcgaagtggacaggtagaagaacggcgcgtccgggaacatgtccgcgatgcggttgaacagcaggttcatgctggccaccggcacttttttgcgcggattaagcagcagcagattgtaggcggccttcatcagacgcggcgcctgcgtgaccatgatggtgtcgtccacgtcggagatcacgcccactttggtgccgctgggaatggtgaaaagattggcgttgaccggcttgcggctacgcactttgtacgagacgttgtggatgcccggttcgagtgaatgctcggcgacgaggtcgaggtagccggcatcgtcggatgccgcgaattcgctggaaatatcaggattgctgtcgatcgcgtcgtatacttccgacgcacccacctgcactgtttcgatgggcacgtcatcgatggcgatccgcactttggtatgtggggacggcaccatcagcatgccacggatgccgcgaatcaggcggccggcctgccgtttgaacgggccgtatacggtacggcagatcagtcgggagtagtgttcggtgccgtagccgacgtagggttcgacacgtggataccagtcgagtgaccgtaccaatgcggtcgagaatttcagccagacactgaatgctttggtgatcgtgcggcggaacagcctggtcagcggcggtttgacttcaaggcgctcatgtctggaggccgcgtcgaaggtggtgaccaccttgcgtgccggaatcggcacggtgggcatgtcatcgcaagaatcgtccatccgctcccccatacgctgctgttcgcgctgctgttcgtgctgcggcgggaactgcggcaacggctgaatttcactcatatgcccactataggggtcgcgttcgaacaaacagtaacgccaccgagaaaatcagggaactttcagggccccgcaaggcacttcccataaaaaggctgcggccggcgggtgcgatgcgcgaccgtaagcccggccgaacggccttgagtgtgtcgcgcatcgcacccgccggccgcagccgtaattaaaactagacgtccgtgctattcagtcagccacaatcttggcatactcgtcagcgctaagcaggtcaggctcgtcatcctcaagctcgatcttgaaaatccagccctcgccgtacggatcgtccgtcacaatgctcggatcgtccgcagcctcgttgttgacgtagcggatggtgccagccaccggcgagaccagcgcggtgaccgccttggaggattcgaattccgccacttcgtcgccagcttcgacctgcgtaccgacttcaggcaaatcgatgtacacgagttcgccgaactgttcggtggcgtattcggtaacgcccaccatggcgggttcaacggaggaatccacccacacgtgctcgtcggagtattcgaggtgctcgggcacgtcgaggttcactttgctatcgtttgcttcgctcatgccgcccattgtacggcgtatgcgaacgccgcgcacccgcgccacgcgtaacgggtcagcgtaccggtccggatggcatggcgccgactacctgcacgatggtgccttccggacagttgtcgtagatccacttggaatcggcttcgtacatgttcacgcagccgtgggagccgtagtgcgccgggtcgccgtgggcgatgccgtaattgttccagcttgccgtgtggaagccttcgccgccgtagaagtagcttacccacttcacacccttggacaggtagcgcgagccgtcgtcgttcaggccggtcatgtcctggatctgatacttgaggtagatgtagaaggtgcccaggtcggtttcgtgcttgccggtggtgcccgtgcacaccgggaaggtcttgacggcctcgtcgttgtgatacacggtggcggtttgcgcggtgcggtccaccacgatgcggtattcgctcttcttctgcacggttttgaagttctgcacatcaccgtccaccggaatggtggcgccttggccgtttttgagcgcttcgccgatcttcggtgcgagcgcctccatgttcttgaccttcacgccgttcacgcctttgacgatggtggccagcactttgccgctgttgtcgacggcgtcttcctggtcgaccgcgtcctggttgagctgggctgggacctgctgctgcacgtagttggtgatggcgttgtcatcgtaggacagcgaaagcgtgccgtgttcgagatcggcgtcggttttcagccatgaggccacgacttcggctggaatctggaaggtcttgccttgtccgttgtccagcacaattggcgcattcagtcgcgcgtttgcctggtcggccacgttttgggcttcaggcagtgcgaccggcacgtcgatggtttcgtacgtgatcgtcacgctgccgctgtgccccgggttcgcgatggctttggcgaccgtgtcgatcacgttgtccaccttcggggacctgccgccgcggccttccactgcgacgaaggcgcgcgcgttggcatcgtacgatgcggtggacggtaccgcgcggtcggtgtcctgcacgaatttgtcggtgacgaacgtcctgagggccagcttgttggacttggcgttcagcggcacgttcttcttgacgaacgggttgacttcgttgatgtattcgagtgcgccgttggtctggtgcttggcggcgagcagttccgtgaccgtcttgtcgacgttgtagctcacgccgaggtcgctcaggctgccggaagcgttgttgccgttgccgtccttgatgttcacggtggtgttcttcacggcggccgtcaccgtgtttttcagctggtcggcggtctgtccggccacactggttccgccgaaggtcacgcccggcgcggccttgtcttggaagtaccagtgtgcggtgaagaagccggcgatcgcggcgaccaccagcacggcgagcacgattccggtgatgatcagcggcagtttgcgtttcttggccacgacggcttctccttcgaccggcatggtgagcacgggaatggcgggagcgggcgtggatgagggcatgtcaccggtaggaatggcaccagtgggaacagctccgttggggacagttccggcaggcgtggtttcggcggcaccggccgtcgggaatgactggaacggctgggtctggtccgatgcgaaattcaacggcggcatggtctcggtggcggcgttggacacgtcgtcctgttcggacacatcggccacgtcggcgagattgatcgtatcgccgttctcaccagactgcggcggcacggcattcaccccttcaaacgagatgccggcgaaactgttgtccgtatcgttctgcccacttctatcagacatgtatgtggtttcctcattcactctcttcacggtacataccatgcagcatgatacgcagacgagtgcccaaacgaatacctaaacaagctcccccggcaaccgccccgaagacaggctcagccgataccaccttttaatggcaggtcttgtcacggcaggtcgtggccgagccattcctcaatcatgtagcgtgcgatcgtggctttgcccggagcctccatacgtcccgaaaccagttcgctcatgtattcgtcgcgtgtgacccaacgcgcctgcaacgtttcctcgccgtccacgtgcacgtcggtggtgaccgccacgcctttgaacgccatcatgagagacgaggggaacggccacggctgggagccgaggtatttgagttcgcctatttcgatgccgacttcctctttggcttcgcgccggcatgcgtgctccaggttttcgccagcctccacgaatccggccgaaaccgagtacaggccgttgttgcgccacgcgctgttgtgctgcagcagcagacggtcatcatggtcgacgatcgcggtgatcaccgctggctcgattcgggggaacagcaaacgattgccatcctcgtcgttcgtgcagtgctgagcccagccgccgagcgccggttcgacgggcgcgccgcacgtcgggcagtgacgctgccgggcgtgccacatgctgagcgagatggcggaggttgcctgtccggcttcgcgtgcgctggcgtggggcgcgaatccgcgcaggtccacccagtcgaatcgggttgccgcgctttccagcagcgatttcgcgttttcctgcgattcatgcgccggcacttcggcgaacgcgtcgtccgctcccccgctgcgagccgtcgcagccgtaatcgtcgtatcgttcggctggacgtgcgtcacgtccacggcgacgacgtgctcgcccaatcgtccgccgtacgagccgaggaatatggcgagcgccgatgggtgcgattcgagttccgcggcaacgtacgcgcccggcagttgggcgaggcgcattttcacgttggcgtagtcggcgatggcgccttggccgtgcggcacggccactttgccgtctttgacgaggatgactttcgttgccggttccgccaggactttggcgaacaggtcgggttcgccgcgtcgtgccacttcgtagtcgatgtctccttgggcgagtggcaggaacggcagggtctgcgtcaatgccagtggtgagaacacgctcatggttgtgttgcctctttcatgcgtgttatatacggaatatattcgttatacatacgtagtacatatttcgtatatatgttttatatattttctctatatcttgtcgatacgccggatggtctgccacagataatcgtcgcagccggctcagccgactcgcttcaccagttccagcaacgcggcggccacctggtcggggtgttcgtacgcgctgaagtggccgcagtcgtcgatcaccgtcatcgtcacgtcggttttcgtcatcgcgtcggcgaccggcttcatcactgccggcgggctggacgggtccttgtcgccgcagattactgcgactggcacgttgatgttcggcagcacgtcgttcaggtcggaacggccagcggccatgcgttcgcgccaggcgatgccgtcggcgggctgttcgttgatccacgtttcgaactgcctgcagtaggcgtccgactgcttcacggtggaatcggcttccgacggcacggcgaatcccatgaccggctcgtgtgtgccggtcgtttcgcagtcggtggcgattgcgacgcgcttcaatcgcatgtcggcggagtcggcgtcggctttcgtgtcgcacagggcgagcgccgccaccgcttccggatgcaggcgttggatgtcgagaatcaagtaaccgcccatcgacaggcccacccagatggctttgccgtagccggcggcgtgcagcaggtccacgtacgcgtccgccatacggtccagtccgtacgggaacgcgccgtcggcgtccttgccgccgctgtcttcgtcggacggaatcggtccttcgccggcgccgggcatgtccggagcccagatcgcaaatggtttcacgccttgtttcacagcttggtcgcgtaaagccgccgcacactcgtcccacatgcggtggtccaccgggaagccgtgcacgagcaccaccggcgtggtttcggtatcgttgccgccgtccgtatatacgttgttgttcagttcaatcgtcatatttttctaatcctcccctatctgtctattcgcctagtttgcctagctcttgccccgcttgcgcggcttgtcctacttgccggtccatgcgagcgcctgccgcacgatggtgccgtagccgttggccatttgcccgacgaaggtgtcgagcatgtcgccggacgggtcgacccattccacgtcgagcgtctcgtcctgcggcttgcaatcgccggcgatcggcaccacgtagcacagcgcgatcgcatgttggcgtggatcgtaatagtcggataggccgggtgtcgggaagaattcggccacggtgaacggctgcaggctgattggcagctgcggcagggcgatatcgcccaaatcttttgcgacgttgcgcgccaccgcttcacgcaacgattcgtgatagagcacacgtccggcgatcaatgtgcgttcgataccgccgtcgtcagtgacgcgcagcagcgagccgatttgcgccaccctgccgagatcgtcggtgcgcaccggcacgaccacgacgtacggaatcggtatttcgtggcgcatgcggttgatttcgtccgatgggagccatcccggagggttgcccattccgcggatgaaatcctccggcgtaatgtcgtcgaattccccgcgatggcggttggcgtcgaaatcgccctcgtcgggcacttcatcattcatcactggcatggttccattatcacgcacggcatgtgaatgtcacgtgcttccgattcttcccatagcgcaatcgggtgcggcagtgtgtttgcgtggcgtgcggctatatacttttcgcaaacgggctttcgcaatattgcgcagcattgcacgatattgttttttgaaatcggcttatagcgtaagccgggaaatggggaacgcatatggcaacgcatgcagtcacttcgcaggatttcaaccaggtcgtcgaatccaatgatctggtgttcgtggatttctgggccacgtggtgcggtccgtgccgtgcattcggcccaacgttcgagaaggcaagcgaggcgaatccggacgtctatttcgcgaaggtggatatcgatcagaatcccgatctggccgccgcggccaaggttcaggcagtgccgacgctgatggtcgtcaagaagcagcagatcatcttccagcaggccggcgcgttgcgcgcttccgatttggatgatctgatcagccaggccaaggcgttggatatggatgcggccgcttccgatggggacaccgcttccagcggagacgccaaagtgaaaacgccaagtagtcagtcggaacgatgattcggcccgtcgcctgcgcgttgcatacgttatcttcaagttccttggggtgcggtagactatatgcagttgcgcgcattccggcggaaccctagcggttgtgcgccgtgccctaggcacggaatccgccgaggaattgtacccgatgtaggagcagaatggctagccataagaaacatgcccaaccaactacgtttgccttgccgggcaaatctcagatggtgaagattgtcgcaacggttgcggcagtggggctgttggccactggcggcatcgtgtcgcataatctgtacgccaccgcggagaagtctcctgccaagcaggtcaccgcgtattccgtcaccgacagcatcgaagcctcccgtggcaacgcccgtgaggcgctttccggagatacttcgtacgtcaccgtgaagatcaacggcaagacccgcgtggttcccggcatgcacttcaccgacgtgaagtccgtgcttgacgcgggcgacatcacccttgatacggaagacaccgtttccccgtctttggatacgaaggtgaacgagaacaccgtcatcaagatcgaacgtgccggcgcttccgttgaggtgtctgatacggatatcgcattcaacacggtcaagaaggagacctccagcctgccgaagggccaggagaaggtcgagaccgaaggcgcgaacggtgttatggagaccacgaacctcgtcaccaagtccggcggcaaggtcatgtcttccaatatgatcagctctttcgtgaagaaggctccgaccgacaaggtgatcctcgtcggcaccggctcctcgtccacgccgtccgcggccgcagcgtcgatcggcaccaccgtgccggctggcgaaatgcagcagtgggctcacgattatctgctgtccagcggctattccgaggccgatttcaccgccaccgtgtacatcatttctcatgagtccggttggaatgtcgcagccacgaacccaagctccggcgcgtacggcctgccgcaggcgctgcccggttcgaagatggtgagcgccggtgccgattgggccaccaactaccagacccagcttaagtggttctggggctactgcgcacagcgctacggctccatccagggcgcctacacctactggctcgccaaccactgctactgagtttttcagtacgagcgaattcctcaatatgaatgagcggtgcatcgcatatttgcgtgcaccgctcattcatattgcacgcagtaccccagctgtcgtcagaaatactgtgcctgtacgaatcggctcgtgaaagtttgtactgggccgcactttgcactaactggtgcaaacccagcacaggctaatgtagacaatctgcgaagccccacgggattttctttttgcagatttcccattctgctcgtctttccatccgtacctaatcgtactttctcaaacctatccatcctctaaatcaatacttcattcataccccgtttgaagtcacagaactctccaagctctcgtgcaaattattcaaggtgcataactccctggacgtccgtgcggaccagaagaacgttcgtgcggaccatccgaacgttcgtgcggaccatccgaacgttcgtgcggaccatccgaacgttcgtgcggattttcagcaacctttgcggatgaagttctcaaattttagcaaggtgccgattgaatcaaagtcaaaaagcccagaattccaacgtttcttgccattataatttcttcaggcttcttgttttaactattattaggcaattcttatccgcacacgtcccgaacaatccgcacacgcgacaccgcgatcatgttcacttagcagtgcacgattccttccaatctcacacccacacgcccgcgcaatccgcacacacttttgggatcacccggcctacttatacacatcttcaaaaccagaacatagttatcaaccgaccgtaatcgcagtgagagaatatccacttatccacagattttcgtaagcaggtggcgccgaccgcgcattttcgcttacgctgcccacatgtacgcacagacaccgcaagatatgacccgcgctctcttcgaagcgcaactcgtagaactacagcgcgcccgcgcaatccgcaagaaataccatactgatgtggtgctcggtctcacttccgctatcagagttttgctaatcgatatgccgtcgctctatgacaagatcaaactgctcgattatctgcatatcgtggtggaggaaccgagattccgctcgtcgcatgaaggtgtgaaatttcacgcttatacagcgacacttccacccgaccgaacacccgaccgaacactacagcgcgatcgcacttctaggcaaacggcagccactccagaaacgccacatacacaaacggcacgttcgcataaaaaagtaacccgcgataccaccccttttgccgcttacgaaaacagcaaatacgctccgattttcgttgagccgcatattttcacagtgcatccgttgctgctgtgggtacagatggccgcatatctcaggctcgaggaattggtggtgctgggcgatgcgatgatgcgtcgcagcttctatcgtgtgcacgtctccccggcagattttgcgacattattgaacgagttgccaaccacgttcccgcatcgcaagaaatgtgataaagcggtgaaattacttgccgaaaataccgattcctgtatggaaacacgattgcgattccgtatgttgcgcgccggctacggtccattcgtaatcaattatcggcttccgttaaatactgccgataaaaagcaggcttttctcgatattgcaattccgaatttgaaaattgcgattgaatattccggtaaatttcacgcacaaaattgggaaagcgacgaagctcgccgcacagcgctgtcttcagccggctggcaaatactttccgtcaacgccgagaccttaagcaattcaggtaagttcaaggattttcttatacaactttcaatgacgattgcaagacaacagactatattgcaacgtaatcagcaaatgtaagatactgcaatctacgacttaatatgtatgcgtgcgcgcataaaacacatgacaactgcaatgcatccatacacgcgcacgatggaaaatgtcttgtggtcggcaacaaccgactacttggcttgcgaagtcttacggtgagaaccagccttcggaccacgcttgccgacagtgccattcttggcaccttccacgttgaacacgatcacctgctcgtcggaataatactcgccgtcaagtgcgtagaacgcaattttggtaggatcgtccagctcggggaagctgaagaacttttgcgtcgcaacaagcaaatcaacattgcgcaacgtcactgcagaagcctctcccggcttcttggtggcgaagcgaatcgcatattcatccttgtcattgcacttttgaatcgcaaatttcttctcgtcattgttcacaagaaccttgacgtatttagggaagcccagcacagcgctgacgttcttggaaaaacgaacggattcaagcatgaccgtcatggtcaatttaccgttattgctttcgccaacctctttaaaaccatccagaatagacatataaaagcctttcttaaatcaaaacaactaccggaaaaactttacatcattttacgattgaatacgaatcgtcatgaatattccacaaatagcgtataacgataacagaaaagaggggtaaataaaagggtgtaaatatcacaatctacaacttacgtaaattgcaatatttacacccttaaatagtacaaatatcagcttctgttatgcgatttagttggcaccggcgccactgccagaagatgcagcacccccattgccgttgactccgacaccggcgccattgtcttctttaccagcatcaccagcattagcagcattagcagcattatcatcgctgccaatattgtcgtcaccattatcaccattattccgcgatggattccaatactgttgcgcctgttgagcctgttgagcctgttgagcccgcgcccgttgcgcctgcgcctgagcctgagccgccgcagcctcctgagcagccctcatggaagcattcaccgcatctgacgcagcggaaatcgccttcgacgcctcctgcatagccttagtatcaacgctattgccgtcaatcagcttctgtgcggcatcgatcgcctgggaaagcgcgtcgcgtgtcgaattatccgcgacttgccaagcggagctgtcaagcaacgtacgcgcaccggaaacgctctgccccaaagcgtcgcgaatctgattggcttccagtgtcttcttgctgtcttccaccgatttcacgtccgcaatgatggtcgcggcttgttccttcatgtcattgctatgcttgttcatgctgcgggcacgcgattgcagcacggattgcgcaagcgacgtggaacattcactggccgcaccgaattgctcgccctgtttgacgctttgcctcaactttgtcagcgtgctcgcgtcggcgacttggctatccgtcagtttctgcgaagtttcagctttccttatcgccttgctcaagatttcgttcgcttcggaatatttgctgcgcgctttttcgcacattgcgattgcagcgctctcctgctgcgcttcttttttcgcacgcacaacgaatacaccgcccacaattatgacgattaccgccaccgcagcaaccgaacccactactattttcttgataggcgacggcttttccggcgatgctgggatggttttcagcggatcatgctccggatcgtcctctttttctgccttcttgcgaacgatatcagcaagggtcacacccctacagtcacccaaacaaccaataattactgcaatctcacgcatgcaaacgtttcagaaaacatgctcaatccacccgtcgaacccagataaagaggcacgatacaatagaccaagcgcgttaaaggagcttgaaaaatgaatttcaatcggtacatcgcattacgtgcgatcgtcgaattcgtgggtgctgtagcatgcgcaacgcaactgtttcagcaccgtacctggccaggcatcatcatgatgtcgtcaatcgccctgctctggattatcggcgaactgtggctcaccatggtgtacaaccgcgcgtatccgcgccgcgacgagctgtccgacgagcatcaggccaccgccatccgcttcaccttcttcatactggtggcggcactggtggtgctgggcttcatcggcatgatcgtctcgctgttcaagcatgtgccattcaacattcccgccatggcgctgccgaccctcggcatgctggcgctggccatcgccgacgcgcgatacctgtggctggaacgtgcgggcggggaaaacggagaagacgatgaagactagtctgaaattcaaacgtatggaacgcgggctcaaacagtccgacctcgccgacctcgtcaacgtgcgccgcgaaacaatcggacgactcgagcagggtcagtactgcccatcgctcaggcttgccatggatctggcaaaagcgctcgacaccaccgtcgaagacctgttcagtttcgacgacgaggaatagcttcggcgtgtcgttttccaattttcctcaagaatggcgagtttccaacgaaaattctatatttgacgattcgggggcatgtgcgaagctcgtcacacgatgagacatcgacgtcacatatgtgcgaatggcgtcacaccacgggaagggcgccattccaagcgaagcgtatagtcaaggcagtagcagggaaccgcaaggcgaactgctgaagacacttccacttattagagaggaattacgatcatgaagaagaagatcgttgcaatcctggctaccatcgccgccgtgttcggcttcggtttcgctgccaactccgcaatggctgtcgaccagtacggcgcaaccggcaccgtctccggcaatgttgcgacgttcacgttcaccggtctgaccccgggtcagtactacgtcgtgtcctacgacgacaccaccgttgagaacgtcaccctggctgccaccaagtattccaaggccgccaaggctcacgacgatggcaccctgactgccacctacaccttcaagaagggtttcgctggcaccatcagctcccagattttcgcttctgacgctgagggtcaccacaccggcgctgcccttgcctccgcgtccgtgactgtggccgccaccggtactggcgctgccgatgctgctgctaacggctccgctcagaccgcttccaccggtgctgccatcgccccgtacgctgtggccgtcgtgctgctcgccgctgccggcatctccctggttgccgtccgcaagagctccgctcgctgaactcggctcaaccggaaataattgaacacttacgttcatgaagggcttggggcattcccaggcccttttttacgcttatttcgcgcgcaccccacagggcatccacgcacgcagaaaggacaccaatgaaggttgtattcgtctgcaccggcaacgtctgccgttcccccatgggagagctgttgctccctcactatatgcccgatctcgaggccgacagcgccggcacgagaggactcgacgcgcatgaaatcgcgccaaacagcgcaaaactgctggccgcgcatggcatcgatgccaaacagttccgttccaagcgcatcaccccgcaactggcgaacagcagcggcctgattctgtgctttgagcacgaacagcgcaaggagatcgcggtgatcgctccaacggcggcgtgcaggactttcctcatcaacgacttcgccaacatgtgcgcgtattgcaaagaacaggggtatatggatggcgatacgcgcgaggaacgactcgaatccgttatcgataatgccagcatgatccgccctatgattcccgataccgccaatatcgaagatcctatgggtaaagattacgcggtctacgagcgttcatatcaggagatttgcaaggctttgcagaccattgctgataccaccactcgataaccccttactgtaagggagtcaagctgaaaccatggtcacgctcagcgccctcccccacaaggagctttcccccatctgggagggctccttgctattatgagtttgttttggattttgaaaatctctgagagggaaacatggccgcagcagaaagtacagcgtcacaaaacggtcaggtagtggttgagcctaccgaaacggaagacaacggcatcaccctgatggacctgttccgtattgtccgcaagcatattgtggtcggcatcatcacttttgtggtggtctttgccgccgtgtgcgcctacacgttcctggttccgccgaaatattcggccacttcccaggtgttcgccacgtacagcgattcctcggtgcaggataataacatttccaacatcaacagcgccagtacgtacatcactaaccagattcagtcgtacccgactctggtcaccactgaatccgtgctgaagccagtcatcgatgacttgggtctcgacactactgtggcgggtcttgctggtcagctgacggtcacgaacccgacgaacaccgccttcgtgaatatcaccgcgcagagcggcgatgcgaagcagtcgtccgacatcgccaatgcggtagccgaatcgttgagcaacgtagtggaaaagtcgctgtatgcgtctggcaaggaatcaccggtgaagctgtccatcgtgcagcgtgccagcgtgccgctctcccccagctcccccaaggtggcgctgtatctcgccgtcggactggtcggcggcctgatccttggcgtcttcgccacgctcattcgcgatcttatggccacccgcgtggaggaagccaacgatctgcaagacatcatcaacgcccctatcatgggccgtattccaacagacgacagtctgaagggcatcaagccgatcatcatctcctcccctgccggtcgtatttccgaggaattccgccgtatccgcaccaacctatcgttcacgtcgaaggttgaaggctccaacgcccgcatgattgtcatcacatccgtcggcccgtccgaaggcaaggccaccgtttccgtgaatgtggccgcagccttggccgagaacggtgccaaggtgctgctcatcgacgccgacctgcgtcacccgtccgtggccgaccgacttggtttggaaggcggcgctggcttggcgcacgtcctgtccggacaggccaccgtcaaggatgtggtgcagcgctattggaagccgaatctgcatatcatgcctgccggtccgaagccgccgaacgcttccatgctgctgaattcgaagaccatgaccgaaatgctggacatggccctgcagacctacgattacgtgattgtggatacctccccgatggtcgtggccaatgatgccgccgtattcggtgcgaagagcgatggcgtggtactggtttccggccgcgacgtcaccatgaagcgcgatctgaaggatattgccgttcagcttgagaacctcaacgttccggttgttggattcgtgttcaacttcgagaaggagcgcaagacctccaacaacgacaattactactattacgacgagggcggcaagacgagccacaaggctcctaagtcccgctccgaagccaagcgcaagaagtagctcggggttaaagtccgctgattcaagagaaggctggaaaccgctgtggtttccagcctttctttatgtcttcaaggctgacaggtgaggtggattcgatcttttcgtttcgagccggtttccgtctcgtcttatgcgcctttccttgtacgccctctctgcgcccacagctgatatggcacttgccggatgccgctatcatgtgggtatgagacttcttggcaatattctgtggctgattctgggtggactgttcctggccgccggctgggccgtcatcggactggtgctgtgcgtcaccatcgtcggcatcccgctgggcgtgcaggcgttcaagatggcggggctgacgttgactccgttcggcaagaccgtggtctatggaggcggcgtgggctcggtgctggtcaacattgtgtggttcgtgctggccggtgtgtggatggcgatcggctacgtgtgcgccggactgctgaactgcattaccatcatcggcattccgttcggtatccagtcgttcaaaatggccaaactggcgctgtggccgtttggttcgcagatttacagcctgtgattagcgcatccagcgcagtcggccatcggatgccgtccgacacgtgagtatcgaagagctgcgatccgattgcgccgtagctcctgcggaagagcagaacgcgccaccatgcgctctaccgagtgacgttgccgccggagcctgcgccggcgattgcgcagcttgggactgctgctgcgccacttgggccaactgttgttcttgagcctgcttcttggcttcctcacgttgcgcgatgttcttttcacgctcgtcgagctgtgtttgccgctggtcttgctcctgttgcttctggtcttgctcctgctgtttctgctcctgctcggattgttgctggtcaagctgcttctgttgcgaatcctgttcggctttctgctgctccaactgatccttgagatcctgaatatcgtccagtttccggttgagctcatcgacttgccgctgcagtttgttgttgtgctgtttctgcgaagtcaactgctgctccagttgcttatactggctgctttgcgtcggatcagcactcatgttgcctatggcgagcgctacgacggcaacgagaataatgacgatccaccgtttccaagagcctggctgcttggatttcttcgtatgctttccaccggttggagggtcggttggcccgttggagtttgaaagctcgttggttgagacagacggagtgttggtcaaagtcagcttgtccgcatcggaaggatatggcatgacggtggtttccactggcgaagtggtcagcggcagttgtgcagcatccgctttggatcgttttgtgttcttcttggctttcttcgccttggcgggcttctcatctgagatcttttggctgtagctgatgccggttcccggaacactggctccaacataggtgccgcgctttcccactgtgacgtgtggcgctccgcgtttgccgaatgtgacgctgctgatgccgtttttgccgagattgacgcgcatgcctttacccaagctgatgctttttcgaatcctgaatcccatgctctcccctttgatagcgtctctcttgctagtcattatatgacttttcggggttgggtccgttatttcaatgcgcctcagccagtttttcttctcttatataaaagcccgtcacattgttttcttttaggcgtctccaaaaaaaacatttacggagtgtagaacgtgccgaagcggcctgaagcatgcgtccatggcaagaaaaagcatccaagactccgcctttcatatattcgacgttccgaccctcccctatcaggaacaagaaccaagaatcccgaaaacgtcaccatcccgatcgaaacaattcccaacccaatataagaagggggacaccgcaaaagcctccacacacaaacagaaaacgtccaaggcaacgtcccagattgcacgatgttgtttcgtatgacaaaacatcaagacatccgttccttctcccgagaaggaatcagcagaaactcaagcacaatgaaaaggaggagccgacgcatcgactcctcccaggtttcgcccgaagacttccaccgcaattaaacgggaatgcactaatcttaataggcgaaagcagccagagcagggcacgaacgggggtacacgcctaacgtagcacgccggcgcactccaaagaatttcaaatggaggcaacctctagcatcgaaccgctccgcatggttcttcctcgacaaggaacagaccatcaaatccaacctcaagcgcgtgtagtagaccatagaacacaccccttttaagaaccttattcgtacaatgccctacctcgcgttcggctgtacaagacctgctttgaagcattggattagatacaccgcagaatgaacggccgcctgaacctttccctttagagaccactccagaatccggaccgccgtgacagtcgggctgactgttcattagaccactcataagtaattggatgacaccgccgagaacattgcccatacacccgaaaccgaatcattgggattgcgcaggcaacgcagcaatcgacaacggcactattgacatcgcaggtatatcatgcgactgcaattgttcaacgagcttttccctcatgtaaggccatgcaacggaaagagcctccggggtattttcatcatcaatgggcgaatcgaattgaatcgcatagcgcagatcggatacgaaaaaaggagacacattcttttcggaatcgccttttttgagagtgatctccgaatgcaacgttaattcgtacggccaaggcttgtcatcacttggattcaaaccaaaattaaaattgatgttgctttccgcgccttcctgcgagtcttgggcaaggtcgcgctcgcttgactggccgagcagcataattctgttgacgttcatccaaccagctcctttttcgattccacgtctttatttgcacgccaaggagcagccttgcccgaagcacccattacagtaaccttgcgtaaaccatcatgatttggtttttgccgggatactgttacctctacgttgatgccgcccatcgttatatcgccattggaccattcacttgttacctgcaattgtcgaacggccttccacgtatcgtatttccggcacccctccggttttagctccgcaggctcgacgctatatgtaatgcgcgccccgacttccaacgcatagtcggtaagcaatgtcacaagcttttttcttccgttctcaatctgagatatgtaagactgggacacacccatctcatcagccaattgctcctgagtcataccccgttgcacacgcatagagacaagaccctcaagaagctggtcctcagcgtgatacaaatcgtaggcaagttcccgataatcgtaaggaagctgaccatccatggttccctcctgtggtggatattacttatagtaatatccaccacaggctcgacattattaccgtcaaccctaattattatgaaatggtcaatttatgaaatcagcgacaattgttaaaagacatcatctgtatcagttaacatatatatagctgacagagagttacaagagtcaaaagagggaaaatgagcaatatcattgccttagtttgggattttgataagaccctcgtagatggatatatgcaagatcctatttttgaaaaatatgacgtagtctccaaagactactggagaatgattaacaatcttcctcaaaaatacaaggaagagcaagacgttgaagttaacaaagataccatttatctcaaccaattcattaaagatgcgcgccctgatggttgcttccctgggctgaataacgaacaactaaaagattttggcaaagaattaaaattctacaaaggtgtcccagatattttcgaggcagttaaacgagtagtcgatcaagacgcatatagagaacgcgacattcatgtggaaaactatgttgtcagcactggaatgtccaaagtaattcaaggttcaaaaattgaaccatatatgaaacatatatggggatgtgaattcattgaagatgaaaatgaaaatgggcaaaaagttattagtgaacttggttacactatcgataacacgtctaagaccagggctttatttgaaataaacaaaggtattccagaaactccaaacattgacgtaaacgcgaaagtccccgaagaactacgtcgagtccaattcaaaaatatgatctatattgcagatggccccagtgacatccccgcattttccgtcgtgaaacggtacggtggcgctacttttgcggtttatcccaagcacgacgaaaaagcctttgatcaagtcgaacaaatgcgaagagacgaacgcatcgacatgtatgcagaagccgattattccgaaggaacaacagcatatatgtggctaacacacaaagtgaaacttcttgctgaaggtatagtgcagagggaaaagaagcgactggaggaatccatttcaagtgcgccacatcatatttcataaacattagccactaccgccccttcttttacatcctttattatacgaaagtctaagagaaggaacatcagaatcaaacaatcaaaatttttaattatcagaaatcggcgttctatcttttcttcctgtctgacctatcagacaggaagaacgtgggtaacagcactataatttgtcgtgagcagattcaaatccaataggattacgagaagaagctttcctctgcaaatcgattagatggaaaacctcagattcatctagatcaagccatcgaccatcgaaaggcgactgataaaactcattcggaggcagcggaacaatcttactccccttttccgatgcatgagaacgcattgccgtctcctttctatgtggttcacgtcagtataacgcgtgaatctggacaacacactatgaccaagctcattttttcatcacaacgcttttcgtaactcactactccattcgtttaccataccttgcattttctttgcgagatttttattatcaacactgtttattttcttacctatcccgatagaaagaacagccattggcaggatactgaaccctttggattcctgcacctgaatagggaacgccattacctgtttccatattccattttcaaaactctgactactgctttgattagtcccaagaacacgtcctgcaatatatgggctatcaaacccgaccgcctcattccgcagctgttctttgtacagataaatacgatcatgagtagcatatcgcgtgagttgactgccatgcgcaatccagagagtcacattgattctgcaatgtccaatcaacgcctcacactgactagcttgctcatgaagcttctctgcgaacctctcttgataagaacgaaattccgttcccgttaacttcttccatagccgtttagttcttgttgctggagggcagtagctagaattccccatataaccaatctcgttaatcagcgttgccgcatcagtataatcattcacaaaaatcggatgaaatccaattgattcccattgagcagcaagcactttcttcattcccataaactgatttagcgtcacctcgggcatactttcacgcgcaatcaaaaccgtagcccgagaatcacctgagttctgtaaaacatcagacaaccagaatctcatatcaggatcgctaaaagacgttccggcaataagtaaatgatgcccctctgtcactgtctgctcaagataatgcttagcatggttcttaccatctctcatggctttgttgtagtcatcatgcgtaagaacaacatcttctacagttgccgaacttccatcacttgccgggaaaaccttaccgtgtaaatgctcaacaggaggaaaagtctgtttccctgaatcaaccgcaatgcgagcaatggcatattcaagaagtaaatcaaaatttagcgtcgccaaatgaacagattcctgatgctggaaagcgagtcttgctgtttgctgatggaaatatgacggaggatacgggttatatgaagcaccctccgggtatagtgcggcgaggatacatctcttccactcattctcattgccgcaatgttgttttacagcttcagctaaaaatagcaaatcaccagcatcacataataacgacgccatatttgcagacactgtcattccttgttgtcggagcatattgccaattaaatctttccatgaaggcaaccccgaaggaacggacgctccagcaccaagcaatatcgtcagttcttcgtttcggtctatgcgcggaagctgcttaatgattgaccactccaactgagatgcgaccataagaattaccaccccatctattccgtctccatcaacggcataagacatgtcaataattttttgatattatcacatcgatagcgcagataacgtccgatagtttgcgcagattcggctttggggcctgatggaaaaggacatggcccggtcttggtacgattttcagtcgccaaacatagaaaaccgcgattgaaaagcaggtcagcgccatgtccaaggaaatcatacagttcgacgacgccatgttcgagtccaagctcgaccggatggtgcgggagaaggtcgagcagaccatcaacctgatgctcaacgaggaggccgaccggatcccaacgccgccagatacgagagaagcggcgacaggaaggccttccgggccggccactacgaccgccacctgaccgccaaggccggcaaactgaaccttcgggtcccgaagctgaagggcgagacgttccgcagccaggtcatcgaacgctaccgccgtcgcgaggaaagtgtcaagggggcgctgatggggatgtacatggccggcgtgagcaccaggcgggtcgatgacatcagccaattgctgtggggagagcgcatgccctcgcagacgctctccgacaagctcaagagggtctacggggagatcgacaagtggcgcacgaggccgctggagggcgcgtggccgtacgtgttcgtggacggcgtgtgtcacaagcgttcctggggcgggcacgtggagaacgtaagcgtcctggtcgccatcggcgtcgacgcggacggccaccgggaggtcatcgcggtcgacgagggcatgagggaggacgcggccagctgggagcagttcttcaggggcatgatagaacgcggcctcaagggcgtccggctcgtggtcggagaccggtgcgccgggctcgtgtccaccgtcaactcgatgctgccgaaggcgaggtaccagcggtgcatggtgcacttcatgcgcaacgtgctctccaagacgccgcccagccacagggattgggcttccgcggccctgaaggccgtcttcgcgcaggaatcgcgcgaaacagccctggccaggccgagaccgtcgccgcggagatggaatccaggaaactcaggtcggcggccaactgcctgcgcgaggggatcggcgagacgacgacctatctgctgggcgagttccccgtgaaccacaggaccaagctgcgcacgaacaacatgatcgaacggctgaaccgtgagatccgccggcgcacgcgcgtcgtgggcggcttcccggacagcaacagcgcgctcatgctcgtgtgcgcccgcatcaggtacgtcaccgccaacagctggtccgaccggcgctacatggatatgtcccggctcgatgacagtctcgtggaagcgaactgatcatcgcgccatggacggccatgatccaaagtgcgcaacctttcgggcactaccgcgcaacgcggtctggattaatacaggcgagtacaacatgaggcaacgccacgggcaggccatgctcgacaactagtcccgaaggccggcggcttctaatcaatccgccaccggccttctcccaccataatgctggtccccaagcacaataaccagtggcctcaaaagctacaaatattcagcatgctgcggaaaaggtgccatatataagccacctagtaaaaaccaactcttcgaatctgccgcaaataagccggatagacatccttgcggagacttttctcccggtctacgacgctcccctattcaccaccgcgatttcaaaagctcgattcccgaggcacgccagaatggaatacgccagtacccggaacacacatggtatgcacctttttagcgtaaccgctgcacttttcttcgcgcccatgcacttttgctacgactcctgaatcctgttggttcgcctgcacttaggtctgttgttcagcctgcgcttggttctgctgagcttgtgcgcctgtgaaactctcctttgactaccatctctcactgtcgattatatggaggagacgagaagcaaaccaagagtagaagaacaagtcaatcatttgccgattcggcccgatcgaatcgaaatcatgattacacttcgacagagtgaaatgagatgaatcctgtatacactcaccatatttagcgttttctccttaggtcaaccactagaagtatggaatgtcttttattggacaaaaagttttacctttggtagactatccatttgttaaaagccaccaatgcctctcactgaagcacactagggtggcatttttcttgctcgaggggattccatggcaaattcgcatgacggcaacgcacaagttctttcctatccgaagcacccaccaaaagatttttcagatctggcagccactctaattaggaacggcttgggcagagtagatgccgagacccttgaacgccacctcgaacaggttggctattttcgtctaaaaggatactggtatcaattccttagcccatcttcctcatgcgactacaagcatgtcctcccgttcagaaaggggacacagttccagcaaatctggtgcagatacatattcgatcaggaactgagaactctcgtgttcgacggcataatcacctttgaaatatatctcaaaagctttctcgcacacgagctttccttgtttggcggcgaatttggatataccaagcctgaaggattgcctgagcttagctttgatgactatctggcatgcattaactcgttaagagcatcgttcacgaaatctaatctgccataccttaaacatttcaaaagaacatataaagaccccttgccgccgtattggatgatagtaggctgcctaagctacggaacgttgaaagggtatttttatcagggatcccctgattctgttaaaagaaagctagcagcgaagcttcatatttttaatccaaataccaatcccgaagtacatggagatatcaagattctctcaaattggttggaaacgattaggcaggtccgcaacatggttgcacatcatgatcgtttctggaacgagaccagtacccgtattgttccgaagctgcctaagcatcggagcggtttgcacgccaatgaatggtggggcaacgattgggacgctttcagaacggactctaccggccccgccgccttcctcaccatggaaaactacctgctgcaacaaatcgatggctccgcatggaagaacaaattcatcagtctcatggaccgctatccggaaattcttgcaacggaaatgggattccccgaggattggcgatcactcgcattgtggtcatgacgacaggcgcacgccgtccgtggttccatgctcccccttgatcatgatttgcaagcgtcctccggaggtcggcgaccgcgcggttgccgagaagctcaacgacaggcccaggaagacgctcagctaccggaaaccgagcgaggcgatgttggaggacgggttctagtgaacgtcgcaacaccatgatcccgaaaaggaacgaatcatggcatacgagttcgatggtgccccctacgagaaaagggccaacatgctggccacccgccacgccagataccccggactggattggcaacggtgtgttggacagttccttagaggacgagtccctgttcggtgaattccttcgggctccggtatccgagggcggagcggagccgctggttgtcggaccaccacacgtagtcgtcggggtcacgcctcagtcgctcgatcgtggtgcagtggttccggtacacgagctccttcttcaacagcctgttcgtcgactcgccacggcgttgtcgcaggggtcgcccttgcgcgacagcgaccgcttgacgccgaacacgcgaagcagctcgtcgattctcgtgttgtcgaactcgccgccccggtcggtgtggaacacctgaatatccgtcagcgggaagtcgagggcggcgaacgcggccagcaccaggcccgcgtccctggtccgtccgacggaatggccggcgatgcccctgtccgccaggtcgaccagcaggcacacgtacgcccatccgtccccgactctcacgtacgtcaggtcgctcgccggacgcgtgcgtggggcgtagccgtcgaacccgcggtccagcaggttcgcgagcttcgcctcgttgacccgcgtcttgtgcggtttgaaccgtctgcgcgtgtacgcgctcgtcatgtcccgccgtttcatgatgtcgacgatgcgccttctggaggcggtgacgcccctccgctccagcgcggccttgatcttcctggcgccgtaacgctcatggctgtcgcgccggaccgcgtgcacgtcgccggcgatcgggtccacccgctcggcttcgggatgcccggtcatccagtagtaggtagagcggagaacgcccggtattctgcattgcgctgatatcggataacgggcggcggcggcccgtatcacgtctaccttcgcgcgaataccggcgccgcctgttctgaaacgtccacctccatctccaaccgcctgttgcgtctcctcagctcgatcagctcgttccgctcgggcgtgcggttgtccgcggcccgggtggagccgctgttgcggatgccctggacccaacggtgcagtgtggaatgcgcgatgtcgtgctcggccctgatctcccgggatggcctgccgctctcgcacgactgcacgatctgccgtttgaacgcctcgtcgtagtggcggggatacttcgggccggccatcgtcggcctccaatcccatgtcattcgtccctcatcggactgtctaatacattgtagccaatccaccctcccggttccgcaattcgtcgatccggacatgttcctctgccgacaggtgggaatacgctttcatatcgagcgcgacactttctccggtcatgaacctgaacacttccaaccatagacaggtgttgcgcatctatttagaactcgggggttcagcattaataatgacgagtatcataatatccgagtggttacgccttctcgttgaagagatggtgcagggtgtgaaattcaaggagacggaagtcatgaaacgtacggttgccttttattggttatcccaaaggagctgtgacggatcttcatacaggcccgtggaaaacttaaattggtgggaacatctgtctgagctaaaggacacggcatgggacaataaagccatcaaagacattaggtatgacgttttgcttgacgaagagtatccgattctaagtgtctatgaagaatttgattcagcgtttatgaggcatatagacgataaaaacaaacgcgttaccgactacatggatgactatgtgggagacgatagtggcaggctagctaaatcttcggcctacgcgtttttccccaatgaaggaattgtgggacgaattggcggctcatccacaagccgtagcgtgtctcctcttgaaagagctcttgcaagatattggcctcttgaaacgggaatgaagtggaacgttgctcccgttgttacgattgacagtttagaaagattcagagaagaggttaagggattatcttctctgcacgcaaaattcacgacaaagcagacattgtcttcaattccaaacgagggcggcactgccggagagtattgccagaagttggctaatgaaattggagcggatattgatgttgatgtcaaaatatctatttcgaatgattctgttttttcaatgccgaggaaaagatttaaattatcggtctctgacttcgttccattcgtggctggtcagggaaagaaaatgagtgttagcggcgttgactttgccgataaattacttgagctcaatcttgtcgagcatccggttacggaacaggaggaaatcgtcatttcaaaaggtgaaacgcatcagtttacgaatcttataaaacatctcgtgaccgtttgcgagcagcaagaggaaaacttgtatcggataacacgggaaagacagtcatagaaacatgaagaaaacaaagaatgctccagatacacctgcgtcttccattgcgaatagcattgcggcacacccattcgtcgacgccgttgcatcattggtagttagcgtgtcttggtatatgtcggggtgtcgtacctttgatttcgaagagccctgcgcagaattgtttacttccttgtcttctgttttccggacttcttatggctgcggccacctttatttgttccatggtgtatcagtctggttcgggacgaatgaaatatgtgataaccaagtattctggtgaattatctagaaactggtcaagcatcattgtctggacaatggttacagcagttcttccgcttatctcgctgtacatctataaggagtatgcaagagtagctatagcggtttccttgtactcagtattgatgatgtttttcaagacaatcagaagtatgcactggctcaaatacactttgtttatgcaaaaggcgtcacagaaactccggggtgaattcactgacgatgatatgaagaaggctgctgcccgcagtgatcgtttctgaagaagctttcatacgacgagttgagcatgtcattcactatgctcaactcgaggttgaagaacggaagacatctcagttctccaacctccgaaaagaagtctgctgacagttgtattgaaccggaagagctttgcgaacatgatgcataattatgagcaggagcagagtgattaataaaatggtcatgaccaaaaggcgcgcggccttctgacactactatcttgcaacctatatctgcattatatatggcagatttggcttcttaacatgagacttctcacttatgcatggcacagcttcttgatatggcctgatttttgttccgcccttatagtggggcggcttgcgccgcttggtttgcataatactcggtttcggtccgttccggtgtcctgtagcccaaggactggtgcagacgctccgagttccaccacgagacccaccggaacgtcgccaattccaggtccctcaaatcccggaagggcttgcgtcgccagacgagctcggtcttgtacgcgccgtcggcgctctcggccatggcgttgtcgtacgagtcgccgaccgtgccggtcgagggaagcatgacgaattccccgaccctggtggtgcacacgaggctgatgtactgcgcgccatggtcggaatggtgcacgagaccgtccgtgccgccatgcgaggcggcccatgatatcgcctgtcccagcgcctgcagcggcagctccctggcgtccatggtggtggcgcacgcccatccgacgattctgcgggcgaacacgtcggcggcgaacgccgtgtagccgaacgagccgttggccatgcgcacgtaggtgatgtcggccacgtgcagccggttcggcgcctccgcctcgaacccgcgttccacgaggtcgggcctgccgcccgtgcccctcgccggtttggtggtgacgggcgtcctgccgcggcgcacgccgcggattcccgattcccgcatgacgttcatcacctggtcgcggccgatctcggccggatcccagccccgcgccaacaaccgggcgtgcgtcttgcggtgcccgtacacggccatgaaggaatcggcatggatctcgaggatgccgcgggccggcgcctcgtgcctggcggccatacggctgacgggcttggatctgaacatgcggtagccgcgcggcgtgatgaacccgcagtccagcgaagcggccagcaccctgcagatcggcccgaccctgaaacggtccttgaattcgtcgatgtaagcgaccatcaacgccgtgtcgggtcgagccgtgccgcgaaaaaagccgacgccgtcgtcaatatctcgttcgcccgcctcaatcgcgcgacctcggcccgcaaactcttcaactccgccatcgcgtcttcggccgactgcttggtctccgccgcgaccgtggcgtccgtcttgttgcgccaacggcgcagcgtctccggcgcgacccccagattgttttgcttcaatttttcttaagcaatttctgcactatttttccgcagcaggggccggtgccgttttgttggactcgtcattgattccatcaccaccaatcatgccacaagaccgagcccgcgtcgacggtccatgatgcccgtgtccgaactccgtcttgatcctcttgtcccggtaccagaccatgtactcgtcgagcatgtcgatgaacccgtccatcgaaacgcccgcgaagctgcgcttgtggaagaactcctgcttgagacggccgaagaacccttccgcggcggcgttgtccggactgcatcccttcgcgcccgtcgaacgcgtcaggttgttgtccttgcggatgcggatccattcgggccaccggtagtggcagccacggtcggaatggatgattggtttctccccgtccctgagcgtggagcacgcgtcggcgagcatgccgttggccaatgccgcgttcgggctggtgccgatcgtccacgcgaccggaagcccgtcgtagcagtcgatcacgggcgacagataggccttgcccgcgggaatcgagaactcggtcaggtccgtgacccacagcatgttcggacgctcggcatggaagtcgcggttcaccaggttcttcggggccttggccggctcgcccttgtacgagccgtaccgcttcgcgctcttgaacgacggcttgatcccgttcttcgtcatgagcctcatgatccgtttggccgataccctgatacccatgctttccggctccaggtggacccgcttgtacccgtagcggcgttcgctgttctcgaacgcctctcgcacgagctccagcaacggcgcgtccttgtcggggcgtttcatggcgttgagctggtagtggtacgtgccgcgcgcgatgccgaccacgggcaagaggcttccggcggtcacgcccagcgtctcgctaacggtcttgacgaggatcgtcttctctcggttggtcaggttttccgggtctgcgcccggctcttttcccaacagctccaacgtgcccttccggatcgcgatctggatgtcgagctcgcgctcggtccgtcgtctggcctcgatgccggcgtccagcccgtccagacgggcctgcatctccgcaagtctccgctccatcgacgccaccgcgtccgccaggccggccacgtcccgcggtccggcggcggccggcggcatggccgccggcgtaaagggctccacgccggttttcccctccccggccgtcgggggcttccttctgggtgtttgtgtcacgtgcgtctccttggatccggcgagcatctgccgtttccagtttcccgacgacggacgcctccacgcccagttcggctgccgcctcgcgcgatttcagccgtccggacgcgaccgcgaccaccgccttccgcttcagttcctcgggcacggggccgtgcctcagcttgcgtcggccgggcgccagctcgtcgatccacgccatgagcagttccttgcttttgggatatcccagcatccgcatggtgcggctgagccgtctgccgtattcgaggtagtggtccaccgcggcctgtttctgctcgtccgtgtaccgccggtaccgtttcccgcgagtggaccgtcttccggtgcgttcctcctcgaggcgttcccggtaccacaccggcagcatccctctgctgggatagccgagctcgcggatcacgtccgcggcgcagcactcgtatctgatgtacaggtccacggccctgtcgcgctgctccttgccgcacttcgccataagggggttctcctcccgatcggggagtccaagaaaacgtcaccacctcgaagcgtccacctcgatttgacgaaatacaccggttcacccgtcatgtcccggccggtctcaggtatcggcctgatgtgcgagtgccgcggcgacgtcaccgaccgcagggccggcgagcacgcgtgttcgagacgctgctcgggtatagcacctcgagaggcgcggcaccgccagcgcgggctccacgccctgatcatcgaaccgttgcgcggcgaacagcctcccgacgacgtcggcgcagtccgggccggcccgccgcgcccacttctcgcagcattcccggtcccactgcctccatacggtcttcccgggcgggtcggtctcgtttgtgctgtactggttggcggccgtggatggcaggagccggtgcgtgctgcagagcctggattgtgccggcgccgacgcgcaggtccacggtggccccggcgtacgcgtacgggacggaacaccagttgcgcgcgtacgcgacatggcagttgggccgcgccttcctgccgtagatccagtccgccacctcgtacgctgtttccggccggtcggcagcacgccgacgaacaggcacgccccggactcgtcgcccgtgaccgggtcgacgatccgtatggtcttaccggcccggtcgacctcgatggcctgtccggccctgtgctcgaccccgctcgtcacaccggtcctcgccgcatacgcggcgtactgcttgcggaaacggtcgcaacccatgcgcggtctgccggcgctggcttattcatcggcgtactcgccatgcaggatgcgcagcgtcacgccgacgcgggcgagctcgcggtgaatcccggcccagtcgggctgttcgtacacgctttcccgttcgcccctgccggggaacggcatcgaatacacctcgccgtcaggcttcgcggccacgtccggataggcgattcccgcggcggccgaggcggacggcacctcggccacgctctgtctcgcgattcccggagatctggctatcgccctgccggacaggccctggtcgttcaggcggggtatcgccttggtgtttatggtcaaataaacgtgtacggcgtcaccaccaaatctgaacggcataagcgttcatattggacacggacggcggacggaaatggcatcggcggaagaaaagcgccggtgccgtacggttcctgatagattcccgagtgctaacaaccaacacatggtcctcgggaggaaaggaatgacgacaccggtgcgtattcaacagagtatcaggcagctcgagacgaaaggcctgacgcatacgcagatagctagggaactgggcgtttcgcggacgaccgtggtcaagtacgcgacccgcgattattcgcccgttccgccgaccgggggaactgcgagccgttccctggtcgcgggcgagtacgcgcgcaaggccgacgaatggctcgaggccgaccggcgcatgccacgcaaacagcggcacaccgcccggcgcgtacacgagcggctcgtggaggaatgcggcttcgagggcagttattcgtcggtgcagcgatgggtcaagcgctggcgccaacgccaccgcggcgaggccgaggggttcagtgagctggaatgggcgccgggcagcgcgcaggtcgatttcggccaggccctggccgtggtcgccggcgtggaacggaccgtgcatttcctggtggtctcgttcccgtactcgaacatgagatacgtggccgcgctgccgggagagaccgcggaatgcgtgtgccatggtctgaacaaggtgttctcccatgccggcatggtcccccgcgtgctagtgttcgacaacgccaccggggtcggccaccgcagggccgacgggaccgtcacccagacgaggctgttctcgctgttctgcgcgcactacggcttcgagacgaggttctgcaacccctattccggctgggagaagggaagcacggagaacgcggtcggtttcctgcgccgcaacctgatggtgccgacgccgtccgcggagggatgggaccggctcacggacgcgtggttggaacgctgcgacgagatcgcgcgcggcgtccactaccgcgaggacgtgccgatccgggacctgttcgagacggacctcgaccacatgctcccgctgccgccgtccatgttcgacgcgtgcgactggcgcggggtgaaggccgacaggaccggaacggtcacgatcgactcgaaccgctacctcgcgggcccgaaatggcattccatgcgtctcatggccggcgtgcgggccctgcgggtcgagctgcgttccatggacggcgagccgatcgtcacgttggagcgcaggtgggggcgcagccccgacaccgcgatggacccgctgtcgctgctcgccatcatcgcacgcaagccgcgttcgtggggcgagagtcccatacgctccgacttcccggaggagacgcgcgtgctgctcgaccggatggagccgcgcgaacgcggcctgctggtcgacgacatccgccacgcggccgtggtgagtggcttccgtgcggccgtcatggccgtcgtcgagatcgtcgccgcgggcagaaggcccgacagggccgcgatcgaccagacggccaggcggatcgcgcagggcgacggtcccgaatcgagggccaggctcgacacgtacagcaggttcatgagggaggacggcgatgagtgagtcgacggacgccgcggcgggcggacgcaggggcgggcggaccgtgagcaagtccaccccggacgaggtcatggagctcgcatgcgggctgccgttgaccaggagcgtgctgcgttccgtggtcgcgggcgccacgcccggccagctcggcgtgctggccgacctgttcagggccgagaacgccagccggacggaatccaggcgcgccaggctgatcaggaacgcgggattcccgtgcgtcaagggcttcgacggatacgactggggcatggcgtcgttccccgccgactgggggcgcgagcagctcatggacctcggtttcgtggaccgggccgaggacctcgtgctctacggcgacgtgggatgcggcaagacgcacatggcgatcgccacgggcatgctggcgtgcgagaggggcatgccggtgaggttcttcaccgcgtcgtcgctggtgatgcgtttgcggcgggcgagggacgagaaccggctcgacgcggaactgcgcgcgataggccgcgccaggctgctggtcatcgacgagctgggctacctgccgatcgacatcgacggggccaggctcctgttccaggtcgtcgcggattcctacgagaagcggagcgtggtgttcaccacgaacctggagttcggacggtggggcgaggtgttcggagacggcgacatggccgccgcggtcatcgaccgcatcgtgcaccacggaaggatcgtcaggttccgtggcgagtcataccgcaacagccactccctgatgaaataaacgaaaagagcggaaccaacccggccgccggtgacggtgtccattttgaacgccgatggtgttcagattaactggtgacgacacgcagatttatttgacgaaagacacttggccttggtttccttgccatgttggcagcctcctttcaccacacgtgcctcgcatggtgaaaggagcctgacaagcggcggcctcgatacgcaataacgatggccttgaaccgcaataatcgtcaaaaagtgcgattggccttctcctgcaataacaatggcctcaaaacaagcaaatattcagtcaatatctcgttcgcccggcgcaattccgtgttctccgcccgcagccgcttcaactccgccatcgcctcctgcacggactgcttcgtctccgcggcggccgtcgcgtccgactggttgcgccagcgccgcagtgattccggcgctatccccagatccttggcgacctgttcgatcgccttcgtctccgacgaatacgacgacctggactccgtcagcaacctgacggccttcgcccggaactccggagtgtatcgagtgccccttgccatggttccatcatctcccatcgagttagagaggaaatgcagaacaaaaatcaggtcatatcactcgtttccagcgggatgattggtttcgccatatggccagcataccggggatccgccaccagccagcgttccaggcactgcctggtcggataacccagatgcctcaccacctaggccgtggtcatcggcgtagcggaatacagctccaccgcacgccgccgttccgcgggactgaacataccataatcctttcgttcagtctccaagaaagcgtccgcagccccctacccttaatgatatgccattccaattcttctcagaatgatcccatataatcggagtacaaaggagactattagttatgtcgttacagttatctgactgtaacgacataactaatagtcaaccctggattatcaattcgataaattcgaagcagcaaaacgctctccgaattcaattaggaatgacggactgaaccgaaatcgccaatagcccaccgcatatgacgctgaataaagatgtcaagaacatagcagacagcaatcgcagcgataagtgttaagaatccaacgagaagctgtcctcccaacggcaaagaagccacaggaataccaacagcggagaacaaaacaaacttgaccatcttaagagcaaaatcattcaaggcgtaaaaaaccaaactgtcccgaccgattgtggcgaagcaacgcgcttctggcaacaacaggctgaaagcgatagccatcgccatgccaaagaacgtggtaaacagtgcaagtgtggcaagcatcgcacctgtagccacaggctgtgctgcagagaaatgttccaaaatcagaaacgctacagtgaaaaccaaaaatgcgccaagtttgtggctgaagttcagccgatcccattttcgaatgtcacatgcctgagcaatgagatatccaaatcctacatacgcagtggcctcaaagattttcccaagctggaaaggaagcattgctgccacagaagtacccttgaggaagaaatcgatgatgagatacaccaaaaggactgcagccaacaccaatttgttgaatcgcacgactcgcactgtaagccatagacaaggtatggctacgaacaatgaccacaagaaccataatccagcattgccctgtgcaaatacaatggcgataatcgcgctcagaggattggaatcagcagtttttccagcagattcatacaatgacggtcggagtaatttcactatgggaggtataaatgcgaacactgagaataaatagtaagggataagcaaggtctttgctcgcttaatgatcaaattcaacagattgacagtcggtttgaagaacaatccgctcagtaagaagaacaagggcatgtggaaggtatatatggcagtcagcaatggttccaactgcggaaaccagctcgcaccgagatgcccggtaaaaacaagcaccatggctactgcgcgagcaatatcaacccatataatacgcgatttgcttcgatctggttcatacgacatgaatactcactcctatagtatcattcaagctttatttagaaaaaacattgcgacaaaatcttctattgcagctcagttccctgtttcttaatttaaaagcactgcaattaacgtctacgttagctaatattatatagcggaattatatggcagaatgccatttccattaactgataacgtgtgtaggaatataaaaagacataaagaaaaatataatatttttacaaaggttttcttttttcctgcaatatagtattcaagataatacggtatgctaagaaaattaagcaaatagaataatgcagaaactctctgacctagtggtatagacagaccaatcataatagctatggatcctacgaaatgcaaatttctaaaaaccgtaaaccaatgatcgccctctttagatttcgtaaacaaatagacaaagaagaaacctacaaacaataaagatgataacgaaaatactttgctaggatccggatagtagccggatatgtagttcccatactttgtccctttgagcaagataccaataactgcaacaaaggtaggtacaagaacagccaaaaaagcaaaaagggacaaatatatttttttgtcaagctttagataaaggagaggaatgacagcaaaataaattagagcagaataatgaaaacctaccgctatcgcaactaaggaaaaagccacaaaaagactctgtaactgatttttgccatccatatttcttttcacaaacaataacgcgcaacagaataatgcagtagctattgtctggcgaactacattcaatgagagtaagaaatacccaccacacaaaaaagaaacagtcaatagaacttttgaacatggcatattatatataacaatatatattaaacctatgaatataaagcttgtaacaataaagatagactgataccagctacctgcaaaatcaatacacagcccgttaagccatttaaatattggctccattggcggggggtgccattatatatctgtttataagttggaacatatgtaaaaaaataatctgttccaactccatagcggaatccagatattgtgaataaaatcaaaaaaacaatagcaaaaggtaaaacctttgcccttttattcaatttatctgccacacacatcaaaagtatgcagcagaaaacagatgttatataaacaaacattcttttccttattttgatacactatattcacaaaaggtatttgttcgagaaaaattatttcatagaacaaatacgtatatccagttgatcaaataagactaacgcttcataaaccatttccatgcgtgtctgaagacatccgcccctgagacaaagctgacagaccagatgcgaacagagctccgtaaactgcaaccaattctcggaatcgctgcatcatcagcaaggtgtgattcggatgacgaagaatcacatacacgcaagcagtaggttcaaggttaagagtaaaccaacaatctatgtcccacttaggtaatgctgtagtgacatataacacatccataaatacactcctagcgatttcactgacctcagcggggagcaaagcctgctgacttaccagaacttttcgttgaaaactaagttcttaccgaagagagagtttcgcaacaacagttgggctgataaatgtaagaaccgcaataatctttcttttcatggagatatcagcggcaatcataggtagggcgagactcctcctatgatgaatgcacgtgcgcaataggtcacgatacacatgttcctgatgagtagcgataatttggcgcaggcaataaccgtaggtactccacaaacgccagttataagccttgcgaacttttggattagaaagatcaaggtgttcacaaatatattgcattgtggtaatggctccaataccctgtcgttcaacgtcaggcttggttgtggcactggtcgcgttatccgtgcgatagtgataaacctttttctgtccgacagtcacacagttggctttgcttgccgctagggtgataaattgtaacccctcccctgcgcaaaagtcggtaataaactcaagattgttggcagtaaggaagctccgcctatacagtttattccacgctccaagctcgattgtgggatagaaaaatagctccattgcctcctgaggattgatagtagacacttcatcctgcgttctctggtggaagtctgtgctggtgaagcaacacagcgatgcaacgatatcagcgttcctcttagcttgaagctccagcatatattcgacgaagtcaggttcgatccaatcatcgccatctacaaaacagacatattcccctttagccgcatgaagaccagcatttctgctcgccgagacgccagaattagtcttatgcaacacatgaacacgttcgtccttatgctgccatgcatcacaaatcgctggagcattgtcaggagaaccgtcatcgataaggagtatctcaatgttgtgatgcgtctgttgtatcagtgaggcaacgcactgatcaagatacttctccacgttgtatatcggaacgataatagaaaccaacggttcagtcacagcattcatcccttcatcggtttattctctgagacatagctagcaacatttgtttgaaggaaaccaagcgaacgtttcttcgcttctgcaagcaactggttaggtctgtcatagtcgatgtcattgctcaacaattcttcaccgacgacatgcctgtccttcaatgtcagggaatccagcaagtcaagcatgcgtgagtttgtagtctgcttgacggtaaagaaatggaatggcttgttgtacacgatggagaacacggtgccatggaaggaattcgttaccacagccttggcgttacgaaccagattcacgaaggtgttaggtgaagcgttccagaagtatcgatcctgatccaacgtgtaatcttcgatggcagtaccgatggtatagactttcacgcctagcttcttggcaagtcgccgcgcataggcatatacgtccttctggcggttatagccgtataccagcacatagtcttcagtggggacgaaatcactggcatcggcaatgacatcccaatcgtttcgttcaagcaggaacaccgggtcaataacggattgcacattgtcaatgccaagatcctcaagcatcggtaccgacgatggctcacgtaccgacacagcatcgaaatcggaaatcaacctatgatagcgggtcttttggttattcggaatttccggcatggcaatgctggcagcatatgccactttccgagctttcgcaggcgcaaacgacaggaaaaacgcatcgtctttaccgttaagcttattcttacagttccaaatctgatcactgccgcaaatataaacatcggcttgaggcacatcagcctcgatttcagcaagagtgcgatatgtcttggcgctcatgggcacataatcttccaggaacttaccgaatactttgcgccccttggtcaagtcggggaaacgcacgacggcacggaccatacgaataggcaatggttgtgtggatgtgtagtagtacttgggattgtaatccagcacctttgcgtccacacccatcttgcgtagtgcggtgttcaaaccataggtttgcaaaacagcaccgtaattcgtcggccggctgcaggtgatggtgtaagaggtagtcataggaagttcctttccgatactgctcattgtgggtccgattcaacgtattcaagaaaagcctcatagccttcgaacataggctcactgcgaataaatgcccgctgcgatcgctccgtattgtcatcgaggcgaaatacatcctggaatgtttcattcagctgagcatcacgagattcgaatagccagaagaattccctgagcagctccttaggcggacgcttatcgtacacttcctcatatttacgcactaatagtgtcgcttcctccaattgaaggttacgccgcttgtctacatatacgtctagagaagaaatctttttcgccggtacgcctgcatatacagcgttcccctccaaatgaccggttaccacactaccagctccgatgatggtgttgtctccgatttcggcccccttgagaatcaatgacttctgtccaatgaaaacattattaccaatacgcaccattccacatgagcccaacacttctccggtaagacgctgcatcactgcccagctatagtcatgctgcaaaatagaacagtctgcagtgatatgtacgttatcgccaatctcaatcatccaaggtctctgagtatcaatcttgatagaccatggcgtatacagatgcacatgctgccctatatgcatcccttggctacgaagccacgatacatattgctccgacgaggacttgtgcccgtataccagttgcaagacaagttgtttaaggcccatcttcttacttgctccgttccggatggatacgtttataaatcaggaaagacacactgtagaggactggagataccgccatgagcttaagctgcatgctgcgtccacgaggaagatccaccgactcggcaacaagccctatgttgcgcctaacaaaggcctgcgtatcttttgcgaaacgtcgccattgttgttctttggaactcctagtgacaagagcctgatcataaaggcttatcatgctccgcatcaacccgtacaaggcaaaaggaagctgctcggggaacctccgacgtaccagttctaccatctgcttagtagcttcgtaacctgcccaattatagtttgtgtatgtatgagaaaggcttccctcagttgtccgataatggtacagaggcaccgaatcaaaagtagttcgtttacttgccgcaagtacttcataagtaaatctcgtatcctcaccattaacgcacccttccgggaaacgtatatcccccaacacagagcgtttgataagcttgctccaaggagaaatcgtcgagtagcccggtaggttaacatacttgaatgattctgaagtggtcatcactaaatggacattaggctggtagtgacagatttgtcgtccatcaggatattccataatgctggcggtcatagaaatatcggcatcattgtttttaagagaattaaaaagagcctcatacatggttggttccagccagtcatcggaatccacaaagcctatgagctctcccgtgctactttcaattccattgtttcgagcagctcccgatccctgattctcttgatgaataacacggattctataatctttagctatccaagcatcacacatgtctgggcaggagtccggagagccgtcgtcaaccaagatgatttccaaattccggtacgtttggtcaacgattgactgcacacaacgatcgagataacgctcgactttatatacagggacaattaccgaaatcaaggggaagtcttctggcgtggccccctcatggaagctagatggattgtcgctcatgctgtatattttctccttccaaacatcaaattaatcaaaggcttgagctcataacattgagcacctgcaatggataataggcaaatcaatgacaaaaacaagtaatggccacattggctcagagtcactacagattgagcagcgagcagccccatggtaatggcagtgggaaacggcctcatgtcgacacgcattaaacgacggatatcaattacacgaattacgaatatcgtcaaactgcccacaagtacaccaagcgctgcagctaaaataccccaactatgcacgaacatagcagtaaacgcaaggcatgatacagttcctacaatcgttgctataagcaatggctttgtacacatataggcctgataaattgtgccaagaaaattgttgatggcacctagatagaaagctaatacaaggatggaaattagcggccataccgagtaaaactgacgctgcatcagtaccttggcgatgaacggagataacgcaatcactaacgcgcttcctatcgacatcaaggcatgatacacacgccagattacatcatagaaatgcttgagcccagagctcttaaactcttggaacgcagaaagctgccaagcctgttgaacaatctgttgaagcacattaagcaaattaggaatctttgaagctgcagcatacaaaccagaagcggaaatacccagtacacctgtaataatgaaacgactaactgtcgtctgaatctggttgcacaatgaattcggagccaatggcagtgagtagcgccaaagttgcttacgaagagacgcgttgttacgccatactgtaaaatcgataaactgatattgcttaccggcaaaaagatataccagaatcgctgaaccattgcctacgatataagagtagaaataccccataagaccgagatgcattccggcaatcagcacatatgcgagcacgcccataataagcgcagacaacatagaagcgtaagcaatgagcttcgtctgatccatagccctagcgacagtacccatcacagagggaaaacacaacgccgcataggacaacaagaaccaaattttatatctacctagcccaccaaaaataggcaaatcaaatactggcagaataattgccaaaagcacacagcttgccaacataaccagcatggtttcggtaatataaaacgcggcttttgacttatcatcaagcgtaaaacggagcatgccctcgctgatgagcaaagttagtacagggaataatgtggtcaccatgatggtagccatgtccatgatgccgtattcctctgtagataggtacagggtatacaacggcatcagtatgaatgccatcagtttagtggctactgcgctgagtccgaagatgccgacattaatcagcaaattcttatacttattcacgcaatcacctcataagcccagacaactgcgacatgtacatttctttgttgagctccgagcgcaatgttaccgcatgagctcccatagccgctcgtttgcctgaatcttgggcaagctcaatcatggcctcagccaattgatcaacgagccgatcatcccgctcaaggatgatggcggactgattatccgcatattctggaatgcctccggagcgcgtggtaatcaacggcttgccggaaactaggctctcgattaccgccaaaggtgcaggatcatcccaaattgacggcagaacgcatacgtcagacatagcgtagatggcaggcatgtcgtcatagtccacaaaaccagtgaaaataatacgatctttcacacctggatttgatgccaaatcccgcagcttctgttcaaacggactcacaatattcgaattaaagaagaacgcgcctgcaactacaagcttcgcgttggaaatttcctccgcaacttcactgaaagctcgaagtagttcctccgctcctttttctggggtaaggcggcctgagaacaggaatacaacatcatttttatcaatgccatatttcttacggaaaatctgcgccttcttgtcggcttcttccgagccgaacctactcgtatccacgccgttgcgccatacggccttctgctcagacctaagcccaccctcaccatgcttgcgaagaaacttatcaagtgtgtccacaatgtaattggaaacgccaagtaccttcttaacctgagcaatctcgtgcttgcaaccgaaatcattggtcacttcattgtgcagatggtagtataccttgtccgcgtagcgttcagcgttaccatacttttgcatggtcatgaacaaagtggcgtgattttcgatcatgaccttatcgaatggagccttgccactcgtatcgtctttgctcagcgctttggccaccttgcggatgtaccacaaacgttgcgcaatataccggtagctcatgagtttcttcttgcgaagaatgtattttgcggcccagtaaatacaccgatcggcagcctttaccagcatcggcgtcttgataaagcgaaaatcagtgtgctgaaaagcaccatcacgaacgattttgtcaacgccaggcgcccaggaagagaaaactgtgaactcgaaattcgcggtcttctcattctctcggaccatcatcatgtccaacgcttcgaccgcgccaccaagcacgttaggaaccggcaagtaaccggaagtaataacagcaacacgtggattcatcttcacttcccattcctcttatttgcagataaatgattcatatttttttaccaagctgtttgcacatcgttggatatcgtattcttcgatgtcaccgctaatttgatctgaacgcttcgaggaatgcaagtttgacagcgtttcaatccaaggctttacatcagtaatctgcagaaaataagagctagcggttacatccgcttccgaaggaacaacatcggacagtaagcatggcaaatccgcgacctgagcttcaacagcaactatgcccaatccttcataaagactgggaagacagaacgcatcgaacgcctggtatagacgattgacatccgagcgttgaccgaggaatagcacatgatcagccataccgagttcttcaacatgttgttgaaccgcagtcctgtcaggaccatcaccgacgaaggcgagcatggcgtcagggcgtttaggaagcagccccgcaagcacatcaaccagaaacgtctgattcttctgtggcatgaaacgtccaacatgaccgatcaggaacgtatcatccgaaatgccgagctctttacgtgtttgtttacgcatttcagtattaaaacggaatttatccaattcgatagcattgggaatcacggtaaaatccgcatttttgccaaataaccattttcctgcataacgactgcatgcaaaacgaaccgttggatacacattggcgaacggacgcagcacaagtttcatcacgttctttgcaaactcgcctttgcccatggtcgaatgagaatgcgcgatacgaacaggcactccaaccttcttcgccgccgatagcgggaacacgctcaacgtattgatattgctgtgcacaatcggccactgctgctcacgcatcaagcgaatcagctcacgacggtagcggatcggatgctggtacggcggtatacggaatacacgaccgcccaaggaggtgatttcctcttcaggaacacgcgtggaatcctcgtcaacaaggaaatcgaactgcactttactgcggtcgatgtggcgatagtaattcatcactactgcctcaacaccaccgccaaccattttgccaacaatttgggccacccgaatcggtttttgcggattgtgcccgccggctcccctatctatgggatgagtatcgacatcgctcatatttcgtattgcttcccttgtacttctggagctccccaacaccagaaaaaactgccattgtttaacgaaatcttactgttataccttgtcttctatcagtatgcacccttgtgggttacgacggcgccgacagtacggaacagcagcacgacgtcacctaacatggaccaattctgcacgtaggtaacgtccagagcctcggattcctcctcactcaggttggatctgccggatacctgccacggaccggtgataccaggcttcaccagcatgcgagtggcatacgtctggttgtactgggccacttcctcaggcagcggcgggcgcgggcccaccacgctcatatcgcccctcaacacgttcaggaactgcgggaactcgtcgatggagaacttgcggatgaaccggcccactgtagtgactctgggatcgttcttcatcttgaagatgaaccgtcccttttgcccggtctgctccgccagttccgacttcatcttgtcggcgttcaccaccatggaacggaacttaatcatcttgaacggcttgccacggcgacccacacgggtctgagtgtagaaaataggccctctatcggtcaccttgatggcaatggccaccgggatggtaataatcgcggtgccaaccaatgccatcagcgacaccacaatatcgaacacacgcttcttgaacatggcccacggcgaatactgcggcaggctgatggtcatcaccgtggaaccctgaatcacacggatgttggtctcatggccgctcacatccaccgcggaggtaatcaacgccacttccaagttcatggcctccacgtccagcacaaacgtgttgaaattgtccgagaaccggtgcatcacatcagtaaccatcaccgtctgcacgcccatggacgcggcgcgttcggcaaaattcttgcaatatggcaacgtggcgatatccctaccacaaatctcacggatccgctgcttaaattcagcggtaacatcaacggcctttacatagccggtctgcgcatccagcccaatcgggcacaccgcaatggcatggtagttcagctggctcttccggctcaaaaactgcaaggcatgctcaatgccctccagcgagccgaccaccacggtgccatacgaatacgcgcccttctcacggctgaacagcacgcactgacgaatgatgaaacgttcgacaatggtgaccagcaacgcgcacagcagcgccaatccagtggtcaccagaggcacatacacgttgagaatggaattcaacgcgcaaaccatcaaacccgcgaacagcgcgcccttgatcaggaacgcattgagctggtaaccatcacccatcacatgacggtggtacacgcctacgctgtgcaggcaatatatccaaatcagcgacccaacaagcatatacgcccacaaagcaatatggaagtggaaacgcgtggaatataaatcaccggtattccgcaccacgtatacgatcgccgaagcgatgatgaaggcagccatatcgcacaacaccaacagggcgttgacgaagaaacgccagtaggcaacgctgagcacatgcctgcgtgaggtctcgctcagtttctccccactattgccactgtaagccattcttctttctctccaagactaaaagccattaccccccccctgatttgttgggggcaataaattagattactcgcacttccgtataaaagacactctccgcttggccgacacgctcacctgccttcgataagcggagtctggcggacggtgagggcattcttcgtgttcggagcggactgcacgtgcaaggtgatctcatactcctcccccggcttcaacgtgaccttgccaacggtgagcgtcaaaccgtcatgcacggtcacgccctggtaatcgttctggttctggaacttccaatccaccaagcggccattcgccggcgcgtacaggaacaaggccgtccggatatctccaggctcggttccatccgtgccaccggtcacataattcggagccgtggccagttccttggcggtcatcagattcttcatcttgatatgcaccgtgtactggttggcaccgttcgccgccaccttctggaattcggtggtcacctcgcgatgcagataccaatccatcttcgactgcgtctcgtcggagatgtacacgcccacctgcggcttggcgccttcggtaatcaagcggccggaaatgtcggattcggcgatcagatcctgctcgtcctcgtgcgcgctccacaacagcagatgcccctgcttcacggattgagacaacgcattgatataggctttcggatcgccggaattctgcgtgatatggtcgaacgcggcctgcgcggcatcagcgaaatacttgtccgtctccgccggagtcatcttcgcgtacacggtgttcaacaacgtctgcgcggtattcgtaccgtccaatacggagccgtcgggcatggtcacgccgccggtgacggcaagcatgttctgcaggaacagcgggtcgatggcaagcacgccatccacctgtacgccatactgcttggcccacatggcacgcacgatctcgccggtacgcgggaaatcgggagtgaagttcacatcgcgaatatccgtacccagcttgtcggtgaacaacattttctcctcggcagtgagtttcaccaccggctcgtcagccttagaaatatccgcgtccgagacaaacggttgcatgctcaaatggccgccctgcacggtgaccacgccaagcgacccggtcaggccgccggacggacgggcctccgcattggtctgcgccagaatcagatagttgcgcggagcgtcattggcatggctgtccgtgccgagcatgccgggcagcagctgggctacggtgttcagcgtatgcacggtgctgttgagctttacacagtaggtctgggccgagtcgagcgcatcggcgaccttgtgaatgtgtggccgtttcgccgccttgatctcacgggtgctgttgtcgatcaccttgtcggcaacgctcagcggctcctgggaatcctccaaaccaggaagggagaccgtgccattctccacgtggatattgctcagattgacgttcttggagaccttcgccaattgcggcaacgcctgcgaggaaatatcctccaacgaggcgaccgtggtacggaccgcggaaacatcatcccccacatacggaacatgcgatgcgaccgtccataggaaggacgacgtctgcttgtacgccttgtccacatggccggagaattcgttaaccttcgtgtcaagctgtcggctgtcggcctgggtgatggtgctctgcagacccttcgcgcttgccacggcctgctgcagttcgctcctggcgctcatgaccgaccatacgaacgcgacggcaaaggcggcgagcgccagcagcacggcgaccacggcgatcaggatgcggcggttgcggcgtttgcgtttgatgcgacggatgtgttcggcgctcatgcggcgacggacgcggcgggagtgcggttcggagtcggcgctgtctggggcatcttcattgatgtcggcgttggcgtaggcattggcatcggcgtgcgcttcggtttgatgctcgggctggtattccgcctggttttgagcctttccaatctggtgttcggcctggttcgctggctcctgccatgtttcatcgccatcgtgttcggacatatttcgttactctccccatcacaacgttgtttcacgtatcgctccgggtttccagtgtaattgctggagccgatgaactcgtactcccccaagaattcgacgaggacactcggcgaaggccgtcaacaagaagcggattaggcgacttcgagggtggcgaggagcgcgcggtggtcggaaccggggatgtgcttcgtttcgaggtcgcccacgaccacgcccttgtcatgcacgatatggtcaatctcggccaccggcagcatggccgggtacgtcatgtgcaaaccctcgccggcctgttcgccggagtccaggaagcggctgccaagaagataccggaagctggcatgatcccatgtggaattgaaatcgcccatcagcacgtacaggctgtcgtaatgctgcaactgggcgagtgaatcgaggctacgattccacaggccttggttgctgggacgtggcgagaaggggtggaccgagccgaaccgtactttcgtgccggcgaaatcgatggtcgccgccggaacactgctcgactccacgggaatcaggttctgcttgacgtcttccatcggcgccgcgctgtacagcacgttcacaccaccattgtcgtgccacgtttgctgcgcggtcacggaatacggcagatagttggcgattccggcgttggcgagccggtcgagcagactccatgacacttcctgcagggcgagtacttcgacatgctcagccttcacggtttcgacgattttgccggcgtcggccgcaccctgtttggtgttaagggtcatgatgcgtgcgtatttgtcggacgtgtcgggcagaccatcggtttccgtctgcgcgacggcttggctggcgttctcggaaatcgtctgttgcggttcgatatacccccaatgccagccgacctgcacgaccacgcacaccacgccgatgatggcgagcgctgcacgtcctccgatctgtcggacggcgagcgcgacgatcgcgataaccgcggacaggaaacccagccatggcatcagtgcgacgatgatcggcacgtagcgtttgccgtcgaggctgttggggagcatgcggagcaacatggccagcaggatgacggcggtggccagccagagtgcgatggtcaggatgcgcaggatggcgctgcgccgggacatgccgcgttgggcgtggtcgcggccgctgcgactggcgccggcagcgtcgagccgcgcgcccagatcctcgatctcgtgttcggcttcgttttcgttgccgctgccgcgttcgctggtgccttcaccttgttcgctggtgccttcaccttcgccggtttgccgcatgcttgcctttcattacgttcccgttcaccatacgcaacgcgatatggattcattgtaaacggtccgcgaggttcacagtgcctttacgtgctcaccgttcttcgcaccgtctttcccaccgtctgtacgccaccgcacgaacgtcgaaactgaatcatcgcaagaactcgccacgtgcagcatcactcaacgaatatcgaatcggccgttttccatgcgcttccagcaaacccaagtccatcaacgcatcgagagcggtgctcaccttccgctcccccacaccaagccattcgcgcatcaatcgccgtgatatggaattcgaagtatcgtcgaacagctcctcctgaagcaggaagaacagcatgtccctctgcagttcgggaacgtcatgcgcatcggcgtaccgttcgagattgtctttcgcggcatcgagcatggccttcttctcgctcaacacggaaatgatgttttcctgggctgtggcgacgaaatggatcatccgatagcagaacaaagaaacatcggaacaattcaatggatgctgcacttcatcaaaagccttgtaatactgccctttcgcttcagcgatggccgagctcaggctgaccgccgtcggtacggacaggcttttgcttaattgcagggcgagcaggaaccgtcccgttctgccgttgccatcgtagaacgggtgaatgcattcgaacgcgtaatggcacatcgtggcccgcagcaacggcggaatggtctcgttggaaagcaatgccagccattttgtcagctgcacctggatctctgattccggccatgcgcccttatgaatcaccctgtcagcaccgtcatagaccgaaaccgttctggctctgaacagcatgccatcaggtttttgatcatccttcaattcgccgtccatcacctgatcgtagatactgcgtatatcgttcagcgtctgaggcaaatcaaggcgtgctgccccctcgccggaaaggccgaggaacagtttggcgagttcgctcaaccgcttatgcggaccatcggccactgcggaatccaacgcgtctgcaatctcctcgcgcgtggtatgcacattttctatcgtgttcgtgttctgcatttccgcaccgatgagttccatcagatacgctctgcgagcgatcggaggcaacgtgttccacagcgcttcaacccgcacttccatacctcgcacggaatccatggcgttaagcagttccctgaacgccacggcgaacatctcatgaccatcgaatacgattcccgaccgatatgtcgaatagccgttcagcctgttctcatactccttttcggccgcatcctgtggtttgagcgtggatgatgacatcgccaacgtctgccgtatgctcttgtattccataatcaccatccctgaatcgtcattctcgcaaaaacgtaagtatgaaccgttttatccggcgttgacatacctgcgaaaagctaaaaacgtaggtatagaaatgaccacatagtatatctatacctacaaaatgtcaaaaatgtaggtataggaataggtgattggtgcgactatggctgcggaatggcgtaagcgtgggcatagcgcaggcatgggatagcgattgatgtcaggttacgacgtcagtcgcgacgccggctgcggcagccgacgtcgaccacagcagccaagccgcatcaatcggacagactcaggccgcggtgtgggcgtgcatgcggccaagggcgcgctggacggtgtcgcgggtggagccggcgccgttgccgcggacgccgaagaagaccatgaccaccatgatgaagcagatggtggcgctcacgcgcagcgcccactggatgccgaacacgttcgcggccgcgtacatgctcttcgcgccaccgattgcggcccaacgcagggcggtgaacgtttccatcagaatcaccagcacgggtgcgccgatggcaccggcgatctgacggaccgtgttcgtgacggccgagccggcgctcacctcctcgggctccaggcagttcagcgaccatgtggtgatcggcataagcacgaatcccataccgatctggcgcacgaactgccagatggacacccaccagatccatgaggtcatggaaatcagactcatcatgatggtgccgaacagcagggtgatcgagccgatcagcgccaccggacgcgcgccgagacggtcgagtgccttgccgccgaagaactgcgcgatgcactggccgaacgcgccgggcagcatcaccagaccgctgatcgtggcggaatagcctcggcaatcctgaatgtagagcggcatgatcaccatgatcgagctgaaggcgaagaacgacagcgcggcggtgacggtgccgacggtgaagctcttgtttttcagcacgctcaggttgagcagcggaggttgcttggacgggtcggccgcctgcctgcgagcgccgtggatctgccgcagcacgaaccagacgatgccgaccaggccgatgagtatggcgagccacaccatcggatgcgtgaacggatacgattcgatgttcgtgaagccgaacataaggccgccgaagccgaacaccgacaggccgacggagaagaagtcggctttggcggacgcgtcgcgcgtgccgaaattacgcaagccgaaaatcgccaaaaacagtgaaatcacgccgataaccgtcagcgtgaggaagatcgatcgccaaccgttcaaatcggtttgcacaccacccaaggtggggccaatcgcgggcgcgacgctcatggccatgccgacggtgcccatcgccataccacggcgggacagaggataaatggagaataccgtgatttgcaggaccggccacatcacgccggtgccgacggcttccagcagacggccgatcaaaaccagtacgaacgatgagccgagccaggcgaacaccgagccgagcgtgaacaccgccatcgatgcaatcacgatctggcgggtggagaatcggcgggtcaggtaggcggtgagcggcaccataacgcccatgacgagctggaaaatcgacgtcagccattggccggtcgtcacggaaatgccgaaatcggacacgatggtgggcagtgcggcgctcaactgcagctgcgtgaagttgccgacgaacgtgataaaggtgagaatggcgatcgatacgaacgcagcatgcgtcagatggtcgtttttatacgattcctcgccggtaagtggctgggacaggccgtgggtgcggccctgtttcgcgtttattttcttttccggcttcacttccgacctcttctccggtttcgacggcaaccgactgctctccatcattcatccgcgtatattcgcagcgtattgcgcaactcctgcaaaaactgactcaaaaagtctagtactgcgggtggtcgaacgtgaggtgaaactattcgaacgcgttcaattccaattcaatcgagaaaaattggcaaaacttcgtatttgttcatcttggggtggtatacatatgcgttggcagtaacggcacgatacaggaaaggaatacgccgcgcagggggttaggaagtatgaccatagtcacgttattcaacatagcgatggagctatggggcgttctcatctgcatcgtttgcgcaggtggcgtctacgtgggcgcgatacgtaggacgcggcgtacctatacgaaagtttccatgcagcttctatgtgcgctgatgctgctggccgacgtgtccgcctggtatcacaacggcggctgcgacaagcttgacttctatatgacgcgcatcggcaatcttggtgaatacctgatcgatttcaccttcatcgcgctgttcgccaactatatctggcaaaccgtcagcggcgacgacatgcttgaagacgtcagcctgcacgagtgggtggccagaacgagcggcggaaccaagcgtaaccgtaagaaccaacgttcggccaacgcccaatccaaaccgaaaaagccgcgttcgaagaagcttgacgtcatctacgcagcgtccgcgctcggcatcgtactgacgattgccacgcagttcaaccatatggtctactacatcgacagccagaactactaccggcgcggaccactgttcgctatcccgcagatactgggtctggtagagctcgcgctgattgtgatgctgatcatcgaaaaccgcaaaaacctcagccgaccgctgttcgtcacgtcgctgtcgttcttcgtgctgccgattgtggcaaccatcgttcagattctccattacggactggcgttgcagaccatcgctgtcacgatttccatccagctcacgttcgtggtcgacaccatcgaaatgaacaagaagatccgctcgcaggacgatgcctatcagaaggtcagctacgaagcgcagcatgacggtctgaccgatttgtggagcaaaagcgccggccgcgaacagattgagaattatttcgcgcacatgcaggaagacgaccaggctgttctgattttcgttgacatcgacgatttcaagcagatcaacgatacgtacggccataaagtgggcgatttctggattcgtgaagtggcgcagacgttgaagcggctgtaccggcatgatgacatcatcgtccgtttcggcggcgatgagtatgtggcgctgataaagaacaccgcgaacgagcgcgtgatcgaaagcacgctggacctgttccgccgccagttggcgcaggcgtccgcgcaatacgggcaggacgtgcattgcagtatcggcgcatgccgcgtgctgtccggcaagaacgtcgatctgagcctctgcttgggattcgccgaccatgcgttgtaccagtccaagcgtgaggggaaaggcatgtacaccgtggtcgattatgacagcgggaaagtgcaggcagcgtaggtttcgtggaaaaatccgcgggaaatctgcgggaaaaaccctagaaaatcagctgagaaactacgaaaaaagcaccgcaaatccgccggagatcgacgtaaaaatcacggaaaatcaggctttgccgagcattgtcagcacaatcagcaccacgttcagagcgacgatcagcgccgcgaccgcgatattgacgacgtgcttggccgggccgtccacgtactcccccatcagcgtgcggtcgtgcgtgtaacgcatcagcggaataatcgcaaatggaatgccgaccgacaacacgacctggccgacgatcaacgcttccgtcggattgttggcgaaccacagcaccaccaacgcgggtaccagcgtcaccacacggcacgcccacatcggcgctttgatgcgtagcaggccgtgcatgatttcgctgccggcgtaagtgccgaccgacgtggagctcaggctcgacgcaagcagaccaatcgagaaaatcgtgccgatcaccgagccgagcacatgctggatggcccgttgcgcgccttcgatggtgtcggtgccggtcatgccgtacagcgagttcgcggcgaggatgagcagcgcgaggttgaccgaaccggccagtatcagcgcccaggcaacgtcgattttgctgccgtgaagtagctttttgatgctcggcttcgcttcgccgggggcgtaatggtcgttgacgagcgtggaatgcaggtagatggcgtgcggcatgaccgtggcacccagcatggacgtggccatgagcacggtgtcggtgcctttgaagcgtggaatcaagccggcgacgacttctttcggatttggcggggcgatgaacagaccggcgatgaaaccgaacgtgatcaccagcagcaggccgatgatcagtttttcgaaaatgcgatgcgtggcgcctttttcgaaaatcagcagcaccgtcgacactgcgccgatgatgcaaccgccgacgaacagcggcagaccgaacagcagtttcagtgagatcgcaccgccgatcacttccgccagatcggtggcgatggcgattacctcagcctgcatgaagaacatgaaacggcccgcgtcgccaagccgttcgcccaggatttccggcaggcttttgccggtgacgatgccgagtttcgcggactggtattggataagcacgctcatgcagttggccagtaccagcacccacaccagcaggtagccgtagcgcgcgcccgacgtgatgttcgccgccacattgcccggatccacgtatgcgaccgccgccacgaacgcggggccgaggatgccggcgagcgcggggccgtggtggtacggccgggcggatcggtcatgctgcgcagtgatcgtcatattcttcgaatccatatcgttcttcatatccacgcaacgttatagtgcgttttccgcgcagaattgttacgtctgttacggaaagctgaacagctgccgaacatgcgccgattgtggggcggacaggccgcgatcacggaagccgctaaactggtgcagagaacatcgcatttcgactcaaggggttgttccatgactgttttccacactccgatgatcacgctttccgacggcaatctgattccgcagatcggcttgggcgtgctgcgcatcgacgacgagggcgttacccccgtggtcgagagcgcgctggaagccggttatcgccatatcgatggcgctgcggggtacaataacgaggctggcgtcggacgtgcgctgcagaacgcgggcttcacgcagggtgagaatcgcaagaacctgtgggtgacgacgaagctgcgcgattcggaacaggggtacgattccgcacgcaaggcgttcgaccgtcagcttgacctgctgcagctcgattatgtggacatgtatatgctgcattggcccaccccgttcaattggcgttccggcgaaacgtggaaggcgttcgacgagttccgcgcggagggtcgcgtgcgtacgcttggcgtgtgcaatttcctgccggagcatcttgagcggctgcataaggaaacgggcgaatatccggccgtcaaccagatcgagctgcatcccacgtggcagcagcgcgaggtggtggcgtattgcaaggcgcacaatatcgcggtcgaggcgtattcgccgatggcgcgtggcgcggatctcaatgccggcgatggtgtgatcgaacgcatcgcgcgggcgcatggcgtcaccgaagcgcaggtgatcctgcgatggcatatcgaaaacggcacgatcatcattcccaagtcggtgcatgcggaccggcagcggcagaatctcgacctgttcggtttcgtgcttgacccggacgagcatgcggccatcgacgcgttggatgggccgacgcgcgccgggcacgatccgatgacgttcacgtacgcgtaagactgcttagggtgcgatgacaaggcgcggatcgcgtgacggcacgcattttcgccgacggctgttcaatgccgacgggccggtggaacgcatactgatcctgctggtgatcgccgtggtggcgggcatcaccatcggcctgctcatgccgaaagcaaacccgaccgtcggcgaaataacaggcgaatacaccgcgtcaggcaccgccgcgcaaacgctgcagcagctgacggtcgacgataatcagcggcacgccggctacgatcgcgacctgttcggcttccgccaaaccgatgacgacggcaacggatgcgacgtgcgcgaagacgtgctggcgcgcgacctcaccgacgtgcgctaccggcagcatggatgcaaagtggaatcgggcacgctggccgacccgtacaccggcaaaacaatccacttcgtacgcggcgcgcgcacctcgtcggcggtgcagatcgaccatgtggtggcgttggagaatgcctggcggtcgggcgcgagcacgtgggaccaagccaagcggtaccggttcggcaacgatatgtacaacctgctcgcggtggacgggcccgccaatcaggagaagggatccgcgtcggccgcgtactggctacccacgaacggcgcgtaccggtgcgagtacgtggcccggcagatcggcgtgaaagccaagtatgggctgagcgtcaccaccaaggaaaagcgggcgatgctgtccgtgctgcatggctgcccggcgcaaagcgtgccggagcggtgaggcgcgtggcaggtggcggagcgtaggtgcgcggtgaagcgtaggtgagtggcggagtctcccgaaatgtgtcacgattcgaaatttcggctgttttttcgaatcgtgacacatttttccttccaaaaaaacaatacgggggtataaaacgacatattcccaaggaaaatgcctcaaaaacatacccccgaaccgaaagtgatgtgtcacgatccaaaattttggtctttttttcgaatcgtgacacaaaaaacaagcctcctatatcctgtgcgcaaccaaacgcatcggaatgccgcgcgacgaacacgattatcagcggctttcaaggattccagcgccgatcgccacaaaagaggcacaacaccgaggagtcgcgatcatgcggaaagcgggcggcctcacgcgcgcacccaacgaaaccgcatcagtcaagcagcctaagcttgcgggctttccgataacgcagcaccactttgcgccatggcaagggcgtggtcaccccaatcggccgaccgacgatcgaagacaacgcatgggcgacgttcatggcgaacgcggcgcgatgcaattcgtcggacaaatccagctgcgtgaccgaaaacacagtccaaccagcggccgcaagacgcgacagcttgttctgatcgcgccgatattgcgcacggtcagtacgatgatggtcaccctgatagtccaggccaaaacgatgctcggcatcgacaagatccaacgtcaccgcagcgccattcgcaaaattcacgccggggaccacacagttcggttgcataatcggcaggccataacacacaagagtcagcctcatttcggtctccttgggggaatcgctgcctgactgcacgagcgccaacgcatccagacacttgctccggtatgggacgctctcagttttaacaaactcaatcagccccttgcgagtggcgaatcgatggcgaatcaacgactccgcaaccatgacgatgtcctggataccccaccggccggcagccaaagaccacgccggaacgggcataagcaccggaactccagcaacctcacgcacgtgtcgcgcggacaagcccttccagacatgcacggtcacatcggccgacaccgatgtgcttttcttcacacggccgcgacgagccggcgattgggcgaccgtatgaagtttcgccggggattgcgggaattgggaaggctgagaagccgactgccgaagacctggaatctgattccgagaaacagcctgggaatccgggaaatattgaaaatccgaatccgggaaatcctgccctaagcggatagagtgctcggaatggccgaaagccggactttctccactccatccatagtccacgtccgtcccagcgtaaccgccttgcgacgaacgcagcgaaacaacggagcaatcactatctgcgggcagctcgacgccccaaatcgcgagcgcggtctcgtgacttacgggatgccgcaactccacggactgggcaatgcggagaatacgccagctggcttcggacagggtcgcccgctggatcggcttgtatgcatcatcagcattcatggcgtgcaatataaacgatggcaacggtttgatgtgcgtttttccaaagttgtggtcggagaacatgcgatttggggcagttcagcatggcatggccgtaattccaacgatttggagcgcaacagcctgtggataaccaatggagatggttccagctaccaccgcagcctttacaagggacgcggcctggcacttccggaagtgcggcaaaccggtatttcttttcgcttggggaatcggggatggatcagcctcagcccagccttcaaggcaattcggaccaattcatcacgaaccagcacaaactagtctcaagcgagccttgaaccagctttggagcggaatcttccgctataaatgtgtcacgattcgaaatttcggctgttttttcgaatcgtgacacatttttccttccccaaaaacaatacgggggtataaatcggcgcatttccaaggaaaatgcctcaaaaaacatacccccgaaccgaaagcgatgtgtcacgatccaaaattttggccattttttcgaatcgtgacacaaaacaagcgacacgggcagtaccggaagagtaggtccaaggcctgctctggaaagggcggagctggcgcacagatagcgtgggcagtgccggaagagcggaatcaaggcctgcgacggaagcgaggagggcactcaggggaggagaaggcatgcggaaagcgggagcactaggcggcgcgaaaccaaacacgcgacactaggcacgggtggtggcgcgggctatgatgcgggattgggtggtgatgagctccggttccaacgtacggctgccatcgatgcggttgatgatgcggctgaccgcggtcggcgcgatccagtcgaggcaggaatccatggtggtcagcggcggctggaaatatgcggcttcctcgttgttgtcgaagccgatcacctgcacccggtcgggcaccgcgatgccgttcgctgccaaagtgaacagtgcgcccaacgcaagctggtcgttgaacgccacgatgccatcgaaggggatgccagagtcgacgatgcgctgcgtcatgcgcgcgcccgagccgatggtccaatcctggccgacgttgggcactagccgtgtgtccaattcgacgccttggtcggcacacgcttcgaatatgcctcgcatgcgcagctgcgcgttgccttccacggcgtcgcgcagctcgaggatatgctccggatcggttcgcgagccgatcaccgcaagattcgtggcaccgtggtcgaacaggtattgcgcggcgagacgcgcctcctggacgtcgtccggggtgacatggtccgccttgccatgcgtggaccgcgcgcccacgcagaccagcggataatccacgtccaggtcctcgggatcgagatcctcgacttcggagatggacaggatcatgccgtccgacaccgtggcattgaagtttcgcaacagcgcgcgggcaccctgcgcggatccttccgcatacgtggtgatgtacacggaatagccgtagatgcgggccgcgtcgatcacccggttggccagttcggccaaatatggcgcggtcaggctcggcaccgcgagcgtgatgaagccggttttgccgcgattgagattgcgggccgacacgttgacgcggtagccgagcctgtcgatgacgtcctgcactttttcgcgtgtggcgtcggccatgcggccggaatggttgatgacgttcgacgcggttttgagggagactccggcctcttgcgccacttcacgcagtgtgacgcgtttcctgtcagacttgtccggcttcacttcggccatatctccccctaaccgcatccgtcatcgatattcgacttccgactttaccgccttaccacgagcacgccgttgcggcgcacggtgtacgagccgggcttttcctcccgatccgtctggaacaggatgaccggctcgccttcgatgccttgcaattcgaccgtcttcttgccacggggcaggtagaagtcgaaggtggcgtcggcggaggcgcgcacggtgtgcagcacgtcggcattctcctgcgacgaggccgcgagatatgcgcggaccagcttcgtcagatcggccacatccaggtcgcagccgacgaaatacgcttcgccggagccgtacggattacgggtgaccgcggccgtgccgtcgagctcccattcgtccgcttcctcgccggcgtacgtggcaagcacctgcgcgtgttcgccggtcacgttcacgtcgttctgccacaggcgggtcgtggtgccgtccagcgcggccgaatcgtcggcggacgacagtcggatctcgcccggctcgccttcggcttcggcgccgaggatgttgaattcctcgccgcggacgcccagcatcgagcgcaacaggccatcgcccgcgcccgggtatccgccgagccaagtgtggaaatgctcgtcgatcagtccggtcgcgtagccgaccaccacgcggccgccggcggccgcgaagtcggccaaccgctgcgtgtcggcggcgctcaggatcagcacggtcggcagcacgacggtcttgtacgagctccagtcgtaggcgagcggcacgatgtcggcgcgcgagcccgcgtccaggaacgcgcggtaccagtcacgcacgtcatgccagtggttgagtttcatgctcggcagggtctgggagcgggtggcccattccgattcggcgctgaagaggatcgccgtgtcggagtgcgccaattcggtgccctgcacgccggcgtcggcgagcgtgtgcaacgacgcgcccagctcgcacacctggcggaacagcttcgtgtcctcgccggcgtgcggaaccatggccgaatggaacgcttcggcaccgaacgcggacgcgcgccactggaagaagttgatggcgtcggcgcccatggccacatgggccagggagtcacgcacggtctcgcccttgcgcttgcgggtgttaagcggcttccactgcaccgccgaggtggagtgttccatgacataccacggcttgccgagcgcgagcgaatccatgagagcgtcggagcaggccagctcgtcgaggtgggattcgccctcgtggaagtagtggtcgttggatacgaagttcacttccttggcccaggcggcgtagtccatgcagcactggtcggtggagaccatgaagttcgtggtgaacggcttgtcggggcagatttcggcgatcgcgtcgcgttcggctttgtagaagtcgaggagcatgtcgttgccgaaccgttcgaagtcgagcttctggccggggttgaccatcgagtcggcgcccatgaaccgtgggatgagcacttcgtcgaagccgttcatctcctggccccagaaggtggtgccccacgcctgattgagcgcgtcgatggtgccgtacttgcggcggcaccatgcgcggaaggcctcgagcgcgttgtcggagtagtcctcgcggttgttccacccgtattcgttgcccatgtgccatgcggtcacatacgggttggtgccgtaccgttcggcgagcttgcggcacagggtcagcgcgtattccttgaacaccgggctggtcgggctccaggattggcgcgagccggcgttgaccggatggccgtacttgtcacgcggaaggacctccgggtggctttcgtacagccacagcggcgcggtcgccgtcgcggaggccaggtcgaccacgatgccggcattgccgagtttgtcgatgatgcggtcgagccagccgaaatcccaacgatcctcggtgggttggatgcgatcccagctgaagatggcgagggccacggtgttgacgccggcctgcttcatcaggcggatgtcgtcgtcccagatgtcctcggaccattggtcgggattgtagtcgccaccgaaggcgatgccgcggccatccgcggtcagcagttccggccattcgaagttgcgtcgcgcactcacgattatctcctttggtaattggcataaagccatggttttttgtatattacattcgttattcgcccaccggcatgtggtacaccggtgtagcatacacgtcggtgacgtcagcgacgcacgcatcggactgctccaggcgggccgccatcgacgatgttaccttcacgcggaccccgcgcctcagcggcgtgacgaccagcgtcagctttccaccagcggcatcgatggcatccgcgtaatcgcgcaatccgacctgccatgtctcgccgttgcagaaattatcggcgatcagcacatcgccgcagaacagccagccgatatcgccctggtatgcgatgttcagcatgacatcggcgacctgccgttgatcgcggaaaagccgtcccatgccagccggcaaagcgatttcgtaccgatcggcgtgcagtcttctcatacgcgcatacaccgatacgggctccaccggccgcggagagccgagcaagccttccggatatgcggcgatcccgttttcggcgcggggcgattccagcgtccacccatcgccgtcctcgtacagcaacgcgttgtcgtcgtcgacgaaggcgaggcctccatccaacaccgtcatccgcccggcgagcgctcgtgtgacgcatacgatctccgccgcgtcccggaccatgaagcgttcgaaatccgccttgccgacggtgacgtcctggatgtcgccttcgaaatggaacgtcagctcatccatgccatcgggcttgaggaacacgaacgtgcggaacggtcggcccggcacccgcagcacggtgaccggctgcaggttggcgcggacgagccgcacgccgtccagatccatgttgaacggcaatatgcagttctccccctcggcgaggccgatgccggtgaaccgtatgcgctcaccggtacccgtcgtcacgtcgatttgctcaccgtgacggctcggcacgcgcgcatggtcctggaagttgtcgatggacacgaaaccccgttcgccatcgctgcgcacggcataccggagggtctcggagtcggacggatcgatgcggtcctgcccgtcctgcaacgagaccggcattccggcgagttccggcccgaaggctttgacgaactcgtgcagggtgcgcagccgccggtaggattcccgcacctgtccgaatttgccaaggggcgcttggaaatcataggagcgtttcggggtctgcccctcattgaggaatccggccgcgcccttcgggttggttccgccatggaacatgtagtagccgaggaaatcgcaccccgagccgagcttgatgttggccatcgcgtcgacggagcgcttcggcagcacgaaacggtaatcgtacgaattgaacatcccgccgcccatctcgcagcaggcgtacgggcggctgtccggatcgtacgggggatcgaagccgtcgcttgtgctggagccatgcagcctccggtatcggtactcgtcggtggcgggatgctccgtcatcccctcggcaccgacgccgtcgtagaacagccacggccggtacgcgtatccaccccacagcggcagcatgtcgtccggaaccggtgactgccagccggtgcaggtgaacatcggcgggtcgatgccttcctcgatcgcgatgtcgcgcagccgttccaggtagccggccccatcgtggccggacggcacccattcacggctgatgccggtggtcatctcccaaggagccgacgacgccatgtactcgttgtcgacctgggccgcgatgatcggcccgccatccttgaaatacaggccgcgcagctgctgcgcgatatgcgcgcagagaccgcgcaccgcatcgaggaagccggcgtcgagggaacggacctcatacgacttgccgtacagccagtcgggaagtccgccgttgcgcacctcgccatggcagaacggtcccagccgcacgatgacgtgcagtccgtgccgggcgcacaattccacgaatcggcgcacgttcctgttgccggagaaatcccactccccctcgcgctcctcatggtggttccagaacacgtaggtggatacgacgtcgatgcccgccgcggccatcttcgcgagttccgtgtcccaccgttcggcggcgatccgcgaatagtgcatctcgccggcgatggggatccatggcgatccgtcacgggtcaggaagcggttcgtggcgcccagggtcccgccatccggcccgcatgcggctgcggcgcggatgacggggatcccgtatgcgggcgtccgcgcgaacttgctggcttccgaaagatcaacctcatagcgcataacgctgctccttgtcgaattcccgcaagcaggaggaccggtcagcccttgaccgaaccggcgaccaggccggccacgatccaacgctggcagaagatgaagaacacgaacaccgggatgagcgcgatggtggtgaccgtcatgaacaacggccagttcgtcgtgaaggtgctgatcgcgttgaacacctgcagcacgatggtctgtttgttggtcgacgagatgtacacgctcggcgtcatgaagtcgttccacgtgcccatggtctggaacacgatgacggtggtcaggatcgggcggatcagcggcagcacgatcgtccagaagatgcggaacggaccggcgccgtcgatacgggcggcctcgatgatctcatacggcaggccgcgcatgtactgcacgatcaagaagtagcagaaggtcgcgccgcccgtgtaaagcacgatcaggccgagcagcgaatcgacgagacccacctgtgcctccatgcggtactgcggaatcagcagcgtctggccggggatgatgaaggacagcatgagcagcacgccgatcacggcggtgaacttgctcttcttcaggatcatgccgtatgcggcgagcgcgccgaacagcacctgcaggccgacgccgaccaccgtcacgatgatggtgttcttgaaggcgttgacaatgggcagatgcccgaatgcatacgtgtagttctcgaaattccatgtctttggtaacccaatcgggtccatggacatctcggcgctgcttttgaacgtgttgatgacgatgacgtacagcggcaccgcgcagatcagcgcgatagcgatgacgacgacggaacggatgatcgagccgatacgctcgcgttgctgcagagtcatgacagcctcttttctaccagattggtgattacctgctgcagggcgaccaacagcgcgcagcagatgaagaagatgacgcccagtgcggagcccagtccgtaccggctcgaaccgatgcccgtgaggatgatggactgggtcacggtgtaggtggagtagcccggaccgccgctggtgaggccatacggcagatcatagaccttcaaaccaccggtaagcagcatgaagatgctcacacccatggccggaaccatctggggcagtgtgatgttgaagaactgctggcgacggtttgcgccatcgacggcggcctgttcgtagatatcggcggggatagcctgcagatacgccagatacagcgtggcgtgccagccgatctgagcccataccgctacgaaaatcacacagaatttggcaagttcggaattcgacaaccacggaatcgcatcgatgccgatcttggcgagcagcgtgttgacgacgccggacttcagcggggagaagatgtactgccagaccaagccgagcacggccatggacggcaccgagaagaagaagaacagggaacgggcgaagttacggccgaagaacttgcggttgagcaccacagccagcggcagggcgatcacggtgatgagcacggtggtggccaccgtgtacagcagcgtgaagccgaggcccgcgagcagcgtcggatccttgaagcactgcacgtagttcgcgaaccccacgaacttcgcgtccgcgaaattgtaaccggagtaatcggtgaagctgaacaccaggctttgcaggaatgggatgaggatcaccacgatgaacaccaccatgatcggcagcaggaagcgtgccgaggcgaagttctccatgaagttgcggtgacgacgctgcttgagatgcaacgcctctacctgatcagcggaatgtggacgcgccgctgacgctgttgatactgacatgttggttgctttctacaaaacgtgagattggcaggtccaggcgtggcgcggacggaagggtccgcgccagcctgccgcgatggatgtctgttcgcgatggatcaggagagggtcttgagcttggaatcgaggttctccgcggcctgcgtagggctgatggagccgagggctacctgctgcagctgggtgaaggtctcggcgcgcagcgcggtggtgcccttgctccagtgggcggaattcaggtacacgttgccggtcttgatgtacaggtcgtaggcgtccttgaagtggtcgtccaccgtggcgttgaagcccttgacggacgggatcaggcccagctgcttctggtacagcttgaggccctcgtcggaggtcaggaaggtgaagaacttctccgcggccttgagcttgtctccggagatcttgttgttgatgccgaaggccggatcgatggagcccggcgcgtacggggtgtcacccttcttcagcatagggatctggccgaaaccgtagttgaggccggtctcattgaagctgtcgatgtcccacgagccggaaggatagaccgcaagacgtccggcggtgaattccgacttgacctggtcgccgctcaggccggacacgtcggagctcatcaggttctgcttgatcagcttgtcccattcgccgtagtacttgccatacacgttcttgaacgtgtccttaccggcgtcgatcttggcgtcgagcgcctcgccctgcttggcggattcagcgccgatccagccctcgacggcgttgcccagtccatccttcggctcaaggtatggggtgattcccgcggctttgagtttgccgcacatggtcaggaattcatcccacgtcgccgggatggagtcgtaaccgaccttcttcagcagatccttgttgtacacccaggcattggtccaggtgctcacgcccatggcgtatactttgccatccacgctataggccttttttgcggcatcgccgattttatccatgaagctttcattgctcaggtccttggcgtagttgcctttgaccagatcgctcaacgcctccggaggaacgatgtagacgtcggccaggtttccgccggagattcgagtctgcagcgtctgctggtagccactctgggaaccggtggtggtgctgtagtcgatcttgatgtccgaattggccttttcgaacgcgtcgatgatcggctggtacttgtcctgcgaattgttcgagaagaacgacagcgtggtcttgccgtcggcggcgtttcctccaccgcacgcggccagcggaacaagcatcgccgcagcggccaccgccgcaatcatcctgatggatttcttctccatgatgtactcctccttgtgtcccatcgttggcacccgctttacgtgcgttcattcgtcgaacccactccagctgcggtagatacacgtcaatatgtcttcaactgaccattcagttgattcgggatatttccttccctttttggtataactgtgtacctgttgaaacagtataggttttccggtgtaccatgtcaattcaaacaaggaaatttgcatcccatcgaccgctacccctacaaaacatcggcgtgtcgtataccggcagcaccgtcgacagcggacgacgacccgcccgcaccatccggagacgcgcagcccgaaagcgtattgcgagtgggcaggacgcatgtggacaagtcggtgtattacgggggattatttttccgatgaattccccagtattagttgggattgaaaagatgctgaaagtccacagataaaaaatcggcggctccaaggaaatatccttggaagccgccgatatgcttgcgtgcgtcgcgctacgggctcaagcgagtacacagcgtgctacgcagaccgtgagcaacacagaccgcgcgctacacagaatcgcaagctacaaactcaggaacagctcgtggatgcgggtgtcgtcggtgagctcgggatggaacgccgtggcgaggatcttgccttggcgcaagccgaccacattgccgtccaccgacgtttcgacggtggcggccggtccgacttcggccacgaacggcccgcggatgaacaccagcgggaaatctttgagcacgatgtcggccggggcgtcctgcggaacatgctcgcccggtgcgaccacgacggcggaatcaccggaagaggagccgaaatcggcggtggcggcgaacgagccaagctggcggccgtatgcgttgcgccgcacgacggcgtcaagcgcgccgaagtagacgttgtcgtcgttatcgagcttgcgggccagcagaatcatgccggcgcaggtaccgaacaccggtttgccggcggcgatatgctctgcaatcggctcgaacaggccggtggagcgcagcagcttgccctgcgtggtgctctcgccgccgggcagaatcacccggtcgatcgaatcgtcgaaatcctcggccgcgcgcagcagcttccacggcgcgccgaggtgatccagcatggcggcgtgctcggcgaacgcgccctgcacggcgaggatgccggtcacgccatgtttcgcggcttcgacgccggccgattcttccttcgaaatgtattcaactgctacaaccattaccgttcctgtgctttcggatatgccggctccgcggtgcttctcgctgcccgcggagccggcgtcacgcatgcgccgtgcgggccgtcactcgccgcgggcggccatgatggtttcgatctcatcttcgttgatgccgaccatggcctcaccgagattctcggaaagacgtgcaagcagctcggcgtcctgccaattggcggtagcctgcacgatggcggcggcacgcttagccgggtctccggacttgaagatgccggaaccgacgaacacgccttcggcacccagctccatcatgagcgcggcatcggccggagtggccacgccaccggctgcgaagttgacgaccggcagacggccattgtcgtgcacgtacttggcgagatcgtacggcacggccagctgcttggcggcctcgtacacctcgtcgtcgcgcagggagacgagttcgcggatctgcttgttcatggtgcgcatgtgacgcacggcctggatgacgtcgccggtgcccggctcgcccttggtgcggatcatggacgcgccctcggcgacacggcgcagcgcttcgcccaggttcttcgcgccgcacacgaacggcacgtcgaaccggttcttgtcgatgtggtacacgtcgtcggcggggctgagtacttcggattcgtcgatgtaatcgatttcgatggcctgcagaatgcgggcttcggcgatgtggccgatacgaaccttggccatgaccggaatagacacggcttcctgaatgcccttgatcatggccggatcgctcatgcgggaaactccgccggcagcacgaatatcggccggaatgcgttcgagcgccatcaccgcgcatgcgcccgcgtcctgtgcgatcttcgcctgctccggagtggtgacgtccatgattacgccacccttgagcatctgtgccagattcttgttcagttcgttcctgttgttggccatcgccagcctttcgtcgaaaataatcgtttgctatcgatactaacgatttcccatttcgatttcacgcgaactgaatcttataacctaccaaaaagtcggttttgctaaatttgcaaccttattttcatgattgtttcattggcttatgatttcgattccgtcgacatttcatcggtttcgtccgtttttcttgctttacctgcgaccatggctttcgattcgtccgcttccgtacgccgtcgcgcgcgctataggaaacacgaatgacatgcgattttcatacgaccacattgcggacgtgcgacgcgtccgtatgcggccgcatgggcatgggcacctcaccaggccccgcattacgccgattcacacactagttcgcacgcatcggctcgccgcatcagttcgcaatccgcacgcgccagctcacatgcgcacgatgcggtccgcgatgcgcatggtggaatcgcggtgcgagacgagcagcaccgcgctcccctgctgcgccaacgcgtcaatcgattgcagaatcacggattcgttgtaggcgtcgaggcgactcgtcggctcgtcgaacaacaccagcgacgcgttgcgcaggaagacgcgagccaggccgatgcgttgccgttcaccctctgaaagccgcccgcccaactcgccgacgggggtatcaaggccctgcgggagcgagtcgaccagttcaagcgcggaagccttggcaagcgcggcgcgcagcacgtcatcaccgacagaaggggtcgaccgggtggaaagcgcggaatcagcggcattccacgaaacgggaggagcgggcggggtaaggagcgctctgccggaagttgcggaatcgtccgaatcgccagcattaccagccctatccgcatcgcccctgtcgcaggccataagcaggttttcacggatagtgccgtcgaacaggtaggtttcctgccccatcatcgtttgcacgcgacggcgatgatgcgcgtcgatctgcggcagtggcacctcggacagggcgactaagccggattgcgggtcccagtaacgcatgagcagcttcagcagggtcgatttgccgcggccggacgggccttggatgccgaggatgccgtgttgtggtatgtcgaacgagacgtggctgaggattggctcggcggacgactcgggggcatccgcatcgcttccggaagttggagcctcgcccgaattgccgtagccgaacgtgacgtcgtgcatggacatgccgtggtagcgcggcaggaaatcgccccgctcctccactgcgggggtttcgtccatcagcgcgaacaggcggcgggcggctgcaaacgtttgcgtgagattggccggcagcgcgctcaacgcgagcgtcggaccgaacgagctggccagcagcacgaaagcggcggtcaggcgggcggcgggcgcggaaaggacggtctgaatggttgcggcggcagcggaagcggcggaagcgatgggcatcgtcgtaccggacgtgaccatcgccagcaatgccgcgatggcagtgaacagtacgaccagcaccgcgccgaagcctgcgaaatcgccattcttggcactcagccgggcacggcggctccagagcgagcgcgtgcgtgacgcgatgccggcaagccgcgcatggccttggccgaatcggatgatttcgtcgagaccgcgcatatcgtcgagcatttcgtcatcaagttgggcggattcgcggcgaatatccccaccgagaccgcctaccgccgtggcgaagagtttcggcagcacgatgccgacggtcaggtgcgcgatgaccagcgtgacagcgatcgcagggctcaacgtaagcaatgcgaccgtgtaaagcacggtggtcgcgatggcgatgacaaccggcgaaatggtgtgcgcaaagaagatttccagcagttcgacgtcggtggtgaccagcgcgatcaggtcgcctttgcctttgccggacagtttggcgggcgcgaggcgacgcagcgcggcaaacgttttcgaccgaaacagcgcgagcaggcggaaggcgacattgtggttcatgtactgttcggcgtagcgcatgccgccgcggatcagtgcgcagataatcatggctgcgattgccgcgggaaggctgagattccagacttttgcgccagctgcggcaaacagcgcggcgacgccgaaaaccggcaggaacgtggcggcgaggtggccgaggatgccgcacgcgcaggcgatggccatgggtttgcgcagtgggccgacttcgcgcagcaagcgggcgacgacttgggttgttggcatgtccgatttgacgccactggcgttcgattcggcggaaccagacatccgagacacggcaaacgcaccagacgcatgagtcatacgcgatacgcgcggcgcgacgcgaccagacaatcccacccgttccacgctttcctgcgcccggaacagcttggcatacgtgccgtccgcggccatgagatcgtcatgcgcgccctgctcgacgacgacacccccatcaaacactacgacatggtccgcgtcggccgcgttcgccatgcggtgcgtggccatcagcacggttgcgccggcgtcggcgagcgcgcgaatcgtttgcaaaatcaacgtttcgctgtccgcgtcgacgctgctggtcgcctcgtcgaaaatatagacggccgacctgcgcaacagtacacgggcgatcgcaatgcgctgtttctgcccgccggacagattcgcgccgtcctgcgtgatcggcatatcgagtcctcgcgattgcgcgcgcacgaaatcgtcgatatgcgcggcttccagcgtctgccacagctcgttgtcggtggcgtcggcgcgggccatgagcaggttgtcgcgcagggtgccggcgaacaggtggctgtgcgcggagacgatggagatttcgcgggtgagcgatgctgcggtgaggtcgcggatttggtgcgatttcagggtttcactgtcatccggcgccgcactgcttaacatagcgcccagcacttcgtcctgcattccggatggcatttcggacagcagcacatcgccttcatatccgacaagcgtgccggcaagcagctggacggctgtggatttcccggaaccggatggcccgacgatcgcagtgacttcgccgggcagcgcacagagggccacgttgcgcaaggcgtagcgcgtttcgcgcgcgtcacccgcgccgccgccctcatcaacgctgtccgcatccgcgttccgcatatcggaatgcgatgtggacgatatacgacggggactcgcaacaccggcacccgcagacccggcagcgtcaggccccgcaccagcagcacccccagcatccacatccgcgtccgcataccggtacgaaacaccacgaaactccacgccgacaccacgcccggaagccccgaattccggcagttccttgctgccatgctccggttcgggcacgtcgagcagcgcgaaaatacgtttcgtggacgtcatgccgttcatcgcaacgtggaaatacgagccgagctgtcgcagcggaatgaagaaatcggcggctagcagaatcgtcagcaataccgcggcgatcggcgtcaaaccaagcggcagcacgccggacagcgcgaaaacgccagacggcgagagcgagccggatacaaatcgccatatcgcaacgccgatgccggcggccgcgccaccgtacgccacggcatccatcgccgtgagcgaacgcagttggatctgcagcacgttcatggtcatcacgcggaactgttcggccttctcgtccatgactcgtgcggcgcgctcgtccgcgtcgaaggttttcagcgtctcaagtccctgcagattgtcgaggaacgcggcgcccatatccgtgtatttgccccagtatttcttgaatacgcgggcagcacgcatcgccaccatgccgacgatgagcacgatgagcggcgcgcaggcgagcagcgtcgcggcggtgggcaggtcgatcggcgcaagcacggcgaacagcgtgatgggggcaagcacggcgtagcacagttgcggcaggaacagttcgaagaagctttggatttgttcaatgccttcgcccgcggactgcaccacgccggcggtgcgcacgcgctgcgcgtaggacgggccgagcgcgagcatcttattgaacagtttctcacgcagcgcgagtttgacgcgttcggcggcctcgctaccgaaacgtgcggcggcgcgaatggtgacgaatcgcacgaccgcggcaataagaataatggcgatgcagggcgcggtggcggacggtacgggcgcgaacagcggttgcagcatacgcaccacagccacgacgaaggcgatgttggccacgaggcccagccattggcaggcgactttcgccgcgatcaatcgaccgacgccgtcagccaaggaaaacagccgcttgtcgaacatcatgccccttttccaatcgtttgcaatcccgccatccgctccaagcgtatcgggcataccgacgaaaggcaatgacggaacggcaatcgcagaaaatcgtcggaaaaatctagaaaaccatcagaactcgcaagcaaatgcacaacagcaaaaccacagaaaaccaagggaacggcgaaaagtgaggcggctgaatgttcgccgttgagcaaacagcctaggcgcaaggggtagttgcgccaaacttgagtgtacacggaacatgttgtggttcgcaacgtcactccgcccagttttgccgcattttccaccgttttcgcccgtaagggcaaccccctctcgaacccgtcgcgcaacccgttggacaccctgcgatcgaacgcgtcaaacctttttttcgagatgacgcatccgtgcaccaatcccccgttccattgacgtttcgtgccactttgtcagttcaaacaaacccgtcgccatatttcttgttgtttcttacaatgcggacttacgtcaccgtaacttacgatatgcgaggcgcgacacaggacgcgaaaagcacgtcatcgatcaccgcaatcgcagcgatcgcatatatcgcaaaacccacgaaaaccgcggaaacgcaagaaaagagaacacttcatgctcaccgagtacacgaccccgggcgcatccgtcgaagtacgcgacgacgaatccatctactccctgcttaccgaacgcatcaagcgcaccggcgaagacaccgtgatcgcggaacgcaaaaccgctccgggccagtggaccaaggtgacgaccggcgaattccacaagaacgtgctctccgcggccaaaggcctgatcgcgttcggcatcggcaagggggatgccgtcaccctcttctccaccacccgttacgagtggggcgtgcttgatttcgcactggccgcaatcggcgcggtcaatgtgccgatctatgacaccgattccgcggctcaggccgaacgcattctcaacgattccaacgtgaagctcgccatcgccgacgatcgcgaacgcttcgaccgtcttgattccgtgattggccgctgcccgtctctgaagcatattctgatgctcgacgccaatgccatgggcgcgctggagggattgggcgtcaccgtgtccgacgaagagctggacgagcgtatcgcgtcggtgcgtgccgacgatctggccaccatcgtgtacacgtccggttccacgggggcaccgaagggtgccgagctgtcgcatcgcaatttcgtgtcgatcacgcgtgccggcagccttgcgctgcacgagatgattcttgaagaccatccgcgtctgctgctgttcctgccgctcgcccactgcttcgcgcgcttcatccagtacgcgtcgatcgcttccgatgacggcgtggtcggctatctgccggacaccaagacgctgctgccggatgtgcgttcgttcgagccgacgtacctgctgggcgtgccgcgcgtgttcgagaaggtgtacaacgcggcttcccgcaaggccggcatgggttggaagggccgcctgttcctcaaggccgccgagtccgcgcgcgactggtcgcgcatgcagcaggctggcgagaaaccgaccatgaagcagaccgccgaacacctgtcgtatgaggcgtccgtataccacaccgtgcgtggcgcgttgggcccgcgtatccgttatgtggcgtgcggtggcgctccgctggacgcgtcgctggcgcatttcttcaatggcatcggcctgccgatgatccagggctacggtatgacggaaaccgcggcgccgtttgccgcgacccgcgtcacggacaatgtgatcggtaccgtcggccagcctgcgccgggatcgtccgtgcgtatttccgacgatggcgagctgcaggtcaagggaccgaacgtgttcatgggttaccacaatctgccggagaaaacggccgaggtgttcaccgaggacggttggctgcgcaccggcgatcttgcgtcgatcgacgatgagggtcgtattacgattacgggccgcaagaaggacatcatcatcaccgccggcggcaagaacgtgtcgccgattccgatggagcaggagattgcgaagtgtccgattgtggagcatgccgtggtggtgggcgataatcgtccgttcatcggcgcgctggtcacgcttgatccggaaggattggcggcctggctgccgtccgtgggcctgtccgcggatacgccgcttgaccgcgtggcggctaccgccgccgttcatgacgagattcagaagtatgtggacaaggcgaacgcgacggtttcgcgcgccgaatccgtgcgtaagttcgtggtgctggatgcgcagttcacacaggagaacaagtgcctgacgccgtcgctgaaggtggtgcgtccggcagtgaaccgcgtgttcgccgacgtgatcgaccgccagctgtacgccggcaagcgctgagccgcacataggtaaacaaaaacagcacggcggggaacgctgcgtacaaaagtacgtcaacttccccgccgtgctgttttttaagcgcaccccgtatcgctgagataacgcgtgcggtaacagtgcggcaggaaacgccggcgtacgaaggtacgtcaagtttcctgccgtgctgttaacgctccgttatttcagtgacggttgttgaggcggtggtacatttcgctcagctccagctccttctcgaactggcgggcgttggtgttctcgtcgatgacggcgagttcgacgccggcgatgcgggcgaagtcctcccaagcctcacgaccgacggacgtggtcatgcaggtgtggtgggagccaccggcggtgatccagcactgcacggcggtcttcaggtccggcttcggcttccacacggcgcgggcgcacggcaggttcttcagggagccctgcggttcgacgatggtgacctcgtccatgagcaggcggaagcgttcgcgctcgtcggccatggagaccacgacggcgtcggccggcttgccggagaacaccagacggaccgggtcggacttgccgccgatgcccagcgggtagatggccagcttcggcttggcgatggtgccgatggacggggagacttccagcatgtgggagcccatgtcgaactcgttgcccggcacgaagttgtaggagtagtcctccatcagggaggcgccaccctcaaggccgtagcccatcacggcgccgatgcgcaccagcacggaggtcttccaatcgccttcggcggagaagccccagccgtactcggacgggaagcgctgcgggccgacgcccggcagctgcggcagggtgccgaggtcttcgaagttgtcgacgccggcggtgcaaccgttctcacgcatcatgttgaccatggcggcctcttccttggctgcgatgaacagctcatcgtagcgggaatcaagcagctcgggggccacgtcatacttggccttgtagtcttcgatgaggtccttgacctggctgtccttgaccttctcgtaggcggcgacgaggtcgttgacggcccaggtgttgatcgaagcgccgaacacgcgctcggcttcggtcttgtcgccttcggtgacggccacgttgcgcatgttgtcgccccaacgcatgaccttcatgttctgggaggcatcccagccggcgcaggcgcgagcccaggtgccgaccttttcggcgacttccggatcggtgtagtggccgacgacgatcttgcgcggaatgccgagacgggacacgatgtagccgaactcacggtcgccgtgggcggcctggttcaggttcatgaagtccatgtcgatggtctcccacgggatttccttgtggtgctgggtggccagctgcagcagcggcttggtcagcacttcgaggccgcggatccacatcttggccggggagaaggtgtggcaccaggtgatcacgccgatgacgttcgggttggcggaggcttcggtcatgaaggccttgacgccgtcggaggacttcagggtcggcttgagcacgatcttggccgggatcttgccggtcgcgttgaggaagtcgaccatctcgccggtctgctgggccacctggcgcagcgcctcctcgccgtagaggtcctgcgatccgacgccgaaccagatttccttgccttcaaatgggttttccattgccatgttggattattccttacttcgttgttgggtttgtcgtttcagtttccgtcgcgtcagtgctggccgtagacgttggtgtagcggtcgttaaggctatcgatgtcttcctgggagatcgggatgatgtctccgagctgcttggcggcccacatggtgtgcgccacctcttcggtcatggcggcagccttgacggcggcttccgcgtccttgccgatggtgaacggaccatggttctgcatgagcacggccggggacttcggatacttcttcagggtttcgaccacgccttcgccgatggcttcggagccgatgaggcggaacgggccgaccggcaccgggccgccgaactcgtcgcccatcatggtcaggccgcacggaatgttctggccggtggccgcccatgcggtggcgtaggtggagtgggtatgcaccacgccgtacacgtcgggcatgtggcggtagatgtacgcgtgggacgcggtgtcggagctcggcgcttcggcgccgtcgaccacgttgccgtcgaggtcgcacacgaccatcgagcttggggtgaggtactcgtagcgcagtccggacggcttgatgaccatcaggtcggcggtgtgcaggcgctgcgagacgttgcctgcggtccacaccaccagattccacttgatgagctgctcgtgcagggtggcgaccacttcgcgcacctgcttgacttcagctcgtacttccgggccgtaatcagccaacgttgccatattgtgttcctttcgtcaggcttgctgttgttacgatggacggttatttggtttccagcgggatgctttcgatggcggcatgctcgatcggcagccccttgcggaagcggtcgaagaaggcttcgaagccggccacgtcgttggcgtccggcgcttccgtggtggaggccgcgtcggcgaagacgcgggtgtcgaggtagtcggcgagcggctggtcggcgtgccacagatagtcggcgagcacggccatgccccacgctccgccttcggcggcggtggccatgaccttgatcggggtgtcgaatgcggcggcgaggatcttctgcgcgaccttcggcgtggtgaagatgccaccgtggccgacgagcgagtcgacggcgacgccttcgtccttggtcatcacatccatgccgatcttgaccggcgagaaggcgctgaacagctgggttctcatgaagttgccgaggctcatgcgcgcctccgggctgcgggcgaacagcggtcggccttccggcaggccagccaggaattcgccggagcggaacggatagttgagcagaccaccgcagtcggcgtcgacatcgtccgcgatcgcggcgcggaacagcgtgccgtacagcgtgccggcatcgaccggctggccgatcgcggcggcgaactgtccgaacaggccgacccaggcgttgagatcggaagtgaagttgttggcgtggctcatgccggccaggtcgccggctggggtggtgacgaggtcgacttccggatgcaggcgcgccagcttgtgctcgagcacgaccatggcgaaaatcgaagtgccggcggagacgttgccggtgcgcacgcgcacggagttggtggcgaccatgccggtgcccgcgtcgccttccggcggggcgaggacgacgcccggctgaagggtgccggtcgggtcgagcagtttggcgccttcggcggtgagcgtgccggccggggtgcccgccacgagcggacggggcagcaggttctcaagcttccacggctgcgcggcgacttcctcgatcgcgtcgaatcgcttgatgaactcggtttcgtaggtatgggtggccgggtcgatggggaacatgccggaggcgtcgcccacgccgagcaccttctcgccggtgagcttccagtgcacgtagccggcgagtgtggtgatgtagtccaccttggagacgtgctcctcgtggttgagcactgcctggtagaggtgtgccacggaccagcgttccggaatgttgtactggaacagctcggaaagcttctcgtgggcttcgtgggtgttggtgttctgccaggtgcggaacggcacgagcagttcgccggacttgtcgaaggcgaggtagccgtgcatcatggcggagaagccgatgtgccccacgtgggtcaaccgttcgccataggcggtttcgacgtcgccggccatgcgggcgtatgcggtctgcaaacccttccagatttcctcctgggtgtagctccacagcccgtcctcgagatggctggcccactcatagtcgcccgccgcgatggtgtggtaggcgtcatcgatgagcaccgccttgatgcgggtggagccgaactcgatgcccaggctcgtcttgcctgcgcggatcttctcggcggtcactgcgacctgctcttgcgtcatagttcacgaactccttgcgtccgagcgcctcgcaaccactctgtcaactgaatgttagcgctcactgttaacgctcactattgtaggcaaaaacccgtgacgcaccaaatccgacgtgtcatcggagcaatgaatatataaacaaatcgagaagaagcagcgccttagcgacggcggacaggacccagggagctgcggttgaccatctgcgccgacaccagtccgacgccatgctgcgatgatccgaaggagttctcctcccccgcgcctagcaggtacagcgtctcgcgcatggcggcgacacccagctgctcaaagccggggcggaccgtggtcagcggcgggaacatattgtccatggcaggcatgtcgtcgaaacccaccaggctcacatcctgcggaatgcgcacgccatgctcatgcagcgcgcgggccacacccacggcctggctgtcgttggcgcagaccatgcatgtcggcagattgccgccggtgcggccgatgttgtcgaggatgtggttcatcttgccgtacgcttcagaggattcccaggtctcacactgcaccgtcacggaattgaccgcattggccgcgcatagcttgttccatgccagcaggcgcgtcgccgcgtcgcgccactccttgggaccggcgaaatacagcaccgaacggtgcccgtattccacgactagatgcatcacgtcggccatcgcggaccattggtccatgccgacgacggatacgcggcggcggtcggcggacttcatcagccgcaggccgtcctgcacgtcgatgccaccgtgcgtggatgtgacgatcacacgaggctgcgcgatccgcgtccggcatgccgcggaaaacatgacatcggtgggcgtgaggaagatgaacgcatcgacgttcatctcgtcgaaggtgcggcacaggtcgtcgaattcctcctgcgagcacagcgcctcatgcaccatgctcaccgtcacgaacaggccatgctggcgagccatcgtctcaatcgcggaaatcgtggaaatcgggccatagaaatgctggccgccggcgatcaggccgatggtgcgggaccggtgcgaggcgagcgcgcgggcggagttgctgggacggtatccgagctggtcgatggccttctgcaccttctcgcgggtggcgtcggagacgtccggcgaatggttgatgacgcgcgagaccgtctggtggctcacaccagccagcttcgccacttcgaacatcgaaggacgcttattgcccgcatcgcgtttgcctgccatgccccgtcgcctttcgcacacaactgttggtacgttcgcctattgtacacgcaacttcagttagcgctaacaaccctcatgctccaaggatgcggcacactgcgcgcaggctaccgcacggccgccaaagcacgcagacgcgccgcgaagttgggccaatcggtgcgcatggcggtcagcagcttgcggttgggcacgtcatcgaccggcacccattcaatctccatgctttcgtcgtcgttggccttgggttcgatgcggtgccccggcttttcgaaggcgaacaccgtggtatacgaccatgggccgtggtcctcgcagtacgatccgaccacgtcgatgtcctccggcgtgatgttggcttcctcgtacgattcacgcaacgcgccctcgatcgggctttcgccgtcggcggtggcaccgccgggaatgccccacgtgccgccttccgcgctccataccgcgcggtgctgcatgacgacgtgcgtcacctcaccggtcgtctcgctgcggcgggccaagagcacgccggacgcgccgttcgtaccccaatgcttgcgaccgcaggcgcaatcgacccagccgtctcccggctggtgcacgttctccttgggcggcagcggcttcgcggcacccgttttcgcatcatattcggcgtccggcgcaaggtcggagcgggtgacgttccacaggtcggtccattcgacgcccaattgcgccgccagacggcgcgccaacggcaggctcaggccgatgatgccgtgcggatcgccttcgatcgagtcgatgaacgcgccgccgaaaccttccaaagtgaacgatccggccacttccagcggctcgccggtggcgatgtagcgttcgatatccaggtcggaatattcgcagaagtgcagggtcgctttgctggcgccgcgcaccatgcggcccgacgcgaagtcgatgaggcaatggccggtccacagctcgccggtggcaccgcgcatggcacgcagccgttcgcgcgctacctcttcgctatgcggcttgccgtagcattcgccgtccagcaggaacatggaatcgcagccgagaatcagcgggccggccttcgaacgggtcaggcttggacggccatccacgaaatcggcgatcggctcggcgacggtgggaatggcgatgccggagaaatcgcgggtcttcgtctcgtcggcggactgcgcgctgtccgtgcgtgcggctgtgcccgccgaggatgcgtcgcgatcgtctgctgcccggagcgggaagccgaccacgcgctccccgcgcgcgtgcgccgcggtatcggcgatgttgcgatacgcctggtgcacggcctcggccttcgccgtggcgagaatcatcacacgctgttcgacgctcaggtcgttcacggtgacgccaagcgcggccgcctcgcgttcaagcgcggcaggctcgtcgacgtgcgagacacggatggtcgggcagatgccggcggagaacagcacgtcacggcgtggacgggactgggaggcgagaatcagcgggatgctcatgcgcgttccacctgcacacccttggtgtcgaccgcgagatgcagcacacgccaatggccggatgccagctcttcggcggcgatctgttcaagctcctcgtgggcgtcgccatggtgcagcacaagcacgcatgggccagcgccggacacggtggaggcgaagccgtgggagcgcatcttctcgatcagcgcccaagacggctccatcagcgaggcgcggtacggctgatgcaggcggtcctgcgtggccgcgaacagcagtgcgttggcgttctgacgcgagccggaggccagcatcgcggggttcatggcggccggcagcaggctcacacgggagacgttgtgcacggcgtccttgaacggaatctcagtcggcaacgcctgacgggccttttcggtggacagctcgtagtccggcacgaacacggccgcggtcagatcgtccgccacacggtaattgatggtgtggaagccgttgtgcatcggctcgccgcctggaatcggcacggatccgacaccttccgcggtctccatgtcccaagacatggtcaggccgccgtacacggccggggccacgttgtccggatggccttcgatggcggcggccagctcgaacacggcgtcgcgattgaggtcgtcgtcctgcgcgaaggcggccgcggcggcgatgccggcgacgatggcctcggcggaggagcccatgcctcgcgcctgagggatgttgttgtgcgcctgcaggatgaatccgacgcgtcccagaccgaaggtctggcatgcgcggcggaacgtggagaccaccaggtgcgtctcgtcacgaggcaaggtgtcctcgccctcgccttcgatcatcacctgcgccgcggtgttcaccgggtcggcgctcagcgtgaattcaagctcgtcatggtaatccaaagccaaaccgaccgtatcgaaaccggagccaagattggcgctggtggccggaaccttcacacgcaccttgcgggtaactggagtcatctctcgtcgtccttcgtcacatcttcattacaaatcaagcaccgtataccgtggcagtgccagagtcaaatttcagggggaaccgcacccgtgcatcgtattcgggcccatgacggcggcttggcatggcttgcatgccaatcgcatcatgggcccgaatcgcatccgatatcagttcagcacgcgcaggatcgacggctctccgcacacgcaatccagctcgcacacgtccttgacggtttcgcgcagagtgagctcatcggtcatgtgggtgaccagacgcagctgctgcagctcgccgtcatagcccggatccttcagcgtcggcttcagatcctggttcacgccgttgatggacacgccatggtcggcgaacttggctgcaatcgcggcgagcacgcccggattgtcgtgaatcacgaaacggaccgcgaactcggccttggaagcctcgatcggagccttcttcagatccttgtacagcgggatggacggaccggtgcagccctgtgcgatatggcgggcttcggtgaccacgtcgccgacgaccgcggaagcggtcggagcgccgccggcgccgcggccgtagaacatgaggtcgtccgcagcttcggccttgacgaacacggcgttgaaggaaccgtgcacggaggccagcggatgggtgttggagatcagtgccgggtagacgcgcgcggacacgccggcatcggtgttctccacgacggcgagcagcttgatcaccttgttttccgcggtggcggcggcgatgtcgtcggcggtgatcttggtgatgccttcgacggagacgtcgtcgatggtgacggaggtgtggaagccgagggtggccatgatggcggccttgttggccgcgtcgtaaccctcgatgtcgccggtcggatcggcttcggcgtaacccttggcctgcgcgtccttgagcacgtcaccgaagtcgaggcccttggtggtcatctcgtcgaggatgtagttggtggtgccgttgacgatgccgagcatgctcgtcaccttgtctccgacgagggattcgcgcagcggcttgaggaacgggatggcgccgcccacggaggcttcgaagtagatgtcgacgcccttggcttcggcggccgcgtagatctccggaccatacttggccagcagcgccttgttggcggtgaccacggaagcgccggattcgatggcggcgagcacgaacttgcgtgccacgccggtgccgccgatcagctcgatgacgatgtcggaattggtggccacgctcatggtgtcggtggtcacgatggccttgtcgatccacgggaacggatcggtttccgccgggtcaaggcaggcgacgccggtcagctcgatcggtcgtccgatacgtgcggcaagctcgtccttctgctcgaccagcaggcgtgcggtctgggaaccaacggtacctgcgcccagcaatccaacgcgaatcggcgcaacatcttcctgtgccaaggcatcctcccttgaatgtgaagtattggtgtgaccttgcttattgtacggtctcaatatgacgtaaggccgcggaatatcaagaaaatggacggtttccgaagctttccccgcaaggaagcccgaaaaccgtccataccgtgagacgcaatcgtggactattcgctgacgtcccagctcagcagatcgtcgatcgtctgccggcggatcatgacgtgtgcgccggcctcgccgacgccgaccacggcgggaatcagcgcctggttgtagttgctggccatcgtgcggccgtatgcgccggtgaccggcaccgcgaggatgtcgccacgcttgatgtcggcgggcagccgcacctcgttgacgacgatatctcccgattcgcagtgcatgccgaccacgcggcacagcttggtctgctcgcttcccttgcggttggccagacgcgcggtgtagtcggagccgtacagcgccggacgaatgttgtcgctcatgccgccatccacggacacgtacacacgttccgtcaccggattgcctgacttgtctttcgcctcgccggaaagctcgaccggcttgacggtgcccacgcggtacagcgtgacgccggtgggggccaccgtccagcggcctggctcgaaggagatgaccggggacggcatgccgagcgcgcggttcacggtgctgaccgcgtcggcgagcctgccgagctccacgtcgatgtccatggaatcctcgccgtcggtgtaggccacggaataaccgccgcccagatcgacctccggcagggtgtacgcatcggtggcgtagaaggtcttgcgcagcagcatcatgcgcttggccgcctggatgaaggcgtccgcgtcatggatgttggagccgatgtgcgagtgcacgccgaccagttcgagcacgtcctgacggcggtagatgtccttgagcacggcgagcgccggtccgtcggccaccatggtcatggcttcggcgagcttgcggtcgccttcggagaccttctcgtggctcaaatcgtacgggtatttgatgtcgtactgcagctcgcgttgcgcatggacttcggaggcgtgttcgccaagtcgtgcattcgagccggcgggcgtcacgtcggtgaggtcgtcgagcacgccgagtttgcccgcgtcggctccggcgggcagcagggccacgccgaatttctggtcctcgtgcgcggtggacacgaattcgtggccacccgcgtggatgccggacgtgactcgcagcatgacgcgtgcgcgcttgccgagacgcttggcgatggtggcgatacgctccggctcgcccggctcgtccacgacgatcttgttgaagccctgttcgatggccagctcgatttccgcatcggacttgttgttgccgtgcagcacgaggcggcggcctgggacgcccgcggcgagcgcgatgcgcatctcacccatggtgcaggtgtcgatgagcatgccggattcggtgacgatgcggcagatttccttgctcagcagcgctttgccggcgaagctgacgtgggtgacggtgttgttgaacgcgtgggacgcggcatgcacgaatttcgtggcgcgggcgcgcacgtcatcggtgtcgatgacgtagagcggcgaaccgaattcgtcgagcaggcttgcggcggtacgaccgtggaaggtgatctcgccttcgtcgttcacggccgagccggccggccagattgggcttacaggcatggtttgcgtatctccctttttcgtggattcgcttcacatcttgtccggagcggtgacgccgagcaggtcgaggccttcggcgatgaccgtcttgacggcgtcgttgagcttgagtcgggcggcggcgcgggccggttccggagccttggcgatgcagatggcgtcggcctgttccccgcgggcctccggatcggtgagttccatcggcacgacgcgctccacgttgtaccacttgtggtaggtggcggcgaggtcctccaggtagtgggccacgcggtgcggggcgcgcaggtcgcccgcttcgcgcagcagggcgggccactgggcgagcgcggcgagcacttcgccgtcggcggtggtgtcgagcaggctcacgtcggcgccttcgtaggtgatgccggcggcggccgcgttgcggtccacgttgcaggagcgggcgtgcgcgtactgcacgtagtacaccggattctcgttggaatgcgaggacagcaggttcaggtcgatgtccaccggggagttgtagtcggtgcgggccagcgaatagcgggaggcgtccacgccgatggcgtcggtcaggtcgtcgatggtgacgacgttgccggcgcgcttcgacatgcgcacggccttgccgtccttcatgacgttgacgagctggccgatgaggatctgcatgttctcgcccggcttgtcgccgaaggcctcgcacatggccatcatgcggccgatgtagccgtggtggtcggcgccgagcatgtaaatcgccacgtcggccgggttggtctcgcggtggcgtttgttgcggtagtaggcgatgtcggcggcgaagtacgcgtagttgccgtcggacttgatgatcacgcggtccttgtcgtcaccgtgcttggtggattcgaaccaggtggcgccgtccttttcgaagatgtcgccgcgggcgcgcagatcggcgatggcctggtccacttcgccgtcggaatacaggctgttctcgtggaaccacacgtcgaaattgacgcggaagttcttcatggaacgctggatttcgtcgaacatcatcggcacggcgcgcttgcggaactcctcgcgctgttcggaatcgccttcgccgagcgggttgccgtcctggtcggcgccgccgtcgacgcgcggcaggctcagcacgtccacgccgtccgcgttggcttcgtcgatgacacgcttggcgatttcgtcgatgtacgcgcccttgtagccgtcgatcggggtttcctcgccgtgggccgcggcgacgagcgacttggcgaagcggttgatctgctcgccgtggtcgttgaagtagtattcgcgcaccaccttggcgccgttggcctcaagcacgcgggccatggagtcgccgacggccgcccaacgggtgccgccgatgtggatcgggccggtcgggttggcggatacgaattcgaggttcagggtcttgccggacaggtggtcgttcttgccgtagtcgctgccggcttcgagcacggtgtccaccactgcggccgcggatgcggagtcgagcgtgatgttgatgaagccggggccggccacttccacggacttgatgccgtcggcattggtcagttcggcggcgaacagttcggcgagatcacgcggcttcatgccggccttcttggccagctgcatggccgcgttggacgcccaatcgccatgtgcgcggtccttcgggcgcatcacggcgaacttggcctgcggcggaatcagatcggcggtcagggtgcctgccttgccttcggagacaagggtgttggcaatgttgaaaatcagttcactaagggcttctggactcattcttccaagaataccgggcacgctgacagaatcagtcttcctgtccatcctcacgatggggttgcgatacgtcctgcggaacgctttgcaaggcgttctgagcatcgtcctgcccgccatgccgtttcgtacgccacgccacggacgcgtagtagcccgtgtagcacagcgccacgaacggaatcatgtacagcagcgtggagcgctgcgacggatcgcaaatcaccagaaccagcgcgccgacgcacatcacaatcgcgacgatcggcacgaacgggtagccaggcgcgcggtacttgagctcgccaaccgtatgcccctgcgcgagccattggtggcggaatcgcaagtggcagacggaaaccgacgcccacaccaccagtgtggccaggccggaaaccgcgaccagcgcgaggtagacggtcgaagcggccaccacggaggacagcagcgccagcagcgagccggccatgctgaacatcaccgcgaaaacgggcacgccgtggaagttcgttttggcgagcttgcgcggaatcataccctcctgcgcgagcgaccacaccatgcgcgagcacacgtacaggccggaattcgcggcggacagcacggccgtcagcaccacgaaattcatgatgtcgccggcgaacggcatgccgatcgactggaacacgagcacgaacgggctggtgtcgacgcccgacttgcgccacggaatcagcgccgccatgacggcgatcgagccgatgaagaagatcgccagacgcagcacggtggtgtgcacggccttcggaatcgccttggacgggtccttcgtctcgccggcggcgacgccgaccacttcggtgccggagaaggcgaacacgaccgtcagcagcgtggagaagatcggcagcacgccgttgggcagccagccgtcgctgtagaagttctcgaacatcggcgcatggctatagccggcgatcggaatcgcgccgaacatggcgagcaggccgatgataatgaacgcgatgatggcgaacaccttgatggacgcgaaccagaattccgattcgccgtacaggcgcaccgacaggatgttgagcaggaacacgaccacgatgaacgcggccgaccagatccatgcgggcgaatgcgggaaccagcgttgcatcagcaggcccgcggcggtgaattcggaggcgagcgccaccgcccaattcagccagtagagcacggcgatggtgaacgcggtgccggggccgatgaaacgcttcgcatacaggtggaagctgccggcgtacggcatggccacagagagttcgccaagactcagcatgatgaagtagaccagtacggaaccgatggcataggcgataatcgcaccgagtggaccggcttggtggatggtgtagccggagcttaaaaacagtccggttccgatgactccaccaagcgaaatcatggtcaggtggcgcgtctccattttgcgctccagcccgccctgctcgtcgttctgctgggcttgcgccgtgggatccgcggcggttccggtcgctggctgcggctgccgttccttcgtccgcgtcggttcgccggcgatctgcgcctgtgcctgctgctctgcttgcgattgcgccatgcttgcctccggcttcctgcgcgtttggttgggtgcggcgtgtgttttggctggccgcacaatcgcaatactatacggcaggctcacggcaatgcgcgagcatcgtcggatcgaccgcgagcggaggaacgcccggaacagcgacggcccgcagccgggaaggcatgcgggccgtcgatcgcgctactcgcggtatgcgcggaacgctcagagcgcggcgatggcgtcgatctcgacgagcgcgcccttcgggatgttgttgccgccgaacgccacgcgggccggcttgacggagccgatgaagaccttggcgtatacgtcgtcgacctcgtggaagtcttcgacgttcttcatgtagatggtggcgcggaccacattctcgatgccagagccggcggtgtcgaggatgtgcttgatgttcttcagcgcctgcgcggcctgctcgcccgcactctcgccggccagttcgccggtggccgggtcgatgcccaactggccggagacgaacacgaatccgttggccttcacggcctggctgtaggcgccgagtgctgccggggcttcggaggtggccactgcttccagcttttcgctcatactgttctcctttgtcgtaaggtatgttgccgcaaggtatgtaaacgcgcgccaagtatgtgccaatatgcccgtacatgcgctatttgcgtcgcacctgaaatcatacttttccgatgggtggaagcgggaaaaaccgttcacagaacgatatggccggagttggcgccacacggcgcagcaggcacgaaaacggcggaatcgcaaggaaaaccgcggaaaaatacaacaaaacgagcaacaaaaaggctccagccgttcgactggagccttgcccggtgggcttgatggggatcgaacccacgaccttctgttccggagacagacgctctatccgctgagctacaaacccatgcaacgcactactgtacacggtctgcgcccgtttgcgacacgattcggcgaaaaacgtgacgcagaccttgcaatcgttgggaaagtcagtacgcgcgctcaatgcatcagagtgctcggcgcaaccagcacgcgctgcacgctcagtacatgagggtggcgaggcgacgacgtgcgcgcttcagacgctcgtcggtcggctcggggatcgtgaagtattcgagcagacgctggcgcaccggctcgatgtcggccttgtggcccgccgccacgaaatcaagcagacggtcgaacgcgtcctggatctgcccgccgatcatgtcgatgtcggcgacggcaagctgcgcgtccacatcgtccggcttgtcggcggcagcggcacgcaccacgcgcacgtccgcattggcggaacgggccagcagcagcgccttcgcacgttcgcgggcggcgcgcgtatcgttcggatcggcttccaaaaccttctcgtacgcggcggcggcaccggcgtaatcgccctgctgtgccagcatgtacgcttcctgatgttccggcggcacctgatcctgcacactgccggcggatgcggaattggccgcgtcggaatccggatcgcccgaatacggagcggtgccggtcacgccggcctgctgtgcggcggcgataagcttcggcacgaccacgtctgtgatctgctgcagttcctcgtcggacggaaggccctgcagaatcggcatcggacggccgccgatcaacgcgaacagcgccggcgcaccctgaatctggaacgcctgtgcgatggagggattggatgcgatgtcgatgcgggacagctggatctggccgttgagcttgttcaccgcgtcacccaatgcgcgtgccatggcgaacagacggtcgtcggtcggcacccacaggaacagcagaatcgggaacgtggcggaggtctgcaccatggcctggaacgtgttctccgtggtgtcgatgacatatccgccagccgccggagcgccgcccgcctgccccggctcggccttcacctgatgcttgagcgcttccagatcaacggctcccgccaatgaaacacccggatggaacgcttgctgctctgccatacttgcctccaaaaacacgaaatcgttgctggcaccaactataggtgccaacaacgatttcccggttttcattcccacggatgcgcgataggcggaaaaccgccgacgatgcgcgtccaaggacccgtcgttttacagcgcttcgaccttcaccggctggcgttcggaaccgaccgcggtgattttctgcccggaattcgccggcggaacatacagcgcgatgacgttcacatagctcgtcttcatggtgctggtggccttgccattgccgaacagcgccttttccgcgtcagaggccggctgcgattcacggccagcgccggcggaacgcgtccattcggagttgatctgcgccaccaccagatcgccgccgtccgcggaacgcatgacgctgatggctccattgaccggttcgaaggtctgctgctgcgtgccttcgttaagctccatggccttctgcacctgggcagtcagatcggcaagcttcgatcgcagatcatcatccgcgaatttgctggcgtacttgctgttcgccccgttctgcagcaggtccgcatacgcgtccaccgccgctttcggcgtcatgaccagaccggtgtccgtaggcgttccctgcgcgctgccggttttggagatttcgaaactcggcatcttcacgccggagaacagtcgcgccacaccccacagcttgtagttctggcgtgcggaatcctgcctgaacaccagcagacgcttggactgctggtccttggttgtggacgtgatggagaacacggaccgtggccagccggcatccgtggagatcacggcctgggccagatccgtggggatggtggtcttacggtcaagattgcccgtggctttcgctacgttcagctcgctggtgcggatgtccagttccggaccttcgagaatcgtcggcaacgtatcagtgtcacggttctgattgcactggtcgagcgttttgagaatcctcgtgcggaccttttgctcctgcttggcgctcaagttcggcgcatcctgccgggtggtggctttcggggtcggcagctggccttcgcaaccgcacatgccgacggccattcccagcgcgagcatggccgcgataatcgcctgactacgcttcctcatcactggtcctcctcttggccgtcttcctgcgtttccgtctgaacctcctcttgggcaagacgagcgaaatacgcggcaagctcatcctgcgagatcacggaagtcgcctcgtcgtcaacagacgattcgcccgccgtcgattcaaatacggtcgattcggacacagtcggctggctttccgcaatcgtgttctgctggtcggcgaccaggttacgtgccacaggatcgacgatgacgggctgttgcgtttcctcgaacgacgacgtacgaccgccggtgcgatgttccgcatggcgacgcctgccgtgacgcgacctgctccgtgccctgttgctggcggcggtttcggcgttcttcacccaagccgaaacctcgttctcatcgccttcgttgacgccaacgccttcgaccatggcgaaagcgcgcttgttgcggcgcttatgcggcggcatggcgaatacggaagcggaaagcacggcgagaatcgccagcagtccgccggcaagatacaacggcatggcgaaattcggcaggttacgacggtcccaattcagagtgaccgtatctcccttgcggttgccgaaatcaatcaacgccacaacatcctcggcgttattgctgttcgatcctttgacctgcatatcaacggcaccgtcattgcacttgatggtgcgccacatgtcggagtccttgaaagccacctggttctgggaattgtccgcggttccctgcgcggagaccttcatggtggaaagcgtcgtccaatcggacagaccggagacgcgcatgtacttgcttcccgcaatccatccggcaacgtcgcgcgcggaacctatggcgatgcacacattggatttcttgtcacgggatttggccgaaatattgacgcggctgtctaccagctgcagcacgttcggatcggtgaccacgtattccgaaccgttcaccggagcggcggcggtgatctcattgtccggtttccagacggttgaattcaacacgccaaacacgacgcatgcgatggcaagcaagccgaaaataggcgtgacgatgccacgcatgatcttcgcatgccgggtagggcccgtctcgatctgcggcttctcttgttcttcctgcaatacagtcatagcttttccattctacagtgtccgtttgcacaagcctgaaaaaaacatgaaaatcatgctttgccgctatggttggccctatgcgtaaatcacttctttccaaggccgtcacggcagtctgcgcaacggtcatgtgcttgggcgtcactgcgtgcggcggtaattccagcgcgaaatccgacaagtcgaactcggattcttcctcatcttccgaaaaaatcggcatgcaccaaatcgccggcgtgaccgccaagggcgagctcggcaagaagccgaccgtctcgttcaaaacgccgatgacggttgaggacaacagctacgtggtgctgcagaagggcgacggagcccagatcgaggacggcgaccgcgtctgctcgcagggcatcgccatcagcgtcaaggatggttccgaactggccagcacgtgggagaagaacacccccgactgctccaccgtagtcacctcggataccagccagatgaccgagaactactacaagatcttcaagagcctcaagctcaattccaccgtggcgttcggcgtgaacgactcgaattcctccggcacctcgtatctcatggtactcacgctggtgtccaagtcgaaggacctgaagaaggccaccggcgagaaggtcgcgggcgttccggccgacctgccgaaggtaacgctcgccaaggacggcaagccgtcgatcgacatgaacggctataagggttccgattccctggtttcccaggacctcatcaagggcaagggcgctgtggtcaaggatacgcagtccgtggtggcgcactacaccggctggctgctggacggcacgcagttcgattcctcgtgggaccgcggacagtcctccgccttctcgcttgacagcgtgatcaagggctggaagcagggtctggcaggccacacggtcggttcccaagtgctgctggtggtgccgccgagcctcggctacggaaacaaggatcaggagaagattccggcgaattccacgctggtcttcgtggtcgacattctcgccgcctactgatccgccgaaccgactgataggttcctccaaaaacaaaatagcctccccctcgggaggctattttcatatgcatgcaagtcctaggggaaatcgcggcaacgcgtgcggtatcgaggcgtaccgagggaaggcgtacgaaggtacgtcgaccgaggaacaacgaagataacgctccgttgccgcgatttccagagttggaaccgaaagaatcagaacaaccgtaaagaatcgtcctcagtgcccttcatctcctcgtaatccaaaagcaggcatttgaaaccgcggtcctgcgcgagcacgcgggcctgcggggtgatggtctgcgcggcgaagatgccgtgcacgggggccagcagcgggtcgcggttgagcagatcacagtagcgggtgagctgttcgacgccgtcgatgccgccgttgcgcttgatttcgatggccacgtgctcgccgttgccgtcaatcgccatgatgtcgaccggtccgatggctgtcgggtattcgcggcgcacgagcttcgcgcctttgccgatgcgttcgatctgttcggccaggtacttctgcagatggtcttcgacgccgtccttgatgaggcccggatcctcgccgaggtcgtacgattcgtccgaatagatgcgctgcaacgtcacttccagcacgtcgttcgatttgtcggccgacgcgcggatcaccttttgcggcacttcagtatcaacgtcgtcatcggcgtggtcgggggtgatgtccctgatgctgcatggcgcggacatccagttgagcggcttgtatgagccgagttcggagaagatcagcaggctgttgtccgccttgatgagcagcacgcgcttggcgagcggcagggaggcgttcaatcgttcggaatattcggcagagcagtcagcaacaataattcgcacgaggcactaccctaccatgcgcgtcgccgtacgtacggcatacgtattcgcggcggcggaaagccacgtaaaagacaaaagcggcccggtaatcgcaatacaaaaacatattgcgattaccgggccaccttacgtcaagcggaaacggcttattcggcgcgcttcacgttggttccacgctcgaccgcgacggtgagcttgttcgaatcgaaggagatgaagccgtcagtcacctcgaaggagaggcgattgccttcaggatccaccacaacgatggttccttccttgatcacggtcagcacaggctcgtggtcgggcaggatgcccattccgccttcggaggcgggaatggtaacggacttcgccgtgccgtgccacacagggtggtcagcggcgacgatgttcacctgcatagtcgatccggccatcacgcaccgtattccttctgcatgtcgtgccacttcttctcgaggtcgtcgatgccgccgataccggagaatgcctgctccggaacgtcgtcatacacgccgtcgcagatgcgggtgaatgcttcgatagtctcgtccgccggaacgtaggagcccggacggccggtgaacttctcggcgacgtagaagttctggccaaggaactgctcgatcttacgggcgcggttcacagtggtcttatcttcttcgccaagctcatcgataccgatcagggcgatgatgtcctgcagctccttgttacgctgcagaatcgccttgacgcggtttgcacagtcgtagtgcgcctgacccacgtaacgcggatcaaggattcgcgaagtggagctcagcgggtcgactgccgggtagatacccttcgaagcgatgtcacgagacagctcggtggttgcatccaggtgggcgaaggtcgttgcaggagccgggtcggtgtaatcatcggccggcacgtagatggcctgcagcgaggtgatggagtgtccacgggtcgaagtgattcgctcctgcagcgcgcccatctcatcggccaggttcggctggtagcccactgcggacggcatacggccgagcagggtggacacctcggaaccagcctgggtgaaacggaagatgttatcgatgaacagcagcacgtcctgattctgtacgtcacggaagtactctgccatggtcagtgcggtcagcggcacgcgcagacgggtacccggctgctcatccatctggccgaagaccagtgcggtcttctcgagcacgccggcttcgtccatttcgccgatcagatcgttaccctcacgggtacgctcgccgacgcctgcgaacacggacacaccgccgtggttctgagccacacgctgaatcatttcctggatcagcacggtcttgccgacgcctgcgccgccgaacagaccgatcttgccgccctgcacatacggggtcagcaaatcgatgaccttgataccggtttcgaacatctgggtcttggactccagctggtcgaatgccggcgggttacggtggataggccaacgttcggtaaccttaacggtctcgtcggccttcttgttgaggatgttgccggacacgtcgaatacgtggcccttggtgacatcgccaaccggcacagagatcgggccgccggtgtcatacacggtggcgccacgcacgaggccgtcagtcggcttcagagcgacggtacgcacggtggaatcgccaagatgctgttcaacctcaagggtgatcttcttggtggtctcgccctcttcgtggacaccggtgttggccagttcaacggtaagtgcattgtaaatgtcgggcaggtggcccaccgggaattcgacgtcgataaccgaaccctggatacgcgtaacgcgtccagcggtcggctctgcagccgtctcgggagccgctgtggtctgattctcagccatatgcgttcctactcttccttcttgttcagcgcatcagcgctgccgatgatttcggtaagttcctgggtaatcgatgcctgacgcgaagcgttgagcttgcgagtcagttcatcgatcaggctgcgagcgttgtctgtagccgtgtgcatggcgttctgtcggcttgcagtctcggatgccgctgcggtgagcaggcattcatggatacgggactggatgtacttcggcagaatcgcgtcgagtacttcgtcaacgcttggctcgaacgcatacagaggagtcgcagcatcggcatcggattccggcacaggaccggattccggctgttccggaagcacgagctcaacgggtagcatgcgcagcacacgcaccttctgaaccaccatattcacgaactcggtgaacacaatgtagagttcggagactccaccttggtccgccggcttcatataagcgtccaacagtgccttcgagatggactctgcgacttccacgccgggctggtcggtatcgccttcccaagtgccggcaaccggacggttgcggtacttgtaatacgtcacaccgcgacgaccatacacatacagttccggctgcttgccctgctcatcgagtcgggccaacagcgattccgtttcgcggatgatcgaggaggtgtacggacctgccataccacgatccgaggtaagagcgaggacagccacgcgagggttgtcctcgttctttttcacgatcggatggtcgatatgggtatgggccaccagcgcttgcacggcgtcgaaaatcgcatcggtatacggcttcgcgttcaaggccacgtcacgtgccttggcgatatgcgaagacgcgatcatctcctgcgcgttgaagattttctccagcgacgcggtggaggcgatcctagatttcaatgcgagttgcgagcccatgaatcacttctctcctgcgacgatcttttcctgctcgaccggagtggtgtgcttctcgtcaggcttcttctcgaccagcggcttgcccgcgctggtcacgaaggtctcacggaacgcttccacggccttgtcgagggcagcctcggtgtcggcggtgaagtcttcggtctcgcgaatggtcttgaggatatcggtgttgtgatccagataatccagcatgcccttttcgaacggcaacacgtcgctgattggcaggtcatccatcttgccatgggtgccggcccacacggacacgacttcctgttccatcgaatacggggagaactgcggctgcttcaggagctcggtcaggtgggcaccacggttcagctgagccttcgaagccgcatccagatcggaagcgaacatggcgaaggattccagcgaacggtactgcgccagcgagatcttcagcgtgccggagaccttcttcaaggccttcgtctgggcagcgccaccgactcgggacacggagatgccgacgtccacagcaggacgctggttcgcgttgaacaggtcggactgcaggaagatctggccatcggtgatggaaatcacgttggtcggaatgtaggcggacacatcgttcgccttggtctcgacgatcggcaggccggtcatcgagccgccgccgaggtcatcggaaaccttggcgcaacgttcgagcagacgggagtgcagatagaacacatcgcccgggtaagcctcacgccccggcggacgacgcagcagcagggaaatcgagcggtaagcctcagcctgcttcgacagatcgtcgaagacgatgagcacgtgcttgccgttgtacatccagtgctgtccgatggcggaaccggtgtacggtgcgatgtacttgaagcctgcggaatcggaagccggggaagccacaatggtcgtgtactccatagcgccggcctcttccagggactgcttcaccgatgcgatggtggagcccttctgaccgacggccacgtagatgcagcggacctgcttcttcgggtctccggattcccagttgcgcttctggttgatgatcgtatcgattgcgatagcggtcttaccggtctggcggtcgccgatgatgagctggcgctggccacgtccgatcggcgtcattgcgtcgatggccttcaggccggtggacagcggctcgtcaaccggatgacgatgcataacgtcaggtgcctgggcctcgagaatacgacggccttcggtcttgatttcaccaagaccgtcaatcgggttgcctagcgggtccacgacgcggccaaggtagccgtcgccgacgggcacggagagcacttcgccggtacgacgcacttcctggccttcctcgataccggtgaaatcgccgaggataaccacgccgatttcgcgggcgtcaaggttgaacgccaggccaagcgtgccgtcttcgaaggtcagcagctcattggccatgcaaccaggcagtcccgtcacgtgcgcaatgccgtcgccagcggtcgcgacataaccgacttcctgggtcggagtgtccgacggcttgtacgactcgacgaactcatcgagcgccttgcgtatcgtggtgggatcaatggtaagttctgccatgatcactccttattgttgtttttaaattcagtcaagtcttgtttcaggcttgttcaccgtgtggcgtgccgtcaggcggtcgccttcaccgtgcgctgaagatgttgcagctgtgcgaccaccgtgttgtcggtgacctcgtcgcccacctggatgcgcataccacccaggacggtcggatcgaccaccgagttgatgtgcaccggatggccggtcttcgccgaatagatggcgacgagcttcttgacctgctccttgctcagtggcgttgccgtggtgacggtgaccatcgattcgcccatatgacgggagaacttgttgatcagccactgaatggtctgcagatagcggcgattgcgcagattgcaggtcgcatgctcggccagacgcttggtcaccacattgaagtcggcattgccgatcaggctgtacagcagcttgatacgggcttcggcggggacggttgcgtcatacagcttgctgcgtacgaccggaaggttgagcagtgcggaatgcagctgggcaagctcgatggagacctgcagagtagcattcgtgtggtccgcgtagtacatcatgccatccacaccgaaatcctcggcggcattggcgatgtcggacacgcggctccaacggcgggccaccagatcggacatgatttccatcgtcaacggatgggcttcatctccaatgagggtcttgactaccgcaaccttgtcttcgactgggcgcgacgggtcggtgagggcacgttcaagctggatgttgtggtcgagcacgttggtgatcgtgaacagttcgttcccgatacgccatgcgtcctcgccgctgtcacgcagcttgggggccagcgagtcacgcgaaacgcggtctgcgatacgcgatgcttctcctcgcattggtcacctccctttcttgaaggtttcgatcacttcttgtcgctgtccagttcggcgatcatctggtcgatcatcgtcgactgcacgtcgtcgctttccagcttgctgcccaggatcttgccggccagtgccgttgccagcacgccgacctcacccttcaggctcaccagagcctgctgctgctgggattcgatggaacgctgggcggtggcggtgatctgcgccgcatcagcctcggcacgggtacgtgcgtcggcgatgatgtgcgatgcttccgcgcgagcgtcgtcgcggatcttggaagcctcgacgcgtgcgttgctcagctgggcatcgtacttcgccttggcttcgtcggcatccttctgggcctgttcggccttggcgatgccgccttcgatcttggctgcgcgctcatcgaacacggcctggaacttcggcaggaagaacttgtagaagaacacggcgacgatgatcagaatgaccaacgaccagaaaatgtcgtagcttttcggaaggaacagttccatctcgctagctgcggtcaccatagtgtcttcctcctttcacgttcgtttgcgtcttcggtgtttaccttggggatcaagccttacttgatgaaggcgagcacgaagccgagcagtgccagcacctcgacgaatgccaggcccaggaacatgagggtctgcagacggctgccgagctcaggctggcgagcggtgccttcgatggtcttgccgatcaggatgcccagaccgatgccagggccgatggcggcgaggccgtagccaacgacgttcaggttgccggcaacctcagcgagggtaacgatatccatgattgtttcctttctggttattgcttgacaagaagcaacacttaaaaagccggcggtcagtcgatctccggatagctcatattgatgtacgcggtggtcaggatggcgaagatgtaagcctgcaggcaggcgaccagcgcctcgaacaggaacatgaacatgccagccgcgaaggtgatgatgccgaacggcatcatcagcttgttcaccacatcaacgaggaagaactgcgtggccgagaggcacaacgcaaggatcaggtggcccgaaaccatgttggcgaacagtcggatcgtcaacgagaacgggcggataatcagcagctcaagcagctgaatcggggacagcagaatatagatcggggccggaacgcccttcgggaagatctcgtccctcaggaagtggccaaggcccttttcacggatgccggcaatccagtactggcagaagcaccacatggcgaacaccagaggcagcgtgatggacgcgcttgccgcgatgttgaagcccgggatgatgccgcacagattgaagaccagcaacgtgcagaacacggtggtgatcatcggcacataacgcttgccacgcagctcgcccatcacctgatagacgatgttgtcgcggacaaactcgatcagccattcgactgcgccctgccaacggccagggatgagctttgcacggcttgccgtaattccgagaaccagcagcatgatgacggtcgcaagaatacgaacgaggatgatgcggttgatggcgaacggcgtgccttgaaaaacaaacggatcgggaaggaagtcattgatgctcggcatctctggaccatcggcgatggtcatgatgccctctcccaatgcactaatcattcacgcctcctgctcttgtgtcagctgttagtctagcccaacagctgagtcgaatgtgacattccggttaccaaaccagaacatccttcgggttctatgttaacgcgcccataaacgcgttcgcataccagccccgaatggctgcaaaggattatcagaccgtggctagacaacattccgcaccgggagctttcccctactaccgtatagcgaaaaccggcgtttcgcacgttgcggggactattagacacaaccacggccgttgtcgattcggcctatttcacccccattcacaccaaaatagacatcgtttgcaacactgcttgataaaacgttttacttaacatatcgcaccataatatatgacggcgaaaatgaaacgatgtcgcagcaggcaacaaaaaccgcgcaaaaagcccacgacaccgcgcaaaagcggcaatcgtgggacaatcgccaatacttgtcagtactcgccgatcttcgtgaaatcagccgcgaatgacaccgtatccatcgtgcgagaacggcgtgaacgcgtcgacacgcggagaaccgggctcgtgccggatcgaacggtcggtgccgaggcgcttctcctcgcgcagctgcggtacttcgctcaaatcgtaaggcgtagtctgatagacccagttgagccagttgcgccacagcaggttggcgtgggcgcgccaggcgaacagcggttcgagcttcggatcgtcgtgcgggaaatagttttcggggaacggcacgttggtcatgcccttcttcatatccctctcgtattcctcggcgagcgtgtacttgccgtattcccaatggccgagcgcgaacacttcggagaagtcacgcgtggcgatgagccccgggccggacttcggaccccacgtgagcacctgcagctcgggattatgggcgatatcaccctcgttgacccccgccaggcgggaatgcggttgcaggcagatctcgtcgaaaccgttggtgaggaagcagtattcgtcctgcagatactgggggaacactccaaagagcttctccggcagcagctccttgcgcacgccgtaccgatagttgagcgcgcccatcgcgccccagcacaggtacatggtggagaagacgtgggtggatgcccagtcgagaatctgcttgaactcgtcccagtagtcgacctgctcgaaatcgaggtgctcgacgggcgctcccgtcaccacaagaccgtcgtaatagttgtctttgaacgcatcgagcgtctcgtagaacttcaccagatggtcggcgctcacgtgcgtggcctcgtgggtggaggtcttcatgaagtcgacctcgacctgcagcgggctcttggagatcagacgcagcagttgcgtttcggtctcgatcttcttcggcatgaggttcagaatcaccagcttgagcggacgcacacgctggcgctccgcttcgggcttttcaagcgcgaagatgcgctcggagtcgagaatgtctctggccggaaggccgctgggaatcttgataggcatgtttcctattatggtgcggacccggatatggcgtattcggcggttttcatcgacggtccgcagcgttatacgaaaaaacggataacgcgttatcggatatgcgattccactagcagcgcaatatgcgacacgccgatttgacttattagccaacatccgtaaagtagttaaagctgcctcaatgaaggcaagccgacgcggggtggagcagctcggtagctcgctgggctcataacccagaggtccatggttcaaatccatgccccgctaccaattgaaaccggaagccttttggtttccggttttttgtttttctaggacgtctcgctccttttatataaagtccccatacatatcgaacgcaaccgacgcgcacaacgtatggtcatgccgctgtagccttcataatcgaacataatcgcaaaacatgtattaaaacgctttaccaaaagtatttgaagaaagcacttgtagccgcatcgccgtaatcgttacgaaaagggaaatcacaaaaagaacacaactacctctataatcggctatatgaatgaagcaacatcatcaagcgcgacaccgcgcacaaaggcaacagcaaagacaacagctaaagcagcggccacaaagacaacgaggacagccgcgaaatcaaccgcgaagacgacaaccaaaaaaccaaccaccaagcgcacttccaagccgaaaaccgcaacgaagcgaaccgtcggcgaaactccagcacctatcatcaaccgcaccagcccggaacagttcggccgcgtaaacgttcttgacatcactccgtccgccgaaaacggcctgtacccggcccgcgtggagcttggcgaggcattcaaggtcaccgcgcaggtgttcatcgaaggccgcaccaaggccggcgccaccgtgtccgtgcgcaacacgcgtggcaccgagaagggccgcttcccgatgatctgcaccaaccccggcctggaccgctgggaagcgatggtcaagatcggcgaccacagcgacctgaagccatgggaagacggctacgccgacgtcaagaagcagctcggcgaatggcacatcgtggtcgaaggctgggaggatacgtacgcttcctggctgcacgacgcgcaaatcaaggtcgaggtcggcgacgatgcggagaacgcgctggaatccggcgcgcagctgctggaacgttgggctggcgcacgcgattccaagctgaccgccgacgacaagaagacgctgcgcgaagcggcgaaggccgttgccgacaagtcgctcgacgcgaccgcgcgtcttgccgcggcgaccaccgacgcaatcgcaagcctgcacgaaaccaatccgctgcgcgacggcctgagcgcgtcgaatccgcagcgcttccgcgtggaacgtccgaagtcgagcttcgccgcatggtaccagttcttcccgcgttccgaaggcgcgtatttcgacgccgacggcaagatcgtgcagggcacgctgaagacggcgctgtccggcctcgaccgcgcgaagaccgaaggcttcgacatcgtgtacctgccgccgatcttcccaatcggcgtgaccaaccgcaagggccgcaacaacacgctgatcgccggaccgcacgatccgggctccccgttcggcatcggctccgagctaggcggccacgacaccgtcgacccgctgctcggcaccatggacgatttcaaggcgttctgcgattacgcgcacaagctgggcatcgaagtggcgctcgacttcgcgctgcagtgctcacctgaccacccgtgggtcaagcagcatccgaactggttccgcaccaagccggacggaacgatcgcattcgccgagaatccgccgaagaagtaccaggacatctacccgatcgatttcaacgccgacatggaaggcatcgaagcggaaaccgaacgcatcatgggcctgtggatcaaggccggcgtgacgatcttccgcgtggacaacccgcataccaagccggtgcgtttctggcaggacgtgatcgccgccgtgacgaagaagcatccggagacgctgttcctggccgaggcgttcacccgtccgggcatgatgcgcgcgctgagctatgccggcttcacgcagtcgcactgctacttcccgtggcgcaacaccaaggaggagcttgaggagtacttggaggagaccaacggcgacggtggtttctaccagcacaacaccttctggccgtccacgccggacatcatgaccgcctacctgcgcgacaacggtatcgccggtcacgcggtgcgcgcggcgctcgccgcgatgggctctccgagctggggcatctacaacggctatgagctgatcgagaacaagcagcgtccgggcttcgaagagcagatcgacaacgagaagtacgaagtcaaggtgcgcgattgggacgaggccgacaagtacggcatctccgagctgctcacctcgctcaacaaaatccgttccgagcatccggcatgccgcagctaccacaacctgcacgtcctgccgagcgacgatgcgggcgtggtggcgttcctgcgccagaccccggccgagcttaccggtaccggcaagccggatacggtgatcgtggtggtgaacctcgacggccacaacgcgcatcagtccatcatccacatcgagctgccggacttcggtttcgccaccgacaagccgctcaaggtgcgcgacgagctgaccggacgcgagttcgagtggagctgggacaactacgtctcgctggcaccgtgggccgacgtggcgcacgtgctgacggtggtcgaggactgatttttggtcccagccgactttaacaaggagcgcgggcagaccattcaaatggctcacccgcgcttcacatgcacctcgctattgatagctccgtggctctatcagcaatcggcatcagaggaagacagcaccccgtctgacataaggtatagatgatccgcgatttgagacagctcatcgctatgatgactggcaatcaatacggttcgacccatatcacgctgacgcttcatctcctccagaaacaccgagacagaatgctcatcaaggccattagtcggttcatcgagcaaaatcaaaggttgatgttccatcaatgcctgcacaatcgccagcttttgccgcatacccaaagagtaagatcgcacttgttcttgcgcgtggttccgtaaaccaaataagtccagcaaacgcatgatctcatcctgatcaaaggcgtggttgatgtcggcaagataccgaagattctccatagcactctggctgggaatgaatccaggattctcgataattactcctacggattcaggtaatttcttattgaattccacgggtttaccatcaatgctcaccgtaccattatccggccggataaaaccgcaaatcgcgcgcaacagcattgtttttcctgacccattaggaccaacaatgccgtagatgttaccccgttcgaattcagcattcacgtcacgcaataccactttgcgtttgatggtttttgtaagatgacggatcttgacatacattttgtcattcctcctttgcattgcgccatattgcaatcaacactttgttttactggaactcaatacatttccacatgctcaaaaacaatgagattcaccatagcgagcgccaaaaaaagaaccgtcaaaacaggtacccaacatgggaggatgccaatccacgaggatatcaaccatcgtcgaaccccatctaacgaaagcaaggcagtatacagcgcagcagctgtggcatagcccattacccggcaattcagcaaataaccaatattgatgatgagcatcagtacggcaagcgtcaaagccgcacaaatcgcagtcatcaacagacattcctgccgatccctagaaacaatcattaccgcgataattaactgcacaccagtgaacagggcacagtagcacagcagcagcgcacaatatcgacaaaaatgagaccatcctcgacgacttctgacatacaccagataatcaggaatcatcagatattcagagcactgttccaaggcaagcgctattcccccgaccataaacagcaacggatacatattcaaggtaagatccggatgactcattgcaggagcaatgcgaaacatccccataaagatacctgtatcctgcgcactgtagtaaaagcgtgaagcgaatatggcgtaaatgacgaatatcagcattcgcagaccttttttacggccacaaacctgtccgatgcgacatatagcatgcattagtttttcagccgatctctggagttgaacgccacgatacaggccataatgagcaatgagcagaatccaaagcatggaatgacttggcagataacaatatctgaccagtctggactgatcgggtaccaaaaatagaacatcatacgagctgctccatcaaccaacggagtcaataaccactgcgcaatagcaaaaagcgcaatcagcaccgcggcgacatgttccatgactaatcccatgtagctcagcaataactggaccaagcctattgaaatattcatcatcaagcattgaactactagcattgcagtcaaagacccatgcagaacagatgcagattgtcttttaatgacaaattccatgacagcaaaaacgaggccaccatatgcggcgcatatgcaagacatcatgttcagccatataacattttcaccaagctcgtcacggggattccgacgcaccaattcaaacgtcctaaatcggacacggcccaaacacattgccatcaaacaaatcggaagtactgtggccgaagctccctgcttcataaatccgatgtagtcagatacgaaatcgtgagggtcgaataataatgaaatgccatacgcaaatcccaccaccataaccaatatggcactgattctcataccaatggtggaataccgtacggaagcaaaaccatcacaaagcatcacgatacctttccacacacgccagtacggtagacaatgcaagtaagagcgccgtcgaaagcacaatgcccacataattttgccaacgcacagaatggtctgcacctggagcaaagtccagaaagataacatggctccactggtccggtatcttaccccccgtaagagaaggaagcatccaccatacaagactcagtacgaacggaaccaacacttccgtatatttgcgttgcatgaaaaaggacacgccaacggccaccgtggagaaaagtccggcaatcacaaatatcaacaacaccacgcatagtatgcataacacctgattgaactcatacaacggatatatccaagaatcagaagaaatcaaaatatatttgctgctatacacgcgccctcgcgcatccgccgatacaccatcgataaaattcaaatgaggattgcgcatagcagctattgatagattcgcaatcatcggcattattccacccacaccaccaagtacgaatccagatgacatcgcagtcgttacaaaacgtcctcgtccttctcgaatcacgaccatggggagccgcccggcgtgccgttccaacgatacgacgctacctcctaagagagcagataggaaaggcagcaacagcagatacatgccaccgcctgtcccgtattgactgaatagcatcacatcccgtagcaatgtagattcgctcgagggagtgacataactcgccctatacgtggttagatattggacagcgaccaacatacaggatatgacgattacaccaatcatccgggcacttcgcagttgcccaaccaactgatttctcatcaaccgccaatccatcaagaccccttcgtcttcccgaatccaaacagcgtggcgtagaagagcaatcttctacgccacacaaccatgctcagttatcggggctccatttacccgatgtttccgttgcaccagagtacgcatgcgccgcttgcaaacgcatatggacctgtttcttaccgaaattcttatatacttggttggtgacccaaccctcttggcctgaagtaagagttacaacgccggattccacatcttcatttgcatacccaagcatccacgcacgtatcgtccgatcaccagacacatgatcagctttaatatagccatttgaagcatcttgtttttgacgatttggcgtatctgccgtattccaacctgtaagatatgcgctccatgatgtttttcctacattcccagcaaacgccggtgttataaaacaacaagaagcagccacagctgctgcaactgcaaccactcggcctgcaatacgtgatttcatcgttgaaacctttctctgctatgtcaataaagacaaaggcaataataagataattcaaggaagccagttcatcttatgtaatgaaattctttatgcattccacaaagaacagatccacttaggaattccagatgggcaattcacaactctagaaacagacaaatatgacattcgcccatcccaactgttgaacacggaaacattgtcgacattccctcccatcaacatcacagccatcattcctaatgcgatctctctcatctatatatcttttctcataattgtgttgaatccacttaaagttttaatctgtttccgcaatagcaaaacaaggcaatgtaaagattttcatcacatggcactatggatcaattggcccacgactacactcacgttatatgactgaaggtatttccatcgccgttctggacaatgactcatggagcttacgggcaatcgcgcggtggattgacggcagctcacctttgtatcatgtcatctggcaaaccacttctgcggcagaagcgatccatcgatgtatatacaccaacgacaagccaaatgttctcttgcttgacatggcgttgaacgatgctactggcatatccgtatgcactcagatacgaaaacgaaccgccgacatcggcatcatcggcatcactgcatatgatcctgaacggtacaagactgatttagcgcttgccggcggtcaagctcttatcgccaaagaaaacttggcacatgtctgcaataaagtactgcccatcgtggcacaaggcaaatccgctgaaccaaattcgttcccaaccgcgaaacaagcgcatgacatactggcagaacaaccttcttcattctctcagatcaagcagctcagcccgcgagaacttcaagtgcttcgcctttacacgcaaaataacaatacttcagaaattgcttcgcaacttggcatttcttccaataccgtattttcttacattcacagagtctcgaaaaaaataggcacaaagaatagatcagagataattcgactatgcaaaaaatacgacattttataaaatcaatcaaagaattatgctacgacatgaatcgtagcttgccaaaaaaattatctttatacatagcttttccattgtttctattgtattctctagaacttatcagtggatactatcatcaatttacagtattttccattgtttttatctgcatagaactatgctcaatcgttctttttattcaattcccctatacaggatcaataataatcatcatattgtggattactgcagttagcataaaaccagtactgccctactcctttgtattcgcgggactgtccgccacggtaattctcggatatatcaatatcccttcagcaatcagcatcctcttgttcgccacaagcatcttatttttccaacctcatacagacaagagcgcactcgtcatgttcgatactacgttcttgaccctagccataatcgggtgcgccattcgtctccatcagaatcaaaaacgcgccatcaatcaactgaccatccacaaatggaaggaagaaatcgcagaagagctgcacgacatcgtatgcaacgatcttacctacgcaatccaccaaataaaccttttaaagaatgaaaatccaaacagtcagagaaaccctgagatcgcagaaaacatggcattacttgacatcagagatagtctcatagaggcattgagttgttcaaggaccgccataaccacactccgcaaagacgatggcagttgctccacatccgaaatcgatatcaccacaatcaacatcatcgaactgctagaacaagaacgtatgaaactcgccaaggctggtttcgacggcattattgcagcggacggatccgacaacctgacaacaacacctggcaaaagcattatcatcaagcaactcatcaaagaaatcttcggcaatatactcaaacatgcggatccctcacatggctatgtcatcactgcgtatgtcaacgccagcacattacatatcagcgccagcgatacgcctcttttaaagaacagcacctcaaagcatccgcaagacaatgccaccaacaatcaatttggcaatggcacaggcatacgctcatatcaaacacgactcgcggcattagacggcgaattatccgcctccgcctccgatgaccagtggacgctggaagccgccatacctttaatggacaccgaccacaccgatggccaccattcagctggacgaatgcgaattcggttggattgagcaaccaccttgccaaccgacgacgcactatatacccgcccaacgatggcggaatatccgcaggacggtcttacagcataccgtgataccgcaatgactacaatcgctcacctaatcactcaggcttagtttcaacgtttgtaagattacggagttttctaccataagcttatggtaattgcatcatgtctatcaaccccgctcgcgccttatttttccgatgaaggcaaaagacttatcaaaacgtcgaaaatgcactttcatgatacgggctgctctgctatctcctgaaataacaaatcggcaacagttccttgccagtccgcacctaggtgcgtgacgaactgaccggacgcgagttcgattggggctgggacaactacgtctcactggcaccgtgggccgacgtggcgcacgtgctgacggtggtcgaggactgagtgagtttggatgctaggcactctgcctagcacccagccagcgcaaaacacatagatcaagggcgggttgaagacgtttctcacgttttcaacccggctttgtgcattccgtaggtggttttttgattccgtaggtgctctccggtcaatccacgcaaacagaatggctgaaatcaagcctttttgccgcagggataccagagccaaccacctacggaagagcaaaaccacctacggaattgttcttccaacgttccaaggcaggatagtcaatcacaatcggccaaaaagatgttgaccagcgagcgcatcacgccttatctccccagcactgagcaccattcatataggtatccggaaaatggtgccgatatggcgcgaaagcgggtattctaagtaacgaactactgctgatcattcgatcaaggagaaaacaatggcagaaaccttcaacgtcgtggtggagatcccgcgcggttccaagaacaagtacgaagtggatcacgagaccggtcgcgtgttcctggaccgtaccctgttcacctccatgggctacccggatgactacggctacatcgacggtaccctgggcgaggacggcgatccgctcgatgccctggtcatgattccgaactccgtgttcccgggctgcgtggttgagtgccgcgccgtcggcctgtatcacatggtcgacgaggccggtggagacgacaaggtgctgtgcgtgccggccgacgtccgcttcgacgacatcaaggacgtcgacgacgtgtccgagtaccacaaggctgaaatcaagcacttcttcgagcagtacaaggctctggagccgggcaaggaagtcaagccgggcgactactggaccggtgccgctaaggccgaggaggaaatcgtcgcagcccgcaagcgcctcgctgaggcgtgaagctgacagcgcggtgcgctgtcagtagccgaagtgagcagctatgcggcgaagccgcatgcgcagcatgcggaagcgagaagtgagtcgaaataattccgactcgacgatagacgataacaagccgctcttgtttcaagggcggcttgtgcgttatagtggtggcttgtaatttacggcatgcgaacagtattcgctgaattcaaagcctgcgggacaccatcgatccgcgtgcggcagttctgtgtcggtactcctaggcgtaggcggaacgcaatccgtcgaggcccatcccgtggggagaccggcgggatgaaccttttcaccagctatgctcattcagattctgcttattggcgtgtccgtgtccatggacacgttcgccgtctccatcggcaaaggcctgaccgtcaagaagctgcgcggtctggacgcgctcaaaaccgccctgtggttcggcggattccaggcgctgttcccgctgctgggctatttcgcggccagcacgttcagcaaatacgtgaccgccgtggaccattggatcattttcggcctgctcgccctaatcggcggcaatatggtacgcgaggcgttcgaagaggacgaggagaacgccaaggaaacccctgaattcgattggaagcacatgctgccgctcgccgtggcctgcagcatcgacgcagtcgcggtcggcgtgagcttcgctttcatgacgctcaacatctggctgtcggtggtcatcatcggcatcaccaccggcctgttctccgccgccggcctgtatatcggccgcgtgttcggctcgcgttggcagaagccggcgcagatcgcaggcggcgtcgtgctgatcctcatcggcctgaaagtgctgttcgaacatctcggcttcctcggctgacgctacagcccacagcagcgcacgcagcgcaacggaaaagcccgcaatcgcaatgattacgggctttttaaatacgtgaattatggcgattacgcaaccgccaaatcgtcagaacgtcacgacggcgagcgcggcgatgcctaccacggcaccggcgatcatgaccggcagtatcgcgatgccgatccacggatcgcgcgcggtcggttcggggtcggcgtcgcgatgccagaagtacgagcagacggcgagcgccacgatcaccagcagcgccacgacgaacgcgaccgtgccgatcgccttcagtaccgtcggcaggaagcaccagcctgcgctggcgatcatcgcaacgccttcgaccacgctgtgcgacagcgagcggatgaggtgcgtgcggttttcgcgggccatctggcgtccgaaggagatcacgatcagcaggatcagcaggccgccgacgccggcgatccagccgtcctccatggagaagtccttgccgccggtcgcgtcggcggcgaaaatcgcccgtccgagcgtcatcgtcgtggcgcacaccaccgacagcaggccggcgatgacggcgatcacgtgtccggcggtgccgtcgcggaacgggctgaacactaccagcagcgcgatcatcgccagcgatccgatgatgatgaacggcaccacggcgggattggcggaatcgccgtatgcgatgccgggaacgagcgcgagcgccaccaataccacgtacgcgacgatctggatcgccaatactttgccgaaagcgaccttcgacgggttttgctgggaaacggcctgcggagcggtcatctcggaccccctttttatattgtggtcaatacgtatgcaatatgaataaatgtagccgtatgtgtccacatacttcagttacaatcgatgaaacgccgataatacattttgcgtgtacaatcgcggcatcagtttagaacaaaagggagctgacgtgacggatcttacgcttatgacgttcgctagcgatccagctaccgttctcccctcgttggcgctgctttcccaccgcgtgcgcgtgttgccgatggatgcggccagcctggtgaaaatgccggagaacaccattctgtttcttgatgcgcgtgacgacctggccaccgccaaaacgctgtgccgtctgattcacgcgtcgggactgtccacgccgatcgtgctcattctcaccgagggcggcttcaccgtggtcaattcgcagtggggcattgccgatgtggtggtggctacggcgtcccccgccgaggtggaggggcgtttgcgcctggtttccgaacgtggcaacgcgccggtcaacgcggcgtccggttcgggcgagcagggcgtgcagaacgaggatggtctgatccgttccggcgatttggtggtggatacgaatggctatacggccagtctgcacggccatccgatcgacttggcgtacaaggagttcgagctgctcaagtatctggtgcagcatccgggccgcgtgttcacgcgcgcgcagctgctgcaggaggtgtggggctacgactattacggcggcacccgcactgtggacgtgcatatccgtcgtctgcgcgccaagctgggcggcgagtacgagcatctcatcggcaccgtgcgcaacgtcggctatcgtttcgatccgccggaagaggatgagcatgaggccgcggccaaggatgcggctcacggcgagtccggcgaaagctgactttttcttgcgatcattccgttgatgttcgacgggtttcgtttgttttcgttggcctttcgctgatttcctgttgttttttgctgatttcctgttgttttttgctgattttctgtcgttttttcgatggattttcgctgtttttgccgattgcgacgtttccgcaggtttcccgcgttcgtccgcatgcgaggggtaggctgggaggcatgcctcgggaatcgaagaaggcgcggatcgcgcgcatgcatcaggaatacgagcagttgtgcgtggagattcccgatccgaaatgcgcgttgaacttcaattctcctttcgaactgctggtggctacggtgttgagcgcgcagaccaccgacaagcgcgtgaacatggtcacgccggaactgttcggcgaatatcccggtccggcggagcttgccgccgcgaatcccgagcacgtcgaggacatcatccgcaccatcggcttcttccgtacgaaagcgcgcaatatcatcgggctgtcgcatgagttgtgcgtgcgattcgggggcgaggtgccggccgatatggcttcgctggtcagcctgccgggcgtgggccgcaaaaccgcgaacgtggtgttgggcaacgcgttcggcgtgcccggttttcctgtggacacgcatgtgattcgtgtgactgggcgattgcggtggcggtccgactgggcgagcccctcccctgacccggtggccatcgaacgtgaggtcaccgcctgcttccctcccgaagaatggaccgatctgtctcaccgtttgatattgcatggccgtgccatctgccatgcgcgaaaaccggattgcgccgactgccccctcaacgacacgtgtccgggcgcgttcgccgcgtgattccgacgcatgccagccgccacgccggcactccgtcgaatcgcacccggccatcgggcgtgtagcacgcgtcaactagactcgggtgcatggatgaaaacgggcggaaacgtaatctgaaagccgaggcgacgcgctggctgatcttcttcggcgtcgcgatcgtgctcagtgtgctgctgtggctgggactgtcgctgacaggccgcaagaatcccatcacatccttcgacacgctcgtctccgactcgtcggtgaccgtcggtatcgaaggcgacgcgccgaaatcgcttgacatccgcaccgaacaaggcaccgccgtggagcaagcgctgctcggcaacgtatacgaaacgctggtgtcacgtagcgaaaccaacaagctgcagccgggaatcgccagctcctggcaggcttccgacgacggtctcacgtacacgttcacgttgaacggcggcatgacgttcgccaatgggcacaaactcgactcgtccgacgtggtctggtcgctgcagaacgccgtcaacaaccattacgtgggagccgaccagcttggtgatctgaaggaaatcaccaatcccaatgcgaatacggtggtcatcacgctcgccaagccgaatccgcggctgttgcgcgcgctggccggccgtgcaggcatcgtgtacgacgcggaaagcaaaaccaactatgcgaaatcagcggtcggatcgggaccattcaccgtgtcaaccgcggaccaatcgcaaatcgtgctgcaacgcaacgactcgtattggggcaaaaaagccgcatcatcgcaagtgacgctctactactacgccaacgaggaatccatggccgatgccatgaaagccggcaaaatcagcatggcgctgccgctgagcgcttcaaccgcctcggaactgggcaaaaccaacggtattaccgcggacagcggcatcagcttcgacaaggtgatgctcgcgttcaacaacgacaacaacagccccttctccgacgagcagatccgcaagatgacgcgatacgccatcgatgcgaagaccatcgccaagaacgcgcccgacgcgtacgcgccgctgggagggccgatcagcccgctggaagacgggtatgaggacctgagcggcctgtacccctacaaccttgaacaggggcaacggatgcgcacgtatttcggagtgaactacatcgcgccaatcgacattctggtgccgaaggaatacgaaagcatcggcaacgacgtgaaaaccgccatcgaaaacctcaatatcaacaccaatctggaagtgctcgattccgccgcggacgtgacggaacgcatgaacgccggcacctataacatcgcgctgaccaccatgagcgacgaaggtgacgcaagcgtcttcgacaacggccagtccgtgttccatttcgagaacggcgacgcgcagcaggcttacgccaatgccatggccgcgaccaacgacaacgattatcaggcccgcatgcgcgattacgcgcgcgccgtcagcgaaaacgcggccagcgactggctgtacacgcgcaagaacttccttgccgtttccgatgggctgcaggggtatccgaagaatctgaccgatcgtctgctgccgttgaacagattgacgctgcactgatttttccacggttttttatgtggattttccgcgatttgcctgcgattccggcattcggttcgataggcgctgatacgacggcagttgtcacattcgctttctagactagcgactatgactgaaagccaagataacaccatcaacgcgaacctcacgccgctgcccgacaaggtcggcgtggacggtctcgaagacaagtggcgcggagtctgggacgagagcggagtctacaagttccagggcacccgcgaccgtaaggccgtttattccatcgataccccgccgcccaccgtttcgggccacctgcacgtcggccacgtgttctcctacacgcacaccgatgtgatcgcacgtttcaagcgcatgaacggctacgacgtgttctacccgatgggctgggacgacaacggcctgccgaccgaacgccgtgtgcagaactattacggcgtgcgcgtggatacgtccctgaagtacgatccgaatttcgtgccgccgttcgagggtacggacggcaagaagatcgacgccaaggaccaggtgccgatctcccgtaagaacttcatcgagctgtgcgagaagctcaccgcccaggacgagaagcagttcgaggcgctgtggcgctccctcggcctgtccatcgactggtcgcagacctaccacaccatcggcaagcatccgcagcgcgtggcccagaaggcgttcctgcgcaacctggcccgtggcgaagcgtatcagaaggacgctccgggtctgtgggacgtgacgttccagaccgcagtggcccaggccgaactggaatcgcgcgaatatccgggcttctaccacaaggtggcgttccgtttcgaagacggcaccccgatctatatcgagaccacccgtccggaactgctggccgcctgcggcgcgctgatcgcgcacccggacgacgagcgttacaagcagtatttcggccagtacgtctactccccgctgttccacgtgaaggtgccgattctggcgcataaggcggcggaaatggacaagggcgccggcatcgccatgtgctgtacgttcggcgacgtcaccgacgtcgaatggtggcgcgatctgaacctgccgctgcgttccatcatccagcgcaacggccgcatcgtcatggacaccccggattggatcgaatccgaggaaggcaagcgtatcttccaggagaccgcgggcaagaccacgttctccgcacgtaaggtcatcgtcgacgagctgcgcgctgccggcgatctggacggcgagccgaccccgaccaagcgtatgacgaacttctacgagaagggcgacaagccgctcgaaatcgtcacctcccgccagtggtacctgaagaacggcggcaccgacgagaagctgaacgccgagctcatcgcacgcggcaaggaactgaacttccacccggacttcatgcgcgtgcgttacgagaattgggtgcacggcctcaacggcgattggctgatctcccgtcagcgcttcttcggcgttccgttcccgctgtggtacccggtgaaggaggatggcaccgccgattacgaccatccgatcaccccgagcgaggaccgtctgccgatcgacccgaccgacgatgtgccggaaggctacaccgaggatcagcgtgacgtgccgggtggcttcaccgccgagccggacatcatggacacctgggcgacttcgtcgctcaccccgcagatcgtgacccgttgggaggagccgggcgaagagaaccaggccattttcaacgccaccttcccgatggacctgcgtccgcagggtcaggacatcatccgtacctggctgttctccaccatggaccgcgcgcacttggagaacaagtgcctgccgtggtccaacaccacgctgtcgggctggatcctcgatccggaccacaagaagatgtcgaagtccaagggcaacgtggtcgtgccggacaagccgatcaagcagttcggcgccgacgcggtgcgttactgggccgcggccgcacgtctgggcctggacgccacgtacgacgaaggccagatgaagatcggccgtcgtcttgccatcaagctgctcaacgccaccaagttcgcgctggccatcggccgtgaggacgagaaccatcacgtgggcgctccggcagtcgccgcatggaacccggccgacgtgaccgagccgatcgaccgttccgcgatgtccaagatggccgccgtggtccgcgaagccaccgacgatctcaacaactacgagcattccaaggctctggaagtcatcgagaactacttctggcagttctgcgacgactacatcgagctggtcaagaaccgcgcctacggcaccgccgattccaccggcaacgtgccgagcgaggccgcggtgaagtccgcacgcaccacgctgggcctgggtcttgatgcgttcgcgcgcctgctggccccgtacctgccgtatgccaccgaagaagtgtggagctggatgcatgagggcgaaggctccgtgcaccgcgcagcatggcctgtggccgacgtgtacgcggccgccgccggcgacgcatccgccgatctgcttgctcatgccggtgaggctctggccgcgctgcgtggcatcaagtcgaaggccaaggtttcgatgaagaccccaatcttgtctgtgacgcttgccgttgccgacgatgtgcgcgggtccatcgaggccgcgctgggcgatatcgccgaagctggtcgcgtgaccggaccgatcgccttcaccgcaccggctgccgccgagggtgaggacgaggccgccgatgtgacggtcgccgaaagcgagctaggcgaaccgccggccaagaaaccgaagaagtgagtctctgaggtgagccgccagcggcttttgtagcgcagccgctcacttcacccacatacgaggggcctttcctttgcatgaaggagaggcccctcgtatatcccgtcactgtctgcaaccaaccgtgcccccttttgctcatattcagtcaaaatcgcgggaaaaatgctttcgtgagcgaaaaggggtataaatcgcaggcaaaacggtcgaaatcatatccccttttgctcacgtccgtgcagaatcgccctaaatcgcaagacgtgcgcgcatagaaccgtccttatcccgttctcggctgttctcagcgtacattcctgccccctgcgcacaaacccgtacgcgaaaaatggtttttatgggcgtaatctcaacgaaggcacaagcggaggcggaaatcgcaatcaaaaaccccgaaacgtaccacgtaagcgacggagcactatcggatttagcgcatcgcacaaaccgcgtgctctacagcaccggaacggacaggaggtactgcgggccagcggacgaatttccggaaccgttcccacccaatccagcctgcagcgcatcgtcgaaaacttccgcagcggcggccaattcgaccgtctcgtcaatcaaatcgccattatccggcgtgaaaccggttttcgccaagccatagccggtaattggtagcgagctggcggacgaatccgccgaaccgtcggacgaatcgccaccgctgttcttcgaagagccgtccactcccccgactttcgccacattcttcgacgtggtgtccgctgcggcgccgaacgacgggcgtagtccgcccgcgtagctcatcacatcatccatgctgatggcgttcttgtcatcgaccaagctggtcgaatcggcggtgttgttcttcgcctgcgcgcgttcggccttgcgttgcgcacgggaccgccgtttctcggctttcgcgcacaacgattggctggcagaggcggaacgcaacgtgtccagcacagaagcgtcatcggcagcgcccgattcggacgtgtcgtcatccgaatccagctggtcggcgaatcgcagcacgatctggtggaatgcgctggcctgtccggtgtgctcgctggcgtccgccaacgcggtcatcgccgcggacaccttgtcggacgcggttttgagcttctcattgtctttgatgccgacacgcacgtcggcgatcgcctgggtttcgtagctgccagccgtgcctgcggtggcgcccagttccttaagccgagccgtgtatgcgtcggtgaaatccatcgaatacgggatcatggccgcggacagctgcgattggccggcactgtagtctttggagccgcgctgttgttcctcgccggcgcgcttggtgagctcgttcaccaagccggatgtgccacgctgttcgatggtgcgaatcacctcgtcgacggcgtcggccgcgccgatatgccggtatgcggcgctcacgtcgttgacggcgttggccaggtctgccacggatttagctacggaggtatcgccgttcagttcggacgcggtgccgagaatggcgggaagctgtgtggcgttgccgatcgaaccggacagatgcgtggtgtatgagcccacgtacgcgtcgatgtagccgtcgaacgcctgatcgtgcgctttggaacgtacggcgatggtctgtttggcaagcgctttctcgttgtctctgagctgttccagttgggcgatgagcttgcggttgcgttgcgagccgacgttggtcagaccgtccaccaaggtggttgcgcgcttggtcaggtcaggcagtgattgctgaacgttgccttccaccgcggcgatggacagtgagctcatggtgaagtgcttcgccgtcacgtaggcgttgaaggtcaggtcctcgcccggtttgccgaccgcagccaccagggtcgaggtgttgtcggatgagacgagcacgccgtcatcggcggtcacgtcactgccgacgcgtccgggaatggtgaaggcgacgattggcgtcagattggcggtcacgtcgggtttcgtggcatgcagggcgatgcgtatgccgatcatgccggaagcgccggaaacgtcggaaacgcttacgtcgggcccgttgagggtgaaggaggcggatattttccacggcaatgcgacaacgcctttgggaacgcgtttcgacgtggaggatccgctgttggtcaggaaaaggcggcctggtttgtcgatggaggtgtaggcgctcatcacgtcatcatgcgatgcatcggccgcgtactgcccattctgttgcaaggccgatatcgcgtcgttcacgccgactgccgcgacgggagcggcggtgatgacggcgaccgcgatcgccgcggcaagcgggcgtcgggcaccggatggacggttcgcggtggcgtggcgcatgccggacctctcaatcgcaatcgaaacaactttccaaggcatttaatgtagtgcccggcatgcccgtcggcaatggacgttcgcgcggggcgcgcggaaaacggacggctcaggcgaaaacgtcgagtacgcccgggtctcccccgttttcggcgatgcgcttgtggcggcgcttggcctcggtcaccacgaattcgcggtacatttcggcgatttccggatccagtccggcttcgtcggcaatgcgatgcagacgctcgatctgggcatgttcacgctggtaatcggccggcgcgaagcccgcacgcgccttgagcacacccacctgcgacgtgtatttgaaccgttccgccaacagcgagacgatggcggtgtcgacgttgtctatcgattggcgcagcgaggcgattttagccaccacatcggccacttcggggttgttctgcgcggtgcgcgcgtcgatgatggtttcggattcggtttcttcttctggccgaagccagtcatgttcgctgtcgctcatgggtataagcctaccgcgcaccctaccgcggcatctgccgaacagcggtcacttcgcgaagtaacgctgcagcacgatggtggtttcggtgctgaccgacaccgtgcgatggatgaggttcaacagctcttcgagcttgctgggcgattcgacgcgaacggtgagcatgaagctgggcgaaccggcgacggaatcgcaggacatgatgccgtcgatgtttttgagcttgtctggaatctcggcttcctgggagtaatcgatgggcgtgaccgcgatgtaggcgttcaccgcaaggccgcggcgctcgtcgtcgataaccgccttgtagccgcggatcacgccgcgacgctcaagcttctgcacgcgcgactgcacggcggacacggacaggcctgtcgcctcggaaaggtgggacagcgtggctcggccatccttttcaagcatgtcgaggattacgccatcggtcgcgtcgagctggctcgcaaccgtacgtgcgtctaccggaccattgtcactgttggtcattcataccccttttccaacaatccactgcaccggccgcaatcgaccgtccccactgcagttccatgttctttttcttccttaccatacccactaccgcgcacataccgtcgcggaatcgccgcagtttatccggacggcgcaacgctgtcatgaaatatctttgttttatttagctcatacccccatatcgaccatatatatttttcccatttatcttttctcgtcgtatttttacctattttttaattgacaacgttgtccaaaaagtggccaatttcacgaaattcgtcgaaacgtacgcataggaaaggggctacacggcgattgccatgcagcccctcaaaccttcagattcgcttgcagccgacgactcagttgccgttggtggcgttgccgctctgctggatgagcgacgccatgaaatcgcggttggtcgctgtcttcttcaggcgtggcacgagcgtctggtaggcctgttccggctcgaggccgcccagcaggcgacgcagacggtagatgattggcagttcctgcggatcggtgatgagctcctcgcggcgggtgccggaggcgttcacgtcgatggccgggaacaggcgcttgtcggcgagctcacggctcaggcgcagttccatgttgccggtgcccttgaattcctcgaagatcacctcgtccatcttggaaccggtttccaccagcgcggaggagatgatggtcagggagccgccgttttcgatgttgcgggcggcgccgaagaacttcttcggcgggtacagcgcctgcgcgtccacaccaccggacaggatgcggccggaggccggcgcggcgatgttgtaggcgcgggccagacgggtcatggagtcgagcagcaccaccacgtcctggccgagctccacgagacgcttggcgcgttcgatggccagttcggcgacggtggtgtggtcggaggccggacggtcgaaggtggaggagatgacctcgccctgcaccgtgcgttccatgtcggtgacttcctccggacgttcgtccacgaggacgaccatcaggtggacttccggattgttggtggcgatcgcgttggcgatgttctgcagggtgatggtcttgccggccttcggcggggacacgatcaggccacgctggcccttgccgatcggcgccacgatgtcgatgaggcggccggtgagcttgttcggcgtggtctcctgcttcaggcgttcctgcggatacagcggggtgagcttgctgaactgcggacgatgctgcgcttcctcgacgctcatgccgttgatggagtcgatggactgcagcggcacgaacttctgacgctggttgcgacgttcgccttcacgcggggcgcggatggagccgtgcacggcgtcgcccttgcgcaggccgtacttcttgacctggcccatggagacatacacgtcgttcggtcccggcaggtagccggacgtacgcacgaacgcgtaggagtcgagcacgtcgacgatgccggcgaccggcacgaggtcttccttcggctcgtcgcgatgctggtcgcggtcagcgcgatccatacgatcgttgcgctggtcgcggtcggcgttgcggtccatgcggtcggcgcgatcgttacggtcgttgcgatcattgcgatcgcccctgccgcgacgctcgtcacgctcgtcgtaatcgcggtcacggacacgcatacggcggccacggcgatcgttgcgtccacggctgtgacggtattcgttgtcttcggtctcgtcgcgacgcttatcatcgtcggcgtcttcctgcgacggcagcgtggcgaggatgtcatcaaggtcgcgcacgacgtcttcgttcttcggcccgtccgccacgcgacggcggcgacgcggctcgaaatcgtccctacggtcgtcatcacgacggcgacggcggtcatcctgcttcggagcggcatcgtcaaggcccagttcggcgagcaggtcggcgccggcttcggcgtcacgatggcgacgacgcttcggcgcttcatcgttcggcttcaacgcgtccaccgctgccacggcatccgcgacttcggaggattccgcggacttggcctgcttggcacggacggggcgttcctcctgcttggcttcatcggccttcttgtcctttgccgatttgacctcagcgtctgcggcgggagcggactttggcgcgcgcacggtgacgccggccggagcctggccgccggaacgggcggcttgaagtgttgcgatcagttcggtcttgcgcatggtggagacaccacgaagtcccatctgcttggcgagctccttgagctcgggcagtttcatatcatcgagattagggcttgttgccactggtagctgcctttccttggcttccacaggcatgcgcccgcgacagctgtaaaaaagaattgcggaaaatttccgtcgaatgaaaagtccgccgcgaaacatcgcggttttcgaactgtcctaaccatacaacgcaacccagaccaacgcaaagcgggcacgcgcggtccgcccgtgcggttcgcgcaccgcgcaatcgcaataaaaatcgcaatgaaaaagcccatgccaaaaagcatgggcttgatcaaagttacgctgcgaaaaataaataacgcgtgcgaagacgcccgtctgaggccgaaggcgtacaaaggtacgtcgagcgccggagaaagggcatatacgcacgcgttatttatttttctacttttcttcgtggtaggacttgtcagtgttgaccgaccacacgttgtctttcgacgtttcgccgctcttgatgtccttgacggcttcgatggcggtggccatggagtggtccatgttgttgtaacggtgctgtccgttacggccaacgcagtacaggttgccgaaggagtcgaggtagtcgacgagttcgggcatgcggtcgtaggtgtcgaagtaggccgggtaagccttcttgacgcgttcgcggtgggagtcgagcacgtcctgcgggccgttgatgacctgcatgcgggtgagctcctggatggcgaacttggtggcttcctcgtcggtcatgttccagaaggagtcgccttcctcgcagaagtattcgaggccgatccacacggtgttgtcgacgtccttgaccaggtacgggctccagttgttgaagatctgcagacggccgaccttgtagcccggatcctgcacgtaaatccagcaatccggcacgatcggcgggttgccgagggtcggaatgtcggtggtgttggtcaggcgcaggtgcttgacgagcaggccgacggtgacgaaatcgcggtacggcaggccgttggcgatttcggtcatatccttcggagccggatggtcggaggcgtccacggcgttgacaaggtccttgaccggcatggaggaaatgaagtcgtccgcggccatttcggtgcggttgccttcggaatcctcgtacacgacggatgcgatcttgccgtccttctggcgaatttccaccacattggcgtcggtgatgaccttcacgccggcggcttcgcagttggattcgacggtttcccacagctggcccgggccaagcttcggataccagaattcctcgatgagggaggtttcgacttcggagttgtcgcgcttcttcggcaggagcttctggaaggcgttcttcagcacgcccatgatgctcaggcccttgacgcgctgcgcaccccagtcggcggagatttcggacgggtgacggccccacagcttctcggtgtagccctcgaagaacatggagtagagcttacggccgaaacggttgatgtagaagttctccaggttggtttccggcagcttgtgcaccatggacttcaggtagctgaagccggcgaccatggtgagcttgaagcccatggccttcagggtgttggcgctcagggaaatcgggtagtcgaggaagtggcggttccagtagatgcgggacacgcggtggcgcttgagcatcaccttgtcttcgatttccggatccgggccgcccggctccatatcatgctcgcggtggagcttcttgtcatcatagctgggtgcgccctgcagcggcagaacgtccttccaccagtccatgatgcggtcgtccttcgagaagaagcggtggccgccgatatccatacgattgccgtcatgcttgacggtgcgggagatgccgccgaattcgcgggtggcttccagcacggtcacgtcgtactgttcggagccaccgtccttgacgagctcccaagcggcagtcaggccggcagggccgccaccgatgatgaccacggattgcttttgcgtcactttgaagtctccttacaaacaaaatcgaagatattctacccgaaggtagggaaacgcacagcgcacctgtgcgcatgcacacaaaatcaccgccaagtccgacagcaatcgccctgatagaaggaaaaccagccgtacggcttccgccgaagactggttttccgtaggtccgctacatgctgtcgggaatgtcgatgtcggttttctgcacttcctcgacgttcacgtccttgaacgtgacgatgcgcacgttcttgacgaaacggctggaacggtagacgtcccacacccacgcgtcggtcagccgcacgtcgaagtagacgtcctggccggcggaacgcacgttgaaatcgaccttattggccagatagaagcggcgctcggtctccacaacgtaggtgaacagtttgatgacgtcgcggtattccttgtatagggacagctcggcgtcggtttcgtagttgtcgaggtcctcggcgctcatcgtctgccttccgtgtcgcgcttgcggccacgtccaagcgtgcgccaccaagcatccttcgaggttttgcgctcatccgagctgtacggccagttgttgtcggcatcgccggccttctggtccgtcttcgccgttccggatgcttcgttcggctgcgattcctgcgatggcgcggcagacgtctcgtcggcggaggtctgcgccgtgtctccactctggcctgccgctgcggcatcgtccgcatcgcccttatgtacggagttgagttggatggcgatcgagtgttcgcgggcgctcaacgcctccttgacgcccggattgtcttcgatcacgtgcatgccgaacgcgtcgagcgagcggatcgggtcgaattcgtcgacgagcgtgtccatgacgatgaggtcctggtaacggttctccgacgcgttccacagggcatcgcgcgaacggccggacggcacgaagccgagcgactggtagacggatacggaacgcgtgttctgttccggcacggccacccaaatgcggtgcatgccgaggcccgccggttccggcgcgaagccgtacgtcatcacgcggggcatgatgtctcgcgagtagccgcggccgcggtagtccttgccgagcaccacttggatgcgggcggaacgtgcccagccgtcgatgtcgatgaggaagatcatgccgatcacgttgtcggaagaggccgcgtcaagctcgccgtcgccgtcatggtcggtttcggtgacgatggaccatgcgatggtacgacgagattccggatcccccacgccggattcgttcgatttttcgccattggaccatgccacggaacgacgcacccacgcgttcacagcgccacgttcggccacgcggtccttgccggtgatgccggatgcgccgacgtacgcctcaatgacctccatgcgtgcgatgtcgtcgatggtggcggggcgcaagtgcaccatctcgcccttgatgggcggaatgacgatgcgttccggcagctccctcgcccgctggtccgtcgtctgttccttcgctgtggtttcagcgtactctgacatgattatcgtttcctatgtttctcggcgcggtccctcgccgcacccataccgacggtattgtacccgactgaacgccagctgggagttttgttaggcaaaatccccgtgaaacctccccagccgacgcgtgaatcgtacgaaaaggcatgtaaaagcagataaaaagcaacaaaatgcagaaaggcgtgcgtttttacgattcctctcatcgcaaaaacgcacgcctttcgatgccatcaatcaggcaacgttcggcaatcgccggaatgtcacttgatcttgcccatcacgatcttggtgacggccttcgcgtcggcctggccgcgggtggcgcgcatgacagcgccgataatcgcgcccatcggcttcatgttgccgctcttgagcttctcgacgatgtccgggttggccgcgagtgcctcgtcgacggccttttcgagcgcgccgtcgtcggaaacgacctggaagccgtgcttcttgacgacctcgtccggagtgccttcgccggcgagcacgcctgcgacggtctgcttggcgagcttgtcgttgagcttgccgtcggcgatgagcttctcgacctcggcgacgtcggccggggtgatcggcagctcttcaaggctcacgcccttgttgttggcttcgcgggacagctcgcccagccaccacttcttggcgcccgaggcggaagcgccggccttgacggtgtcctcgagcaggtccagagcgtcggcgttgagcacgtcgcgcatctccagatcgttgaagccccactcgcccttcaggcggttgcggcgctcacgaggcatttccggcatctgggccttcatctcctcgatgtgctccttggtgatgtgcagcatcaccagatccggatccgggaagtaacggtagtcgtcggcgtcggacttcacgcggccgccggcggtggtctgcgaggcctcgtcccagtgacgggtctcctgcagaatctcgccgccttcggaaaggatggcggcctgacggcggatctcgtactggatagtcttctcgatgccacggaacgagttcacgttcttggtttcggaacgggtgccgaacggatcggacgggctgttgcgcagcgacacgttcacgtcggcacgcatgttgccctgctccatgcgggcatgggagatgttcagcgcacgcacgatgtcgcggatggcgcgcatgtaggcgcctgcgatttcgggggcgcggtctcctgcgccttcgatcggcttggtcacgatttcgatcagcggcacgccggcgcggttgtagtcgaccagcgagtggtcggcgccttcgatacggccgtcagcgccaccgacgtgggtgttcttgccggcgtcgtcttcgatgtgggcgcgctcgatcggcacacggaagatggtgccgtcctcaagctccacgtcgaggtagccgttgccgttggtcggcttgtcatactgcgagatctggtaatcgcgcggcatgtccgggtagaagtagttcttacgggcgaactggctccattcggcgatttcgcagtgcagggcgagacccagcttgatcgcgtaatcgacggcggtcttgttgaccaccggcagggagcccggcaggccgaggctcaccggggtgagctgggtgttcggctcgccgccgaagtggacttcggccgggcagaacagcttcgtggtggtggacagctccacgtgggtttccagaccgatgaccgggtcgaacttcttgacggcatcggcgtacttcatcaacttttcagccattttgttttctttcctccgatgcttcctacttgtccagtccgtcgagccacggggtcttcagggactgccagatcgggccgttccagctttcctcgagggccgcttcgagagcggcggcgggcttgtacatgacctcgtcgcgctgctgcggggcgaggaactggaagccgaccggcaggccgtcgtcgctcaggccggccgggatgctcattgccggcacgccggcgaggttggccggaatggtggtgatgtcgatggcgtacatggccatcgggtcctcggtcttctcgccgaacttgaaggcggtgaccgggctggtcgggccgacgagcacgtcgaccttttcgaaggccttcttgaagtcgtcgatgatcagggtgcggactttctgcgcggagccgtaccaggcatcgtagtagccggcggacagggcgtaggtgccgaggatgatacgacgcttgacttcgtcgccgaagccggcctcacgggtgtaggccatcatgttggccgcggtctgcggaacgcctgccggcggcatgacgcgcaggccgtagcgcatgccatcgtaacgggccaggttggagctgacctcggacggcatgatgatgtagtaggcgccgagggagtacggcaggtgcggcagggacacttcgatgacctccgcgcccatttcctcaagcttcttgacgccttcgttgaagcgggccatgacgcccggctggaagccttcgccgccgagctccttgatcaggccgaccttgaggcccttcagatcgcgcttcatgccttcgcgggcggcggcgaccatcggacgcgggccttccggaatggaggtggaatcgcgcttgtcgtgtccgccgatcacttcctgcagcagggccgagtcgagcaccgtacgggagcacgggccgatctggtcgagcgaggaggccatggcgatcgcgccaaaacgggagacgccgccgtaggtcggcttgacgccgacggtaccggtcagcgagcccggctggcggatggagccgccggtgtcggtacccagggcgagcggagcttcgaatgcggccactgcggctgcggaaccgccgccggaaccgcccggcacgcgctcggtatcccacggattgtgggtggtctggtaggcggagtgctcggtggaggagccttgcgcgaattcatcgaggttggtcttgcccaacagcggcatgcccgcggccttgagcttctcgatgacggtggcgtcgtacggcggcacccagccttcgaggatcttggatgcggcggtggtttcgatgcccttggtgacgatcatgtccttgatggcgattggcacgccggcgagttccggcatctgcgacttgtcctcatcggacttggcgtcgaaggcgtcggcctgttcgagggcctggtcggcggagaccttcaggaaggccttgacgctcggttcggcggattcgatgaccgcaaggtgggcttcgaccagctcacggctggaaacttccttggccttgatcttggccgccatctcggcggcggaaagcttgacgagttcggtggtgctcatatcactcctgtcccagaatgcgcggtgcgacgaacatgccggcctcggagaccggggcgcctgcggtggcttcggcctgggtcagcggggtctcgggtacgtccggacgcaggtaggcttccagcgggaccgggttcgcggtcggttccacgtcgtcggtggcgacttcctggaccttgttgatggattcggcgatgacgttcagatcgccctgcagacgggtgatttcctcgtccgtgagtgcgattcgggccagatcgcccaaatgcacgatttcttctttggtgaaagtaggcatgaccctaacagtaacgcgtctgtgtgacgagcgtgtgccctatttcgtgccccgttcgcaacccggccgcgactggccgccatccgttcgacggccgttccgtcgcctggtcggcgagcacgcatccgctattgcggcaaagcgacgcttaacggcttttcttgccgcgtgccgatggcgcgatcaggcgtgcggcgcggcgtgctgggcgatccaggcgtgcatggagaccgcggcggcggcgccggcgttgatggaacggaccgagccgaattgggagatgtagaccacgtcatcggccagttcgagcgctttttcggacaggcccgggccttccgcgccgaaaagcatgaggcagcgtttggggaaatggtaggtttccatgggcaccgcgccgggaatgatgtcgagcgcgatgacgcgggcggcttgcagttctgctattttcgcgtccaaggcttccagttgggccatggtttcgcttgtgttcggggcagtgccggaagtgccgtccgtcgcggctgcggagccacgcatatggaaggcgatggcggcggcttgcgattgggcggcggcgatttcgccggcgatgcgcagtttccaacattcgacgagttccgttatggatggatggttttcgacgtgctggtacagctccgtcatgagcgcgcccttgcgattccatttgtgcgggccgacgatgtgcacgcggcgcgcttggaacgcgttggcggtgcgcaccatggagccgatgttgaaatcgtgggtccagttctccacggcgacttcgaaatcgtggcgcccgcgggagtccaggtcggctttgatggccgcgaccgtccagtagcggtagcggtcgagcacgttgcggcggtcgccttcgtcgagcagggtggagtcgaagcggatgtcgtaattgggggatgacgcatcgtccgggcgtggttcgcctggatgggtttgcgaccacggtcctacgccgacctcgcggaacgtcggttcgccggatgcctgtgcggcaacatcgatgggattgggatcgtgcacgttctccccttcataggaacagcaatacaaatatgtcaaaggcccgcgcatccgtatgcatcatcatgcttgtcatcgcacattcgacgacgtcaacggcagatatgtttgcggtcggtcggcgggaaactcggtgttcagtggagttcggattccttgaacacttcgacgaacggcagttcggattcctccgaagtgaccgggttgatgaccttgatggtcgggtcgaccatgtcgacaccgccgatcagcgaggcaacggccagcactttggcgccttcgttctccaccacggagaagtcgaggctcagctcgttgccgttgcgcagggtgaccagcgatgaggtctgcacatacgatttttcagacagccaggagtcgatcagcaccacgcgtttgccggcaatcgacggacccttgatggacggatagacgaagtccatgacgaaaccgtccaaatcctcaccacgggaggcggcggcctggatcatggcggagaccagcggcacggccgcggcggtcaatgcgccgaccgcgtcgaaatcgtcgacggaatagccggcttcctccaacgtgtcgagcaggatatggccgacgatggaggctccacgatggtcgaacagcacggaggagagttccgagaaaggcttgtccttcatttcggcctgcagcagcgtcttgagctggtcgcgaggttcgagcatggcgaaatcgacggtggattccgtcgaagcggaaacagactggcccgcagcggaatcatgcgtcggaaccggtgtcgtcttgcggaaagtgttctcttcggtcatggttccagcctatcctttcggctcgtcattcaccgtgcggtatgggtgatttatgagcgataaacatggttattcggcgttggtctcgggagcggacaactcgcggatatcccctttttcgggcgcgatcatgtcgacggtgccgatgaccttgctttggtcgacgcgttgcagtttgcgcgcggtgaccagcacgcgcgattcgagcgacgcggcgaacgagttgtatgcgccgaccgttttggtgatggcggaacccagtttggtggcccgctcccccaatactgcaaaccgttcgtacagctctcgggacaggtcgaacagcattttcgcgtcatcggtcaggctttgctgctgccatgcgtatgccacggatttgagcaccgcccatagggtgatcggcgaggtcagcgcgactttctgcgcgaatgcgtcgtccatcagtgtcgggtcggtttccaatgcggcctgcagcaacgattcgttggggatgaacgcgatcacgaaatccggagcatcgctgaacgcgttccagtaggctttgtctcccagggtcttcacatggtctcgtaccgctttggcatgggaatgcagcagctcgttcttgcgggccagttcctccggtgaggcggtgtctggaatctcgcatgcgcgctggtagtcggcgtatggcgctttcgcgtcgatcggaatggttttgccgcccggcatgtggatgatcatatccggccgttgcgtatgtccatcggcgtcggtgaccacaacctgggtgtcgaaatcgacatgttccaacagacccgccgattccacgatgttgcgcagctgcgcctcgccccacgcgccacgcaccttgttgttgcgcaatgccgatgatagggcgctcgtctcgcgatccaatcgcgcctgctgttcgccaagacctttgagctgttcgccgagcgctcccatctcatgtttgcggccctcttcgatttgcgcgacctttgtctgcagggcgtcgaggttcttctgcaccggagccagtgcggagagcaccttgctttgctcctgcagtttccgttcgctttcggcttgatgacggttcgcttcttcggcggcacgctgccgttcacgttccacgcgcatttcctcggcacgctgggcctgagccaattgcgatttgagatacgtcagctgttggctgaatccttccgcctgcgtacggtattgcacaacagccgcgttgagattgctgatgtcctgtttgtccgcctcgatctgcgccttcgcctcgttcaggtcggattccttcgcgccacgggccatatcctgccctttggcacggcccgcgaagaagcccgcagccgctccgagcgcggccatgatcaccagcaatatcactacaaacacaggattatcgaacatacgttcgatggtatcacgtcgtcaggaacacatcaatccacgcatccacattcattcgcaagaccgaccgcatgccacacaaccgtgcactatgctgaaatcagccgaacgcgaaatgcatcagcccaacacgaagggacattatgggattcgatctgtttttggcggccgtgtcgattgtggccgcatccatcgccacctgggcgttgttgcggctgtttccaagctcggacgcacgccaggcgattccgctgcggacggacggcggatttgccgacccatcccacacaaccgacggtggagtgacgatagacggcaaagtgacggcagacggcgaatcgacatccgacatcgacggacaacccaccgaccacctcggcaagcgcctcgtcatcgcgcttatcctgaccattccaacgttcgtcatcacattactggcgctggccaaaatcgccatgccgggctggctgacgaatccgtggccgcacgccatcgtcatcacgccggtcatgttctattgcgcggcgccgattcaccaccgcggcctgcccgcattgcagcggcgacgtccgaacggcgattcgctggtttcgcttggcatggcgattgtttacgcgtacagcctgctgctgtgcgtggtgtcgtggattttcccggccggctcgcgcgatccgtatttcgcgttcgtcggcgtggtcgcgacgctttcgctggctggcacgcttgtccggcaacacgcgatgaccgcgcagcagacggcagaaacagaaaaggcgcaatcggcacagtcaacagaatcaacagaatcggcgcgatctcaagcgaaatcccctgagccaacgcaagaaaaaagcgcggaagaattgctcttccgcgctgtggtaggtcatgagatccgcgcacgtgtgctgcagatcaccacgtcggtgacgatggtggtcgcggtgtggacgtgcgcgttgtggctggcgttcggcatgcaaccgaagctggcgatcgccatactgctcggttcgaccgtgctgtcggtcgcaggcctggtattgcaggcttacgaccgacaggtaaccaatcgataatcgtcactcagccgggttcgggacgtcggcggaatcgtccgtcttcccctcgcccatatcctccagctggtccgcggcccacgcggacagctccaggtggtcgccgccggtctggtccaccagcacggtgtcgccgtcgtgcacttcgccggccagcagcatgcgggcaagctggtcgccgacttcggtctgcaccaggcgacgcagcggacgtgcgccgtacgccggatcgtaaccggtgttggcaagccattcgcgcgccgaatcggtcacgtcgagcgtgatgcggcggtcggtcagacgtgcggacacctgcgcgacctgaatgtccacgatgccgccgagctcctcgcgggtcagcgggtggaacatgaccagttcgtccagacggttgatgaattccggcttgaactgcatgtgcacggcgtccatcacggccttcttcttggcgtccgcgtccatgtcgggattgacgaggaactgcgagcccaggttggaggtcatgatcagaatcgtgttcttgaagtccacggtcctgccctggccgtcggtcaggcgaccgtcgtcaagcacctgcagcagcacgtcgaagacttccggattggccttctccacctcgtcgaacagcaccaccgaatacggacggcgacgcacggcttcggtaagctggccaccctcttcgtagccgatgtagcccggcgcggcgccgatcaggcgggacacggaggccttctccatgtattcgctcatgtcgatgcgcaccatggccttctcgtcatcgaataggaagtcggcgagcgccttggccagttcggtcttgcccacgccggtggggccgaggaacaggaacgatccggtcggacggttcgggtcggagatgccggcacgcgagcgacgcacggcgtcggaaaccgcttggatggcttccttctggccgatcacacgcttgccgaggtactcctccatgtgcaggagcttctcgttttcgccctgcataagacggcccacggggatgccggtccagtcggagacgatttcggcgatggagtcggcgtcgacgcggtcggggaccatcggcacgtcggcgttggcattgtcggctccgcccgattccgcctcgttcttctcggcttgggcgatttccttctggatggccgggatttcgccgtagttgatggctgacgatttcgccaggtcgccttcgcgctcgtacttttcggcttgcgtacgcagctcgtcgagcttcttgcgcaggtcgccgatacggttgtggccgttcttttcggcgtcccaacgcgctttcagcccgttgagcttttcgcttttgtcggcgatttcctggttcaaatcggcgagacggtccttggcgctgtcgtccagttccgcttcggccttttccgtggccttgtcgttcttcggattgcccagcaggtacgacttctccatcttgagacggtccacctggcggcgcagttcgtcgatttcctcaggcgaggagtcgagttccatgcgcaggtgcgctgcggcctcgtccaccagatcgatggccttgtccggcagctggcgtccggaaatgtagcggttcgacagggttgccgccgcgaccagcgcgtcgtcgccgatggtcaccttgtggtgggcctcatacttcggcgcgatgccgcgcaggatggcgacggtgtcctccacgctcggctcgccgacgaacacctgctggaaacgacgttcgagcgccggatccttttcgatgttctcacggtattcgtccagtgtggtggcgccgatcaggcgcagttcgccacgggccagcatgggcttgagcatattgcccgcgtccatggagccttcggccgcgcccgcgccgacgatggtgtggatctcgtcgatgaaggtgatgatctgcccgtcggccttcttgatctcctcaagcacgctcttcagacgttcctcgaattcgccacggtacttggaaccagccaccatggagcccaggtcaagcgagataagcttcttgttctgcagggtggtcggcacgtcgccggcgacgatgcgctgcgccaggccttcgacgacggcggttttgccgacgccaggctcgccgatcagcacaggattgttcttggtacggcgggacaggatctggatgacgcggcggatttcctggtcgcggccgatcaccgggtcgagcttgccttccttcgcggcggccgtcaaatcggtggagtacttctccaaagctttatacgagccttccgcgtcggcgctggtcaccttgcggtcgctgccgcgcgcggcggtcagggcgttacgcagcttatccgcggtaagaccgttcttttccaagatgtccgcgctttgattaggtttcgcggccgcgattgcgaccagcatgaggtcgacggtgacgtactcgtctcccctccgttgcatttctttttcggcttgcgatagcaccgccgacagctgcctgctgacgtccggctgcgttgtggtcgatccgctggcgctcggcagcgattgcatcgcctgatgcacttcggcgctcacgttttgcgcgttgccgcctgccgcttcgatgagcgcgcgggccatgctgttttcctgacgcagcatcgcgtccagcaggtgcagggtgtctacctgcggattgcccagcgccgccgcgttctgaacggcgtccgaaagcgcttcctgcgccatctgcgtgaacttctgttccatatcatcctccatggttcgcgcccggccgcccggccttcgctaccgggccggcgttcggacgcatatgtcgttgtctgatatgctcaaccgacttcatcgccattatattcccaaaacttgagtcccacacgctcaactttttgcgtttctcaaaaccgtctttcgacacaggacggcagtcaccgacaatcaccagcgctcaccggcaatcgcaatacatacgaaaaaggcgggcagcaacgtaacgaaatcacgaaacgttgcaaacccgcctaatccaaagtccgccagcaagccgaaaatcagccgcgcaccaccacgttgcgcagatcgccgatgccctcgacgtgcacgatcgcctcgtcacccggatccagatgacccgacgcgttcggcgtacccgtcataatcacatcgcccggcagcagcgtggtgaaactcgtaatcgccgcgatctgctcaggaatgccgtgaatcagattcgccgtggtacccgacgccatcggcacatcctcaccgttgagcgtgaaggaaatcttcgcatccttccaatccacatcgtcacgcgtcacaatccacggacccaacgggcacgccgtatcaaaacccttcgcacgcgtccacgtcggatcaaggccctgcagatcacgcaacgtcacatcattcacgcacgtgaaacccagcacataatccatggcctgctccaccggcacattcttggcgatacgacccatcaccacagccaactccggctcgaaattcatatcattcgaacacagcggaatcacaatcggatcatccggaccaatcaccgacgtgctcggcttggtgaaaatcaccatatcctccggcgcatgcttgatatcggaatgaccggcctcatgcatgaactgcgcatgcgcctcataattcttcgccaaaccgtacaccttcgacggaatcaccggagccagcagacgaatgccgtcaccatccaccggatagcgctcgccggtcggctcgacggcctggccggacagcggatagccgttcaaggccacaagatagtccttgccgtcgttcttgtcggtctgaacgaaggcgtactgcggtacatcattatgcgtaaaacgtgcgattctcatacccgcaagtctacccgctcgccacgcccgccgttctcgacatgcgtcgctttgcggacgatgccgattgctcgcattttttacgatttttgcgattatttgcgatgcagttccgcccgcaacgccgccacctcgcgttccagctcgtcgatgcggcgcacctgctgggcgatgagcaggtcgcgcacgtcacctcccgacagaatcgggacttcggctgcgttgcgcggcgcgggcagcgtcgcattgctttgcgtttccgtcgtttgcgttggctgcaccggctgcgataccgcagatcgagcaacctccgcagattccgccgacggcgccacatccgccgacgccgatggcaccactccaccattcccatcaaccgataccagccggtccgtgcccatacggcaggcaatcttgcgccagcgcgcgaaacaacgttcgatgcgcttatagccgatcagcgatgggtcgagtccggcttcgcggaacagttcgaccggcgattcgcccgcatggtaccggcgcatgcagttgtgtttgaacgattccgtgtaggtgatgcgtcgcgacgtcgcttcggccaccaccggcagcgagcgcagatattcgacttcttccggactgaacgctcccccaccgttgcacatgatgttccctttcggcttggcgtgcggcggctcccttccaccgcacggcagtcgaatggcctccgtcatgccattcccctgttcggcttgcgattcggtttgcgatacgtgcttgcgatacgtgtttgcgatgcaaggccgcaatccgattcgttgttcgcttcgtgttccatcataccggtacgaatggcgtttttccaaccatttcaggcggcactaaaccctaaatcacccgtattcgtcacaacaaaagcgggtgaaccgttgatcgctcaacgactcacccgcccgaacaagccccgttgcctgtctgctggcccgctcagaccgccatcggcgtatcggattcgcggaagcgcagcacgagcgccagtccggctccggccattaccagggccgcgatggtgaacaacgcggtgcccattgcgccggtgagcggcagctgcgtgacgttcttcacgttcttgacctggattgccttgtcggacatgccctcgtcaagcctgcttgccagaccgaggttgttggcgccgaccagcttgaaggtcgacttgccggtttcctggttcacagctagttcgacggtgaagatcggcacaaagttcttcgcatagccgctcgcgaatccggtttccttcagcgtgtacttgccggacttcaagcccatgattttcacgtcgccggtggtggtttccacatccgcgacagcgccgttctcgttcgcttcggcaaggcggtattcgccatccacaatcttgatgaacttgagcggggtctgcgaaacctcggttccctcgaacacgtggaacttcgctcctgcgagaccattggcatcgcttccgacaccgtacttgtggaaggagaagcccccggtataggagtcgaattcgaccggcgtgttccacacctcggtgtcacgggacacggccgccttgttggtaaccttgttgcccatgtcgatgatgtccttgtcgaccacggcggtgtaggtgatgaccagctggccgctcttgttggccaagtcgaatcccagcacggtggtggtcttgccgtcggctccaacggtcggaacggtcacgtaggtgaacggcatattcgtttccgtgccatccgcggctcgaacaacggccttgaagtccttgttgaccgtcaggcccttggatgccacgtccttcacgaagtacggatacttgtcgtagccttcggccgcgttcggaatatccagcgtgatggtgtaggcgacggtctgcccaatgctcacgccttcagtggtggtaatcgtatcggccgtcttgcccggctggtcgggctcgttctcgttcttggccacaaacatgccgacagcgttgatcttgccctggccggttgccggatcgcccttcactttgaatgtggcggccacgccgttcagcgtggtggcgacgatggcattggttccccgaccgccgtccttgtccacatcggtgatgagataccagccttcttcaagcgaaccgatggcagccgtaccgccgttgcctgcaacggttttgtcggcaacgacgccatcgccaaccgccaacgaggccgcgaatgtgcggaaccaggcggcgtcgttatcgccggtcttggttgcggcgaacgcggccggattgctgtcatattcggagggcatgctgacaacggggtccatgttgttgttggcggcggccaccgcgtcggtcaccgcagtcacccaatcggcgtcggtgtcgacctgcacggcgtcgccgtccaccgtcagcgaggcgaacttgtacgcggagtaagtgtgccccttctgcgaatgccgcacttcgatcgatgcgctgccggccgcatacgctccggcggtgccgaacgccataccgcccagcaacgttgccgccgcggcgattactgcacaaagccttctcgtcttcatgatgagagacctctcttccttggtttggtcggccttgttaccgcagccgattggttggttttatgggaagtttcgtatattgtgttgttctttagttgtgattgaaaaattgcgattgccggattgcgatcagagaattgcgattgccgtccggcagttccgtcacggccgtccgcgcccgatcaaagccagtccgacgatgcccgcaagcagcagcaccagtgccgtgacgccggccacgaccagccaggtccgtccttccgatgcgccggatagcggcagcacggccaccgtctctttcacgttggtgaacgaggcttcgtaggtggcggtctgtcccttgtcgaacgcgctccacatgtcggctctggtgatgctgatcggcactgaggtgacgttgcctttcgcgtgatagccggcgatgttgccttccgtgacggtgtagtcgcctgccatcacgccacggaatgtgtactgccattcgccggtaggcagctcgtcatcttcggaaaggtctttgcccagcttcgatgcgccgccctgcatgaaatcgatgcgcaatgtggttccactcgccggcattccgccttcccaatgtttcgtcacgaccacgttggcggacggcacctgcaatacgggatgctggtaggccgcgcaggcggactgcttgtcgaaggtgtaacagacctgcgccgacgcgttcgatcggaagcccggctttcctgcggaagtcgtgccggtgcccgcgtcgccggtcgcgtcgtagttgatgccgccgtcgaccgtattgacccgcgcgtaggcgctgtcggttggcactatgccgtacgagagcgtgtaggtcgcgttgtgcagcagctcgtaatcgccggcgaattcgacgcggatcttgccgttgccggcgtcgctgtaccacaatgtgtaatcacgttccagcactggaggcgtagcccccgaaggcagattcgtcacgttgagcgtcacgccgccggtcacccggcagtaggtcgctccgccgaagttccgcatgctggccatgttccagacaacgccatcgacctgcgcgtattcggacagctcgtcgacgatcgagacgccgctgtaggcgcttcccgtggtgatttccttctgaatgtcgtcgaagatcttcgtcaggtcgtcagcgctgttggtggccttgtagtagccgaggttgccgcccgtaacccaattggctttgtcgtacgcggtggcgttcggatagttgctggatacggcgtgcatgaactggttggcttggtcgttctccctgttaccgaacgattgctgctccggattggcgccttcgaagatgccgatgctgtagatgagcgtgccggccgatttcatggcgagcgcggttgtcacggcgtcattggcgactctcgtgctaaaagtgttttgcgtggtcggcacaccgtccgcgaagaaaatgacgattttcttcgcgcctggccttgcccgcagcaatgccgtctacgcggcggccatgcctttgtccgcaggggtcgcgccattggcggacagcctgctcaccgatgatttcagagcggcggtatcgctggtcagggaactcaccacgccggatgtctgcccgaattgagcgatggcgattcgcactttgctgttttcgtcctggatggtgtcgttggtggtctcggtggcgtcgatgaagctggtcgccgcttctttcagcgccgtcaaccgcttcggattcgatttgttgcatcttctttggcttccgtccatgcagtagttcatcgatccggacgtgtccagtacgagcaccacttcgattttctccgtggtctcatggctttcgcgggtatccttgcccaccacgttgaggttcagcgtgtatttgccgccgttgttgtatgtgatgcttttcgtgtggtccggctgcggcacggcgacgttacgcgcggcacgcatcacggttttgcgattgaaggtgaagcgatcgcgcatgatgtgttcgtcggcgtcggtatcgtctttggcagcatcattcttgtcgttatcgttgccgttttgagccgacgcggcatccttgtcggcgtcattcttaccgttcttgtcggcatcgtcggcatcttcagcagtgttgccatcgttgtcagcatcgtccgcatcgccggttttgccgtcatcggctgtcgcgcccgcatcgccattcgccacagcatccgtgcgattttcgccggcatggtcgtttcgatcgccgtcttgagccggtgcagcaccatttgcaggtacgtcagcgttctcagccgtcggctgcctaaccgcctgccgttcctgctccttctgctcattcggctgttccgtcttatcgcacggctgccgctgttccggcatcgtctccgacggttgttccggttgcgattgcgactgcagttgcgattgcgcttgttcgttcgatggctgatgcgattcgccgtcgtccgtaaggcattgtgcgtcgtcatcgtccgttgcggactgtccggcaacatcttgcccggcaatgtcggcaacgtccgatccgactgcgttttcagcatcggattgttgtgtcgattccggctggctcgctgcggattcggcggccacgttgccgccatccgtcaccgtttcgtcggcgaacgcggtcgcgccggctcccgtggtgccggccagcatcgcaatcgtgacaagcaatgcggtgaattttcccatccgcgcgccacaccggcttatgaagccggcaagcgggtccttcatccacttcatgacatgtccatctctcatggcgctgcggcgaattgcctatgcgcctccatgccttgaaccttatggatgaacgttttgaaacccgtcccctccattgatgggttcggggaacgtacggacccgcgaaaatcgcggccttcccccttatcctttacgcggccaggcgaaagcgtgccgcatgattcggtgtcggggccgcatcgaccgcacgaccatgcagcacaacagcatgccgcccatcgtgcaaacgatggtcatggcgagcgcgcccagttcggtcgcacgttcgtcgcgcacgtcggccggatctggcgcgggcagcggtattgcgacgcgatgcccggagactagcagccgatgcgtgttgatgccgtatggcgtgcaggtcatcaacgtcagccggtcttcgccgggcacgattttcaaccgtgagacgtcgtccggttcgatcacgctgattcggtccacttcgtatcccagcgtctcgtccatcactttgatgtacatgaaatcgccgtcgtgcagttcgtcgagccgtgtgaacatcaacgatttgaccaggccgcgatgcccggtgaccaccgtatgcgagtcagtgccgccgaccggcaggctggtgccgtacagatgccctgcgccgacggcgagcaccggttcggacgtaccatgccgaatcggcagttccacaccgattttgggcaccaataccgtgcccatgatgcctgcgccggaatccagcaggccctgatagttcgcgtccgtgtccgccgcggaaagcccggcaccgccggaatgtgccgaatcgtcggcggtatcagcatctccggaagtgccagccggtctggtagtgaacggatcggccgcctcgcccaataccggctgtccttccacggcaagccgccgattgtatgcgcgcgcccgttccaactcctccatcgccatcggatacggccatccggcaaccgtgcgagccgccgaatcggatgtctcggccaagcgccgcgcggaatgcgcatgcatggcgaacggcaacgacgcgaccaccaccgcgcccacaatcagcagcacggacacgcaccgcaccaatatgaaacgaatccgccgcagcctgcgcgcgcgaaccacatcggcaatgtcaatcgcctcgtaaaacgacggcgttccagcgaacgttccagcagacgttccagcgaacgcaacagttccggcatgaccactgtcggcagctgcatcggcatcagatccgactccggcgccattgccgatgccatcgttatcatcaccggcatcataggaatcagccgaggcgcccgccacggcaccgaacagccgcatgggcgaacgcagcacctcatgcgcatgcacgtaggaatccgtcctgcgggcgagcagacggacgggtttactcatcaatcgagaggcagaccaaaacatgggtttctccttcgaacacacccatgttcacacccgccatacgaaagcccttgccccctataggagggcttacccctagaaagacaacggtttcaggcacgaaaccggcaattttggcaccaaaccgcgcagcaccccacctaccggcggaacgcagctcagacaagccgtttttcagaggaatgcaagtcagacgaatgtaagccagacgaatgcaatccaggcggacgagccccgcaaatccttaaaaaacagaaaaagtcaaagaaagcgctcagatgaacgcacgctcaccgaaaatcgcagtgccgacgcgcacgatggtggaaccttcggcgatggccagttccatgtcgccggtcatgcccatcgacagttcccggcaacggtccgtgcccggttcgccggatgcgaggatgaggtcgcgggtcttgcgcaggtgcgagaaaccgcggcgaatcaccgtttcgtcgtgcacatgcgcgccgatcgtcatcagtccctgcaattcgatgccgtccaacgtgccgattttctgcgcgatgcggatggcgtgcgccggatcgcaaccggatttcgattcctcgccggattcgttgacttccagcaacacgccgacagtaataccgcgagccacggctctacgtgaaattttttctgccaaatcgattgaatcgaccgattcgatagtgtcgaccaccggcagcactttgccgattttattgctttgcagctggccgatcaggtggaatggaatatgctccgccgcagcatccggcgcggcgcctgcgacgcccagcgaaaacccgcgttccgcgcatcgccgtgccagcccttcggccttcgccgtcacttcctgcggacggttctcgccgatcatgcgcacgccggcatcaatcgcagccatgatttcgccgatgtcgcgcgtcttcgtggcggccagcaggcgcacggagccggcttcgcgtccggcttgttcctcagctgccgcgatgcggtcgagcacacgatgcacgccgtccgtgatctcacgtgcgcgcgcatcgtcgatcacctcgttggcgaggttcttgtgatccatgtatgcagtcatcgtccacctctcgcaaattcattcgaccgccggtccgcggccggcaccaccgtttccggcatgtcggctgatatttcgatatcagtgttaccagaaaaccgccgacaacgtataaagaagcccgcgcgatgacctgaagtgaagcgataaagcggtcataaattcgcgcgggctataaaactagacggcagcagaagggggacttcaaagactccgtctgcacatttaatgtatcagataaatgcgcgcgaaccgccggaaaaaccaataaatctgaaaactttttttcagattttatcccccttgcgtagtccctccaccaaacgctccaatttatcgacgcgatcactcaacaccatcacctggcataccagcgattggatcttgcccaacggcacttccgacatcgcattgtggctgtccacagccgtatcatgcggttccggctcttcggccgccttgcgcatgatgtcctcgtcacgcttccagcgtgcgatattgcgttcgatgcgcttgtgcccgatgaccgatgggctcaatcccgcggaaatgaagatcgcagttggcttctccccctgcagataccgcctcatgcagtcgatttggaattccctcgcatacgtgattctgctgtccgtcaccgcgtcgatcgacggcaatgtacgcaggtattcgatttccgctctactgaactgtcgcttcgtcatattcgccccttgtaaatccccttttgaccggccataccgataacgcatagaccgaattgccgaaatcaccacccagaataccggatgacgcacatcaccttacgcacaccccaaacgaaacgcgcggcccgtatcaccatgcgctaaatatccttctcacactgtgagatacctcacagcgacagcacgtttccggagcacgctgcagcctcggcatggcacgtcaccgcacgtccagcaacgcattccacaatcgcgtcccacgaaacccgccgttccggccgccgatgcaggtacagttgcaagcatcggcgcgaccggtctccgcaccggcaacaccgaaccgcccgccaacgacaggaaggaaccccgtgccaggtcgtttcgcacccaccccatcaggccgcatgcacatcggcaacatctatgcgatgctcggcgcatggctgtccgcgcgtagccgcggcgacggcatgctgctgcgcatcgaagacatcgacgaaccgcgcgtggtgcccggcgcggccgaactgatgatggacgatctgcattggcttggcttggattgggacggcgatccggtgttccaatccgctcggcacgacctgtaccgtgaggcgctgcattgcttggaaaacctgacgattgacgacgcatacgattcgccgtttgacgagcgcaacgaccacacccccgcagtcggcagcgcagccaacaacgcaatcgctggcacaaccccgctgatttacccttgcttctgctcgcgcgccgacatccgcgcagcctccgcaccgcaggaaggcgaccgtttcatggtgtatcccggcacgtgccgccggcttatcgccagcaatccggataccgtccggcggcggctggccaacggcgaccgccattcgctgcgcatcgccatgcccgccgacacaaacccgcacgcaaccgtccaattcgatgacgcagtgttcggccatcaggaattcaatctggcgcacgacgtcggcgataccatcgtgcgccgcgccgacggcctgttctcctaccagctggtggtggtcgtggacgatcttgacatgggcgtcgacgacatcgtgcgcggccgcgacctgctccggtcgaacgccttgcaaatcgccattcgccgagcgcttatcaaggcgggattccgcaaggcgaaaacgcaggcctctgcaccatcgcagcacgcaccacaatcgcaatacaccccatataaccccgaaaacccacggtacgcgcatctgccgcttatcgacaacgcggccggccgcaggctcgccaaacgcgagcgctctttggatatgggggcgctgcgcgcgcatggcgtcaccgcggaacaggttgtcggctattgtgcgtggctgcttggtttgcagggcgattccgcgcataccagtccgcagccgatgagcgccgtcgaggcgttgcaggagttcgattggggtaaggtacgggccgatacggccgaccgcagtatcagccaagacgatttcgacgcgtatttcggcctgtgacaacggctggccgggtctcgccgaattgccgagacgacccggtcagtccgggaaacagcagaaagcagcagaaaataacgggaagcagtcgacgttcagccgatccacagctccgagtcaagcggatattcgttgaccttgcagccgtccaaatgcatggattgctcctgcatcagcggcgccaactggccttcgccggcgcaggtcgtttcgttgtcgatgtgccccagccggtgtccgacctcgtggttgatcaccatcgtgcggtatcgcgccaggttgccgccggcggcgagccattgttgcgtgccgccgttccaacggtcgtcgttgacgatcacgttgttgtcgaccctgcagctgtattccaccgagcatgatggcgagaacgacgtcatttccgatgcttgggacagcacgagattgaaatcgcagttgccgtccgtggattggtcgaatatggctccggcgcgtggccatccgtgttcatcgttgaggatgcggaacgccgcgttgccgaattcgtcggccgaaccgacgtttcctttggttgcgatgcagtaatggtattgcgttaccggtttgccgctgttttgcgcggtttcctgcgctttgttcagaatcgcggttttctcgtcgtcgcccagtgccgccgattgcgcgctcaccgctttggcgacggcctgctcttcctgcgattgtttggtttccggtttggtttttttggccgtcttatgctgattggttttggctgttttcttggctggcttcttggccgacgtcgaatgcgtggcttgtgccgtcgtctgcgtgttcggcgtcatgcggaccagtagtgcgtgcacgctgcaggacgtcatcgatgcgatcagcaggaacagcacgagcaccagcacggcggccctgcggatgcgaaacgcctcaagccgttcccgttggcccattgtggcgtcggctttcggatcgagcgcacgtatgatacgacgaatccgcttcaatccagcctcccgatatggtgatgtttctctcttcggcaacagtaccagtctcagtcaacatgccgaagccgccgaccgccatgcataccacctatgcgtaaggcccgtggttccggagggaatcacgggccttaccagcatgccagacgaatgccggcaatcgtcaaagtaatgctcaggcgaacagcaccttgaacaggaacgcgccgacgatcgcgcctgcgatcggggccacgaccggaatccaggcctcgccccagcgggaatcgcccttgttcggaatcggcaggatggcgtgcaggaggcgcggcatgaggtcgcgggcagggttcagaccagggccggtcgggccgcccatggaggtcacgaggccccacacgatgaagccgacgacgatggacgcggcggccgggttcgccttgccccacggcagggacaggcagcacagggcgccgagcaccagcatgaaggtgccgaagaactcgttgaggaagtagttcacgcggtcgttgtgcgcgtcggtggtgcagaaggtgccgaggatggcttcggcatcgtcggtgtccttgtagtgcggcaggtaggtgacgtacacgatgagctggcccgccactgcgccgagcagctgggcgatgatgtacggcaggacctcgttccacgggaacatgccgttgacggcctgcgcgagggtcatggccgggttgatgtgggcgccggagacgccgccgaacatcaggaccgggaacatgacgccgaagccgtagcccatggcgatgttcagccagccggcatggtagcccttggtgtttttcagttccgcgttggcgacagcgccgttgccgaagaccatcagcacggcggtgccgacgaattccgcggcaagcttggtgaagagtgtgtattccactgcagtttcctctattgcttcttctctaacgattcttacgattcgtgcgattcgagatgaattgcgattccgctctgggcggacaacagcgcactaccttactccgtacggaggaagtaatgcggctttgggtggacacatgtccgaaatacgaaaaagacccaagtcattggcttgggtcttgtctgtgcccctcagggattcgaaccctggacacgctgattaagagtcagctgctctaaccaactgagctaaaggggcgttggtcttggcgaggtttttgttctcgctgagcacatggagtaaatatactcagaatcggaaagaacgcaaccctcggcgtgtcgcaatcataaaaccgccattttccaacgttttcagcaaatcgccatctatggtgcacatcgcgtcatacgacgaaaaatgcggcgcgatggcgccataaaatccaagtaatcacattttcttcacattctgccgcaatgcaaccactccgacagtcaacggcacgaacttttccatcacacatttccaccgcggcgagccgaatagcacgcatcatcgtcgagcccgtcggcgcgccagaggccctttataataaggaccatggcgcgtcacaggagtatataacgcgcatcaagaaggagaaaggcttacctatggcatgcccaaattgcggtcagccgaccatcgaaggcgctaaattctgcgcctcgtgcggctcaccgctcacccaaacgaccgcggcggcaccgcaagcgccggccgcgccggaatccgatgacggcaccatgctgtcttccgcgccgcacatggcaccggccccgcagatgccgaccgctgccgtcccgctgcccaatagcgccgcaccggcagctccgcaaaccaccgtcccgcagcccaccacaccgcaaccggcggcgcaagcacagccgaccgctcaggcgcaggcaacgcaaccggtggcaccacaggccgcgccgacgcagcagttccaatacgcgccatccccggccccgcagccggcagcagcgccgcagccaagccagccgacccagcaaatcgcccgtccggcggccgatcccaccatcaccgcgctgaccacaccgcagtccatgaagaccatgggcgccagcctcggcatcggtctcggcgcgagcgtggtgttcgcactgctcgcatcaatcgtcttcttcatgggcaatgccgcggccagcaacgggcttgccggcattccgggcttttccgacaccgcctccttcctgggcaacaacggtgtgtccggctccggcccgaatttcttccagattctcttcaccgtgatgacgctcggcgttggcggttcgctgaatctcaaaaccagctcccagggcttctcgctgagcaatctcggcattgacgcctcgcacgtcagcgtgacgctgccggtcggactgcccggtgtggcattggcgatcggcgccgcgttcggcgcatacatgctggcacgcaggttcgcgcttcgtttcaagtggacgggcgtcatcagctcgctgatcgtcggcgtgctgtccggcctggtgctgctggtcttcgccgccatcttcccggtgacggtgggtggttcctacagcgactattccgcttccgcgtcgctttccggcgtgtccttccgcacgttctgcatggcgttcctgctgtcggcggccggtgcgctggccggctacgcgttggcacagtatgcgggcgattcgggtaacgtcttctccgccgcttggcgttgggcgcaccgcgctcgtggcttcgtgcgcacgctggtcgaatcgtttgcgatctacggcgtgctgttcctggtgcttggcctggtggcaacaatcgccatgtccgccgcgaaccatctcggcgcaggcggtctgctgctggttccgctgctgttcccggctctgccgcttatgctgatttcgctgtcctcgttcggcggcatcgccttctcgacgtccagctacagcgcccatacgatcacgttgttcaacgtgtcctccctcagccagtatggctggattctgtggatctgcttcgtgctgttcctgcttgccacgttctatatcgcgctgcgtgagaccgcgcgcaatatgtacgacccgtattacgcgggctggcagcatacgtggaaggctccggtggccgcgatggtgttctggctggccgcggagttcctgttcacttatttcgcggcgggatacgcctcgtccagcatgtcgatgacgaccccgatgtggtatttcctcgtcgccggcatctgggcgttcctgatcgaggtggccgcgatgacgttcggtccgacgatggtggcgtccctgccgggcatgtggcggatcatcgtcggtggcaccgtgcagcagaccccgcagaacgtggtcgattacgtcaagtcctgcgatccgtcctacggcatgaagaagacctctgccacggcgagcggcacgaccgcaacagcgaccatgccgacggcttcggctgccgcacagccggccaatccaactactccggcagctccggccgcatcggtcccccagcccgcgacgccggctgcgccgatgcccgcgcccaccgctcctaccgcaacgcctgtttcacaggccgttccacaaccggtcgccccgacgtccatgcccaatacgacaacgggcaacacggcaacgggtgcggtgccgctgccgcaatcgccagcaggcgcggcttctatgccggtcgcagctccgggggcaggtcaaccgctcgacccaaaaactaagaagacgatccttatcagcggcatcgtaattggttccctgattgtgttgggcattgtctacggtgtgctcaactcgaccgtcttcagcgcgaaatccgtggcgcaaagctatctgacggcgattgccgacggcaagtatgacaaagccaatgacatcgccgatccgcaggtggacaaggaccagctcaagctgctgtccgacaccgtagcgaaggccgacaacgccacgatcgccaacccgcatatcgatagtgtcaaaaccgtcgaaggcgtggccaaggtcaacgtgacgtattcgctgaacggcaagaacgtcaacgattcgctcaccatcaacaaggacgggtcgaagttcctgctgttcccgaattggaagatctcgagcccactgctcaagaccatcaccgtgtcggtgcccaatgccgtggaatcgttgtccgtcaacggtgttgacgtgaccgcgaagaatgcggagaagtcggacagcagtacgtggacgttgcgcgtctacccgggttcgtacaaggtgtcgatcggcaagtcagggtacgtcaccagcggcatcaccatggtgcgcacgagcgcggactccgatgccgccgatctcaagatcatgcctacggccaagcttaaggaggacttgagcaaggccgtgaacgccaagctggacgaatgcgcgaagtccaccgactacgcgccggaaggctgcccgttcggcttcgacctgtacgacgaggactactaccgcaacttcgcatggtccatcagcgtctatccgaaactgtccgacatcgatctcgattacggcacgttctccacccggcagggcaaggcgaagtgcacgtatgaagagaagaatttcgacgattcgtgggagtctcaggacgacagcacccacttcaccgtcaacggcagcttcagcatcagggatggcaagctcagcgtcacgattgacgatgaggactgatgccggctaaagagcggatataggaaaatcccccgcaccaatcggtacgggggattttcgatgcttaagctcagacgtgtttcagcctgaagtcattcaccgccggtccgtaaggacgtcgagcggtgaatggggcgaaatcactcagcgacgaccttcacgaagaagttggcggtgatttccgggtgcagggcgacggttgccgggaagtcaccggtggtcttgatcggctcaacggtgatgttcttcgggttgacctcaaccttggaggagagcgcgatggcgatcttctctgcggagatgccgccgaacagcttgccggactcggagaccttggcagcaatttcgacggtggaaccctcgatgatttccttggcggcaacagcctcttcgcgggtggcgacggccttggccagacgagcgcgcttcatggcctcgatctgggcggcggcacccttggaccaagcgaaggccaggccctgcgggaacaggtagttgcgggcgtagccggacttgacggccacgacgtcacccgggtgacccaggtgattgacggacttggtgagaataaccttagtttcagccattgttcaaacctctctaagatcagcggccggacgtggcgtacggcagcagggccatctcgcgggcgttcttgatagccttggagatctcgcgctgctcctgcacggtgacaccggtgatacgacgggaacgaatcttgccgcgatcggagatgaacttacgcagcagggcgacgtccttgtaatcgatctcggtgaccttggcggccttcagtggattcggcttcttcttaaacggcttgaccggcggctgcggcctcttgcgtgacatcttgatgttctccttaaaatctggaaatactgcgattaagctgcttgtttcgctgttcgcctatgttgcggacggggttcggtccgtcagaattccggttcgtcgctgtcgccgccgaattcggaggaacctccgaaggactgggacgcgccgaaggaaccgaaggacgagccggagttatccgagcttgaccacgggtccgaggccggagcggactgtgcgggagcggcgttgaccggagcggaggctccaccctgatatccggcgccgccagcatagctggagccaccctgatatccgccgttgttgccgccgaaaccaccgttgttgttggcgttgttgtagccgccgcgattgccgctgaagcctccgttgccggacgagctttgacgggtcacctgggcggtcgcgtagcgcagggacgggccgatttcgtcgacctgcatctcgatgacggttcgctgggaaccgtcctgcgcctggtaggaacgctgctgcagacggccttgcgcgatgacgcgcatgcccttggacagactctgcgcgcaatgttcggccatgtcgcgccacgcggagcagcgcaggaacagggcctgaccgtcttcgaactggttcgagttacggttccaggtgcgcggagtggaggcgatcgtaaagctggcaacggcggcgccgctgccaatggtacgaatttccggatcggccgtgaggttacccaccacggtgattacagtttcacctgccatgtcgttacctacttactttgcagcttagaaagcttggtttacttacttgcgaagaatcttcgtacggatgacggattcgttcaggttcagcagacgatcgagttcgtcgctggtggccggctcagcggagtagttgaccacgacgtagttaccttcggtcttgccggcgatttcgtaggcaagcttgcgacggccccagatgtcgatgttctcgacggcaccgccttccttggtgacagtttccagatactgctcggtcagcttcttcagaccgcgctcatccagctcaggatcagcaatgaacatcagttcgtacttatgcgcagacatcacccacctccttcggactatcggccatggaccttccatggcaggagtgtgtatgcgtgctgccttcaggcatcgataagtcgcaatgaacatatggatacgattgatggcaacttgtacaggctaccccgacgccgcgacgtatcgaaacggcgtctgccgggcgcgaaatcacgtgcggaggcaagcaaaaagccccgctcgcaagcggggcttaatcgcaaaaaatcgtaataaatcctgaaatatcacgatagccgtatggcaatcgcacgaaatatcaggcgtagatgttgcgcggacgcatgtcttcgggcaggccgttgagcagcgtagaaacggagccggattcgaacacggagcggatgccggcggccagcagcggggccacggacaggacggtcatgttcggcaggcgcttctcttcgggcaccggaacggtgtcggtgaggacgatttcgcgtgcgccgcagttcttcaggcgttccacggccgggccggacagcaggccgtgggtggcgacgagcgtcacggacttcgcgccggcgttgttcagcgtgcgcacggcctcgcagatggtgccggcggtgtcgatcatgtcgtcgacgaccacgcagtcgcgtcccttcacgtcaccgatgatgccgtgtgcctcggcatggttcgggcgcgtggtgtcacgggtcttgtggatgaaggcgagcggcagtccgccgagcttggcggcccactgttcggaaaccttgatgcggccggcgtccggggacacgatggtggtgttctccagcggcatgctgttgcgcacgtagtcaagcaggatcggcatggcggtcagatggtcgaccgggccgtcgaagaagccctgctcctgggctgcgtgcaggtcgaccgtcatgatgcggtcggcgccggcggaacggaacaggtcgaacatgaggcgtgcggtgatgggctcgcggccctgatgcttcttgtcctggcgggagtagccgaggaacggcgcgaccacggtgatggaacgtgcggaggcgcgcttcatggcgtccaccatgatgagctgctccatgatccacttgttgatcggctcggtgtgggcttgcatcacgaaggcgtcggcgccacggacgggctcggtgtagcgcacgtacatctcgccgttggcgaaatcgtatgcggtggtctcaagtacgtcggttcccaggtattttgcggtttcctgagcctgctcggggtacgcgcgacccgtcaccagagccagtttcttatccggagtgccttcgagaatcgccgacatgcttgccttcccaattgttcgatatgtgaaaataagccaaactccaatataacaatgcgggtgcccacggcacgcggccgttgcggaagcgtttcaccataccgctccaaactgccgtcggcaacatcaaaaaatccccaagccatcgacacagaaggcacatctcaacgtcgatggtttggggggaaaaccggattaccggactattcggcggacgcgaacgcttcgcggatctgcgccgcgttgccgtaggacgcctgcgcgccgtagccggtggccgcgtacgccgaaacgtacgaggcgagttcggcggattcggacagcgccagtccggacgacagaccggccagcacggtgcccatgaaggaatcgccgcagccggtggtgtcgacggccttgacgcgtaccggggcgatgcgctggacacggtgttccggatcgtccgcggtgccgtcgagtaccacggaaccgtcgccgccaagcgtcacgatcgcctgttcgaagccgaatccgcgcagttcgtcgagcgcgtgccaccagtcgaacgaatcccaatcgtcgttctccggctcgtcgatgccgagcagttgcgccatttcatgctcgttgacgagcaggatgtcggatgcttcgatcagttccgccggcagggacggggtgaacggcgagtcgttgagcagcaccttcacgcccgcttcgtggcacatgcgtgcggccgcggtgacggtttcgatggggctttccaggcacaggccgagcactgtggagtgggtcagcgcgtcacgcacggattcgacgtagtcgacggtcacctgcgcgttggagccgggcgagtacacgatggtgttctcgccgtgcgcgtccacggtgatgacggtggtgccggacgggccgagcacgcggcgcacgtgcgtggtgttgacgcccgcttcgccgagcgctccgagcaggaagtcggcgttgttgtcggagccgaccgcgccgaacatctgcacggtggcgccgatgcgtgcggccgccgcggcctggttgccggatttgccgccgggcagcagctgtagcgggccgccggtgatggtctcgcccggcccgggcagtcgctgtgcggtgacggtgtagtccgcgttcatggaaccgatcacggaaacggtgccgtggatgcggtccagtgcggagaggatttctgctgcgctcatgatcgctttcctttcttgcgattattgcgattgccgacggtcgccgcactttcactgcgcggttattgtgctctcactgcgctttggcggcgaggccggagatgcgggtcatgaattcgttgaggaacctcggcacgtccacgccgacggcgaccttcatggtcttgaccgggtcgttgaggcgggtttcgtcgccgatggtgcgtccgcgggtcgggccgtccacgtcgaccttcatgttgatgtcgagcgtggtgacgagcgtcgggtcgacggcgacgccgacggcgagcggatcgtgcaggccgcagccgccgaggtgcggcgaggtggtctcgtaggccttgatgtagaagtcggtcatgtccgcgaggaacttgccggccttggtgccaaggtcgcgccactgttgggtttccttataagtgagcagggtctgcagggtcacgtcgaggccgatcatggtggtcggggtgccggagcggaacaggtagtcggcggcttccggatcctgcgagatgttggcttccatgcaggcgttgcagttgcccggcacggtcagcgcgccgcccatgagcaccacgcggccgatctcgtccttgatttccggagccttcttcagggcggcttcgatgttggtcatcgggccggtcggcacgtagatgaggtccttgccgtaggtcttgacggcgtcgatgatgaagtcgacggccgattcggtttcgacggaacggttggagtcggggatgtccacgtcgccgatgccgttgtcgccgtggatgaacgcggagacgggcagcacttcgaagcggtcggtggtgctggagtgcggcaggccttggtagaccttgacttccgggtggccgagcaggtcggtgacggcgagcgcgttgcgtacgccctgttccacgagcacgttgccgtaggtgccggtgatgccgatgagttcgacttccgggctgcccagcgcgtaggagatggcgagcgcgtcgtcgacgccggtatcgagatcaagaatgagcttcttcatgattgcgccttcctcgttgattggctgtgacggccgttcgcgtccgcgcggctgccgcctttgttgtgttcttttttttatgcgatgttttatgcgattgttgtacggtgttgagtacggtctctgtatcacctcataacattatgataaaacgttttatcaagatttccaaatcatcctttcgacgtgcgtgtcgcggcggaaaaccgccctttctccgatatgcgccccacgttacacgcgtaatacgcaatacacgcatcgcacgcgctatgcgcgttatgcgcaagcggcctgcaccagtttcggcgtcaacaccttcacctgcggcgaggcgagccacggacggcccgcaccggaatcgccatcgccacgtaccacggcgtcgattcgactgcccagcatgccccagccggcggcggccaaatcgaccacgctctgttcgacggtggtcatgcgcaaacccaatccgaatcgtctgagaatgttgtcgtagccgatcacctgcatgtcttcggtgacgtgcagcccgcgttccgccatacgctgacggaagccgagcgccatcacgtcgttgcagcagaacacggcggtcgcaccgccgtcgatgatctggtcggcagcatgatagccgccatcgaaacggtagtcgccggacacgcacaacgcgggatcgaaccgctcccccgcctgctcgatcgcatccacgaaaccacggcgacggtcggccgcgctcgattcggccacatcgcccgtcacaatgccgatgcgcttgtgcccgccttccagcaggtattgcgccgcaagccgaccgccgagatagttgtcgaagccgaccgcgtcacaccaaccgcattgcatcagtcggtcgatgagcaccaccgggcaggtgacacgctccacgtcctcacgcaacgcggcgccggcaccggccgcgcaggattcgcgcgcgggaatcagcagcacgccatccaccccacgtgacgtcagcctgcgcagcaaagcctgttccgactcacgcgaatcatccgaattggccacaatcagcgaatacccctgcgccgcgcattcatcctccacgcacttagcaagcgccgcgaaaaacaagttctcaatatcaggcacaatcaacgccaccaactgggattgcttggtcaccaagcttcgcgcactctgattcggcacgtaattcagtttcttcgccgcatcggcaatgaccttgcgcttcccctcagacacgcgagcaggacgattattcagcaccagcgaaaccgtcgtcacagacacccctgcgacagcagccacatccttcagcgtcgcacgatacgccatccaaacccccttaaaacgtttatccctccagcataaataccatggaatcctgacgcgcccagcatcgcaataacaaacaaattcctttcacagcaaaataatccgcactatttccaccggtaaatcgtttctcggaagtgtttttgcatactcgcaacgtttgtccaaaatgagagacgcacaagaagaaaggaaccagcaatgcggccaaccacgcagaaaaacaatgcgagacagcgcaaaaccatcgccatcgtcgcagtggtcgcagtggtcgccatcgcacccaccaaacgctatgagaggtcgagatctccgtccgtgcgtagaaactccatcaggttgagatgccttacgccgtcacgttgcattggcagctggtccaaactgaaccggtatttcggatacccgtcagccagcttcgtgaacggacggaattcacgctcctcaacattaggatcctgcacactcatcgacacctgcacataggcgtaccgttcctgcttacgcacaatgaagtcgcactccagcttaccaataatgcccacgctcacctcgtagccttcgacctcaaatgcacgtacagcgcattttccaaggctggtccgtaactcattcgcgtaccagcgttacgcgcgaatcgtatgccaggatccgcaagataatacttctcccctcctctcaacgacctgcgcgaacgcaaatcgaatcgcgggcatttgtagaggaccttcgcactctccaacagccggacatagttcgcaagagtctcacgtttgaccgtcacgccttcgccatgtttcatatagtcgacgatccccgacagattcgtgggagctgcatagttgttgatgagatagtcctgcacacgctggaaggtatcgcggtgacgcaccactttgcgtgcggctatgtctttgttgaagatctgccctatgacctaccacgaccaagaacctaacccacgaaaacagcagaagcccctcaactcttcaattccactacaaaggtcacatcacggcatacgcacgccgacgcgcgtatgcgtgcacgactccagcaacgagccgtacccgccgttagatggcaggcttcagtatcatgacgccatgcgttagcgtcaccatgcaacgataggaacacactattcaatagtgcatcatgaaagcgtgacgttgcccttgcgcaggtgccgtaagactccgcggacaaagcaatgaggcttccccgtgagaagggaagcctcatattccattcattctattcagcgatgatgacgccgaatcaccgatcatcctttgggaacaacgcgtcgaaggcatgttccatcacggacttacggcggatcacaccgacgagcctgccatcaccatccaccaccggcagtttcttgaactgcttcttggcgaggattcgggccacctctccaacatgctggtcgggcgtggcggcaacgaccttatgcgtggcgatgtccatcaccttcttgccggagagcgcctgcaccttggaggccacggtttcgtcgtcgaacaccaccatcgtcgaaccggtgccggtggaaaccgtacgggattcataggtggcaatcgatttcatgacatcgccgtcactgacgaagccgacgagcctgccatcgccgttcaccacgggaaggctggagacgttgaggcggatgaactcgcgcaccacatgcgtgatgtcatcgctgtccaggcagctgtagggctgatcgtccataatcccgccgatggactgttcctgggcctgcttgaacagggaggcagcgggggccacgtatgcgccggcgtagtgatgctcggcgggctgaccttcagtggtttcgaccgcgacttcggcggaggcttgcgcctcgtaggccttggcgttgcgtgcggccttctccttggcacggctggtgacggtgaagatgcagatgatcagggcgaccagcgagatggcggcgcacagcaggtaggagaacgcgatgccgctggccgtggcggacttcacaccctgggacatgtgcgaggcggtcacggatgtttctgcggtgaccagaagcgaggtcgcaatggctgccgcgatctggcggccggtgttggcgatggcgttgccatgggcgatcatgtcgttcggcaaagcgttgacgccccaagtgttgatcggcatgttggcgatagcctgaccggatgcctgcaatgcgcagaacacggcgacaaacagcactgatgtcctggtgttgatggtgccgagaagaccaagagagatggtcatgagcgcaaggccgccgatgcccacgccgcgcgggccgaatttgtcgaatgcggcaccggcgaccggactcaggatgatgccgaccgccgcggcgggcagcatgaccatgccggtgacggtggcggattggccgagcacattctggatgaagataggcaacgtcacgttggttgcggcgactgcggcgttgatcagagtgaccagaatcgcggagttgcggaagttgcgggtggcaagggtgtcaacgcgcaacaatggctcatcgagcttgacttgcttgtatacgaatgcgacgaaggccacaagaccaacgacgattgaaataatgacgaccggactggcccatcccatcgtggaagcggacgagaagccatagagcaggccaccgaacgcgatggtcgaaaggatcacggacaggatgttgagctttgggttcttcaactcgccgacgttcttgagcatcatcgtgcctccgacaaggatgaccagtgccacaattgcgatgccaatgaacatcgggcgccatccgaaaccgtcaatcaccagaccaccgacaaccgggccgatagccgggccggcggccatgacgataccggccatgcccatggcggtgccgcgcttatccggcggatagacgagcatcggcactacggcgaccaatggcaacagcacgccggagccggcggattgcagtatgcgtccgacgagcaacagcacgaaattcggcgcgacggcacacagcagtgtgccgaccatgaaagtggcaagggctccggcgaagagctttcgggtggagaatttatcaatcagatagcctgaaatcggcaccatgatgcccgataccagcatgtagacgctggtcacccactgcacggtgccggtggtgatattgaaatcacgcatcagtgccggcaaggccggtgacatgacggtctggttgagcagcgcgatgaacgagccgacgacgatcacgcccacgacgatgaatcgggcgtgcgaatcaataggctttacggaactggcggcggacccgaattccgcggttttctgtgaggtcacagcatttccttctgttggtaacggcatgtgtgggcgatccggccccatacttgtgtcaagacgcggggacaccgatgagtccggggtaaaggaaaagccgccatccgttccgcattcatatacggcaaacgattcgcggctttgcgtaagttgatggctatggtgagcgattcatgcgacgtcgaccgcggatgggccatcggtgcatcccggcataaggcgtgtccccgctacaccagcatcgaaaaaagggacatttgtggattggcaaacagaacattgccgacgaacgacccacggcaggtgcgtgcgatgaacatcgcgtagcgatacaggttcatggcatctccttgacgggtcttcgtacggcagacatcgagaagcctatcatcattcagatcgacggtgaaacccacgcatgcccgacaatacacaaaatctttacaaaaggattgggcttaccgcatacgatccgcctgggtagcggtccgaggatgaatcaggggcgagccaagggttgcgtctcgtgtttccgccatgatgtctggcaaaatagtgaagccggacatgcgaggcatcgaccggaatcggaaaggggcaaatcatgcgagttctcggcaatatcctgtggatcattcttggtgggttggccatcgcaatcggatgggcattggtgggactgattctgtgcatctccatcatcggcatcccgttcggccttcaagcgttcaagagggcgggactcaccctgacgccgtttggcaaaaccgtgcaatacggcggcggagtcggctctgccttggccaacatcctgtgggtggtgctggtcggctggtggatggcgttcggctatctgggagccggcgtactcaactgcatctccatcatcggtattccgttcggattgcaatcgttcaagatggccaagcttgcgctctggccattcggagcggaaatcgtcaacctgtagattccaaatactacaaagccgccaaagcaacccttggcgaggcggccaccgacgtcaacaattggattgaccagcaagccgccaaggccgaataataaaacacacattatgctgctgcagcagccagtccttgcagaacaatgtcatgacaaaggcccgaggaggcggcgctgccgcagatgttccgctcccatggagaggatgtgatgcgtcgcgcgatggccgtggtgaacgtagtgaaccagacgagcacgctcgttcccgccgtgctcggcggcgtgctgtacgcggcggttctaggacgggattccatcaccttcgctctggacagctgagacatcaaagccatgtgtggatatgcaaacggccgccatcaatcatggtgatgttggccgttcacgtcccattaaatatactttcgcaccgtatctggcttatatacggcagattcgggagacttggattcacagctgggtcattaggccagaacgtacatccggctctcgcagccatttcctgacgaagccaactacttgcagcacgttatttcccaatcgccacttaccggacccaattgccaggctgcgccgcatccgccatgacgcaccgtcgcaaacgctcccgtctgacgcgctttactggccttgtgcgcggtagcgggcttcggtggcggctttggcgggttcccaccaagcgcggttgtctatataccaagcgatggtcgcctgcaaaccggcttcgaaatcggtgcgcacaggcttccagccgagttcggtacgcagcttgctggagtcaatcgcatagcgtcgatcatgcccgggacggtcacgcacccagtcgaacgcatcttcgacacaccccataagtcgcagaatcatacgcattacggcaatattgctcatttcgccatctgcgccgatcaggtatgtttcaccaatccgcccgcgtgtaagaatctcccacaccgcagaagagtggtcttccgtatggatccagtcgcgcacgttctcgcctgtgccatacagtttcggccgcgcgccttccagaatggatgtgatctgtcgtggaatgaatttttccacatgctggtatggcccgtaattgttggaacagttggaaatggtggcgcgcaggccgtatgtgcgcgtccacgcgcgcaccagatggtcggacgcggctttcgacgcgctgtacgggcttgacgggcggtacggcgagttttcgccgaatcgcgccggatcgtccaacgccaggtctccgtacacttcgtcggtgctgatgtggtggaatcgcacgtcgtatttacacgcggcctccaacagccgcatcgtgccctctacgttcgtgcggatgaacggttccgggtcgaagatggaattgtcgttatgtgattccgccgcgaaatgcacgatggcgtcgcagccgggcacaatgcgttccagcagcgacgcatcgcagatatcgccgatgacaagttcgacctgcgattgcggcagcccgtcgatgttcgccggattgcccgcatacgtcagcttgtccagtacggtgacgtgcacgtccggatgattgcgcgccacgtaccgcacgaaattggcgccgatgaacccgcatccgcctgttaccagaatatgtttcggtttgaatccctgttcgctcactgtttcagcaaccgccttcccgattccaacattacgaatgcaaacaaaggcgcataaggaaggaaatacctgaattgcataccgtcgactccgattagcccatccgcatcgtattgcagtcacaaggcaaggtaaatcagtaggatatctccgatacagaccaccgcgatcaaccatgcgtatggtaaggaaagcacaccgcatgcatttatagaaccattggcagtcctaaccggattctttcggcggcttttgacacaagcattcaccacactggtcacagccaacacgactacggaaaccacaattgccaaccaacacgcggcaatcatgatgctgtccgtcctgttattcatattcgattgagcatgcattatcgcccatgcaatgttcttcacagcatccaacatggcaacgggatccgtcaacaatgcatgcttgcgctcgctcatttgtttgtacgaaaccagcatcggacaattcgtataccaagcattgacgcccaaccagaatatggtccatataccagacgcaaccacgcctatcaacaatggcacagcccgaccacgattcacacgccagcgaccggaaactcgatcaaacatcaacggaataaccagcaaaaccaatggcatgtacacaaacttgcacattgccaatagcacgctcgttaccgcaagcgccactgctccacgttgtgatcgtttaccaataattccccggaacagcaaacaggagaacagaatcatcacagcttgtgtcagcgaatccgcagaaatagcgaatgagtaacgaaacaccatcaaaggaaagcataaaagtattccaactgggatacgccatcgcggcaatgcgcgtactgcaccatacatgaacaacacataaatgatcaacatgcacgcttctgccaagcggtatgtcattccagaactgaaattaaaaactcgtccgattctgaagcccagtaattgtggagcatatacgaccggagaatttgttgccgtgttgttaaaaggcaggtcaaccgttgtcgatgatccattgtcagcaacggattccgcaatcacaattcctggatcatatccgtcatactgatctaaggaatactgcatccaactgcgatcgaccgcgccaccgactacccctgtctcagtattatgcagcatacttctcgaagtgactggccgtgcgattacatccccgttaagtatggagtcaattcgataaacatgcgtccaaatatccggcacatggccaggcttggtaacagccatgaaaaacatgccctcaagcagcacacacaacgccaccaacactggcatgcatcgaaaaagcttctttcccttcataccgccactatcgcataactatttgactgcgcttaagaacatgccttggtttcattcatcattcagatacccaccagctaccatcaagacacctactcgtccagacacactggctaatatatagctcggttttacatgctcataaacccccgtttacacaaggggttatttgccgtgaaggaagcgacgatgccttatatccagtctgccgttcatgccttcgagccttcatacgtcaggcattccaaacaatcgtttataggcggaacttaccggacactggctgacgagagcatgatagacaccccctcttgtttcgatgtgcgccaccgcgcggaactgtacacgcataaagcccctcttcatgcggaacccgcgcaccgaagcatctacataccggaaacggaagcgtccgtcgcaccatgtgatacggatattcttgcgattacggacgagcagtatatttcctcttttgctgcagaggcgcaagttaatggcaatcacgcattacaggcaatgccgcgcactcttcaaacggttcggacggccctgacgactgccgggcatagcttgaaacgaattggccagactattgccagtgcggctcacgccaccgcacgcgtcacacgtaccgctgcgaccacggtgcgtaacgcatggcgcaccttcacgagtttcaaagccgtccagcttatcatcaagttcttccggggtgcgcatgccttgtggaagaaacgcatgaagttctcttatgcgttctataccgcagtgttcttcctgctcacttcagccgaagtcattttcctgcaatggggcatgtactccgaaccgaaatatagtaaaggaagtaaaatttccgaaaccgcgaagattcttcaaagtgtatccgggaaaacaacccaattcatctgtcaaatgtggcttgagaatagatataacttcttattcaacctatttgctctcaccatcatctatcttgctttcatcttcatcacgaatcgtttctggattgccactgctcttttcggagtcttattcaccgcctacggtgtagccaaccatataaaaatgcaattacgaaacgagccaatcattcctgccgatctgacttttgtcgcaggcggaaactcagataaactcctttccttcattccaaaagaaaatcaacaattcgtaaattcctcaatcagtgttgttatatggctcgcttgcctctgcgcacttttctttatcattgacggtagaagacaattcattccttgttcatggagacatccattctcaaatccaggaatcctcattggctcgttgacacgcattttcgcagctataacctgtatcggtatcgtttgttcttattcatttaatctcagcgtcccaggttcttgggcttactcttttgccggcaatctcggatacacgccttcgttatttgacgcaactctcgatgccaaaaccaatggtcctgccaccacttttctaagtctcaccaaaacaaaagtaatggataaaccggaaaactataatcgcaaaacgatggataaaatagcccaaaaatatgattcgatggcccattccatcaatgctaaccggaaatacaacatcacggacagcaccgttattatgattctgtccgaaacgttctccaacccaacacgagtaccgaacattagcttctcaacagatcccattccaaacattcaccagattgaagaaaataccacttctggactcatgctttcttccggatacggcggaggaaccgctaatatggaatatcaggcacttaccggcctgaacctcactaattttgacgattctctcataattccattccaacagcttgtgccgaatcaaaaagccccttatgctttcaaccaaatctggaacacccgctatggcacgtccggttcggacgcagtgcatccgtattaccaaaacatgtacttgcgggataccgactatcgtaaattcggatttgctcacctacgcacacttgatagcaagccaaaaatcacgcacaagcaaacctctgattacaatccgtacgttaccgatgaagcggcttatcaaaacgtgttggaccttgtgaataacgagacgcatccacaattcctgcaattatcaactatgcaaaaccatatgccctacaccggttggtacccagataatgaatttaccgaggcggattcatcagtcgatatttcaacagaagagcaccaaaatctcgagacatatgtcaaagggctcagcctcaccgatcaggctacagcatcttttctaaaccagctaaacttgatcgacaaaccagtcactgttattttctacggagatcatcttcctagcatttactcaacagccgaacaagaccctaagaattcatccgtcctgcatgaaaccgattatttcatatggtctaacagcgcttctccatcaaacggaacaaaactcgcagatacagatgctgcttatatatccccaaattactttatggcgcttgccgcttctcatatgaacgctaaagtatccccctatctcgctttgctaaccatgttgcacaacaatcttccggcttcgagccgagtagcattcgccacaggcggagtcagctctggagatgaaacaaatctcgaccaagtaggtaatcaaatctccaagaaagccttatcgaaagaggcaaaacaattgttgctcgattacaggctcgttcaatatgatatgaccgcaggcaaagggtacctagccgatacgaacttcaccaaaataaagtaaactctattgtcaagagacgtacaatctttcgatgccacattacatcaaggaaacaaggacaggacatggctacttcaagacctttggtttcaataatcgtccccgtatacaattcggaacgatacctgccatattgtgtggaatcgattttgaatcagtcttataccaatcttgaaataattctcgtggatgatggatcaaaagacacctctccacgtatttgcgacgactatgcggagaaagattctcgcgttattgttattcaccagaagaacgggggcatcgccaaagcccaaaacaccggattggatgcagctcacggtgaatatattgcattcgccgacaacgatgacatcctggacagccgaaatattgaattgttgctgcacgcaattctaaataccggagctgatatgagcaagggaagatggcagcaattcggcgtctcccaactagcagaaatcaaagcacgcgccgcccaaggatctgctgcgccggacaaaacaacttcctttaaaaatcctctgcacgcatatcaaaccgtgttctgcaagagtctacgtattttgggaaatctgcttggcaagaactctgaagctctctatttcaacgaggcaaactggtgtcgtctgtacaaacgcgaattgtgggacgggctccgtttcgatctgggacattatgcccaagatattcgcatggcggcccctctttactccagaatgaagctggtgaccgacatagattccgtgctctactactggctgcaagaaccagattccgtaactcactctaaacgcacaccaaatttctggcatgataatgtaaccgccgccgcaaaaaatttccaagccactcttgatcagggcattgtcccttgccgtaactatttcggtctagtggcgagtgtcaaagacgaagaaaaagtgctacgtaactccagtaatgaagttaccgatgcagattggcaaaatctgcaggatgacttgacattatcgagtcagcttattcttaagctgactccactgcaaaggctccattgctatattttgtttataattcgacattatgaaaacaaaatatatgatcgcaaaattcatgacatgaagtaaagtcatgtgcatacggaaagcaaatgctcatccgtatcactttgctggaataaagacctttaaaaggcgataagggctatacaaaaaagcatgcaaaaacatgcacaccttgaaaggtggcaacaatagtgccgcatttttcgattctggtacctgcatataatgtagcagactatatttcagactgccttgaaagcgtcatatctcaaaccttcactgatttcgaagttatagtcgtagatgacggaagtactgatcaaactgctgagatagttcaaaatctgcaaagcaaagacgcccgaatccgtctaatccgactcacgcataactcaggacgccatgtcgcgaggaaaacagcagttgactcatccactggtacatacacgctgttccttgatgcagatgatgcaattgaacctcatctgttggagctacttgatttcgtatccaaaaaacatgatgcagatatgatcaggtatggtctgtcagttattccaggaaccgaccaagacaagaaatgggcattcgactatgaagcaatgtttaacagtgctgacggagagctccatggagacgatatcttaaaagcatctttctccttcgatttcaagcaatgggtttcatggaacattcatacaaccatgtatcgctccgatattgttaagtccagttttaaggaaatgccagcagaacgtcttaacaaacttgaagatgcttacgaatatctcgttttatgttcacgtgcaagaacgctatatccaataaccgagctacgtggacttcaatatcacatcggaaggggcatctctggaagggcacgatattccatcgataaattcatgcaagatcaacgttctgtacatgatgtcgttctcgccgctcaacgatttagcaacacacagcatgttccagcaattcaaacggcgaccaattggctgagcacacgtgccgtctcaattattcaagatgatttccaagaaagactggcacctgaagaatgcgaatccgcattacaaagcatcgcccaaacctggaataaagaaacagcctgtcaaattctttgcaattgccttgaatcacgcgtctggtggttttgcaacatgaacagctatcccgcagacaacgatcccgtcatttactggaaaatcgctttctcccatatgatggattccgtttctttcaaggatgtttttatctctaataaagagttacagaagcaagcagcacatatttatgaagcgctctccgaactcgatcgtcgaatcgctgagaaaaaccaagaaaattctgcacgagaagaggcatataagcaagccatcatagacgaaaacaagcaagccatcatagaagaatataagcagacgacattaccttaccgcataaccaatgccttgcttccaaatgaaacacgtagacggagaattttcaaccacctcattaacaagcagaataatcaataattgtttgtgttaatgatggcccaggggtaacgtcactggaccatcattaacacaaacatacatacaattaattaaaagacaaatatgtattgtctttatttacgcttccttattatcatcgctttctcattcagcagtgcataatcttcatgatctgggttgttaatagaaaacacgcacccattagcctcattcgtaaaagcaaccattttggtttctgagtctgccgagtcgccatcatcaacacgcacactggcatacaggcggtataccccactattaagcatgtcaatcggcatctccagtgcaaatcgatgttttccactacttgtctgcacaagagtgcgtgaaccggaatcatagacgatgcctccgcgtttcagatccaacaagttcacagcaacataatgcgtcccagaatccttatactcgtataccacatcaaattggaacggatgttttccatcagttgataaatcagacttcgggactattttcaattctggaacagtggcgtttaatcctatcgcatattcaccattttgcttctttttctctggcaaaggttcattgcctttgagattgtccaatgtatattgatccgcaacttggtttttgtcaccactaacgacaatttctccgtcacggatgagaatggctttattacaatacttttttactgcatccatgctatgagtcacgagaataacagttttattcgggtctgcctggaccttcttgaaaaatgcatcacatttacgttgaaacgcctcgtctccaactgcaagtacttcatctagaacaagaatgtcaccttgcgctttgattgcaacggaaaaagcaagtcgaacctgcatacctgaagaatagttcttcagtttctgatccatgaactcttcaagctcagcaaattcgacaatatcgtcatacatggcgtctatctccgaatgactgaaccccaggagagcaccattaagatagacattctctcgaccagtcagttccgggttaaaaccaacacccaattcaatgaaaggaactagctttccatagacatctacactaccttggtctggaacgtaaatctgtgaaataatctttagtaatgtggatttaccggaaccgttacgtcctaccacaccgaagaaatcaccgcgatggacctcgaaatcaatatcacgaagaactttctgctctgtatatcctttgatccccttggtccaattcagaaaagccattttcaaaccagtcgcttgctccgtcggcaagcgaaatgacttagctacatgactgacttttaatactactggggagtcttgcatctttttattttccctcaccgtttacagcacctccgcaaatttagcgctgtacctacgaaacacctgaattcctaatacaaaaatcacaattgaaagtacatatggcaacgcacacagcaagggattgccaacatacgtccagactgttggaatatattctggagacaaaagattatgccggatatccataattacttgagtactaggtacaagtaacagaaacttcgaagcccaagcaaaatcaggagccctttgcgcaatcatagtaatcggatagataataggtgtcgcatagaataaagcctgcgtaatcacatcccagatatgcgctacatctcgaaaatacacatacaagcttcccagtaataatgtcactccaagcgtcaacaaataaaattgcataatgttaagaggaagcaacagaaccctccacgtataatgcgcatgtgcaaaaaaaccaaagcaaataaccacaacaaggttgatacccaaagaaatcaacgcgcccatagcagtagaggcaacaataatgtaatttggaaaatgcactttacgaagcaaatcgccacgatctactatgccacgcattcccatgctggtagcttcagtgaaaaaagaccacaaacacgtaccgcacaacaatgaaatcgggaatgtaggtgttccatctgtaaatttcaggaacctcacaaaaactacatacataaccgcgaacaacatcaacggtttaagaacggaccacgccattcctagaaccgatccttggtaacgaagctgaaaatcggtcttcacaagctctttaaagacaaccatggaataacggtatcgttttctaaagcgttctaagacattctccataaaaagaatatattagcaggagccccaaatcctatcgagggtatgaagtcatctccagaatattctcatacatcacctatcagcgctatactttctatgtttgagagtcttatagaaaataaggattattggaatgttactcacccaatcttcaatcaaccgactcggcatcttcttcttctatgattccgatggagttgtggatgactatgtccctaccctgctagctggattcaaacctcatttctccgaaatgaccatcgtctgcaacggaaaactcaacgaggcagggcaatcaattttgtccaggtataccgacaacctcatcattcgtcccaatacaggtttcgatgtttgggcatataaaaccgcccttgattcctatggatgggaaaaacttgagcaattcgacgagatcgttctttttaatgcaacgattatgggacccgtctatccgttcgccgagatgttcgaaacaatgaataagcgcgatcttgatttctggggcatcactaaattccataaagttccacaagatccattcgggcgtagcccgttcggatatcttcccgagcacattcaatctcatttccacgcttatcgaagaagccttgtgcagagtaaagagttccaggattactggaacaatatgccgcagattaacagctattatgattccgttggaatgcatgaatcgttattcactaagcgcttcgctgatttgggattcaagtgggacgtttatgtcaataccgatgatttagaaggattcacttatggtccgattacttttgcggccaaaactcttatcaaggaaaagcgctgtcccatcttcaagaggcgatcgttcttccatgattacatggatacgttaaaccaatcagccggcaacgcagctttggatttattcgaatatctgcgagaccacaccgattacgatgtcaatctaatctggcaaaacgcattacgcacgatgaatctcgcggatctcgtcaaaaacctgcatctcgatttcgtgatgccgtcaaatatcactacgccgattcctgaaggtaagcgtatagcgctgattatgcatttgtactacatggatttgctcgataaaacgctggaatatgcaaaatccatgccggaaggctgtgacttcatcttcaccgtcgggtccgaagaaaacgcaaagctggtacgggaacgttgtaaaggactgccttataacgtcgatgttcgtgtcatccagaaccgtggacgagatgtaagcgcattgctaatcggcgccggtaaagattgcctgaaatatgactatgtgtgcttcgctcacgataagaaagtgacacagctttctccatacagcattggagatggctttgcctacaaatgtttcgagaatatcttaggcagcaaggcattggtgagcaatattatcaatcacttcgagcaggatccgcatgccggtttacttgcaccaacatcgccgaatcacgccgactatttcggtaatttcgcaagcctatggggtccgaatttcgaaggcaccaaaaaaatgcttgaagagactttaggcgttaaagtacctttgaatccatacaaggaaccaatcgcacctttgggcactatgttctggttccgtccaaaagcattgcaccaactgttcgatattgattggaaatacgaggatttcccgcctgaaccaaacaaaatcgatggatccatgttgcatttcatcgaacgagcttacggatacctgcctcaagccaatggatattacacaggtttcgtatattccgatcatttcgctcgcattgagcttaccaacctgtcatttgatgtacagacacttgcgggtagtacggcaccttatctcgacactacactgcggggaacctgtctgaatgttgcgcgtggattcacattgcgagccgctattttgctgtggttcaagcgaacactggtgggcactccgtttgcatatcatttaggcgctagggttatgaagctgtaccgtcatatccgtcatccgaagacgtataaagagaggtatgggaacagtaacgcccatttgaagaaggatcgtgcatgacagacaacgttccttttactaaacctactatgcccgatacgacgaagcaaaaaggtaaacgtccacgacttttttatctagatctagtccgtgcaattgccgcgattctcatcgttatcacgcatttcaataacccatacatgatcgggcaccctgtattcgcttacgaaccatttggtatctatatcggtggcttaggcgtttccctgttcctgattatttccggcgccgccttgatgtatacatacggcgagtccgaaaaattaaactacaggcattttcactacaagcgttttattggaatctatccaatgttttggattgctttcattatcgctaatgcctatctttttttgcgtaacggtggacatgtattcgcgaacgctccaaaatggacgttaattttctccgtgctcggcattgacgggttggtggccaatacttcacttccaacgttctatacacttggcgaatggttcttgggattcatcctcattttctatgtggtatttccattattgaggtacggagtaaaaaaacatcccctcatcactggatctgtcgctattgcattgtatgccttgacgctttattttcatccaatgccccttggactaccatccgatttattgcttacaatgaggttgcctgaattactgtttggcatgtatttcattcagtacatcagaaaaataccaacctatgcagccgcagcagctttattattccttgttgtacaagaaattcatccactgtttagcggatcctttgccgtgaccattgtaggaatttgtgcatttgcagttatagtctatactgcaaaatggcttgatgtacaacctattcggataccagtaaattctgtatcaaaatattcgtatcctattttcttagtccaccatgttttgatttcacaggtattcacaattattaactgtactgccttgtcacgctttgacggttatctactattttttgtagattttatgataatcatgacattgtcaattgctttatacagactcgaaaaaaagaccatcagctacatacaatcaatgttttaaaagttatataagtgcccagaggtatcccctcctcgggcacttattttaagcatctttctcatgtaaactgaacatttgtaactttcaaggccactgcccccccctggtcaggattcgagcatggattgtccatgccgctgcctcatgttgaattcgccggcgtcaatccatatcgtgttgtgcacggtgcggctaaggatggcgccaccgcctaaatggcagcacatcattcctcgacggccagatgggttgggagcatggtaccgaccgccttgtcatccgatttcgtttccatatcaagctgaggttgattatcaaagcgaagtatcgccttggcttgatacgtaataatcgtcaagaagtgcgattggcctcctttggtaataacgctggcctcgaaacgagcaaatattcatgtaagccaatcttatattgacgatatatccatattgctagcaaagggagtacatagtacatctgtaaggaataccgaaaagcagcaactggtgaaaaagcaagcaaggaaatcaagatacaaagcaacggcaaagacatgattacaaatttacgcaaacatctcatacgatatgcgattatgcatcctacaacaaatagccataatggtaaagctctgtcaaagaagatcagattaaatgaatctgagattacagggattcccatactttcaattttgttataaagtttcgaaggcaccgaacgcatatacgtataatgccccttaaattgattaaggtactcgtcactacatttattccccatcttttggcatgtagaacgcgtataaatatcgtgatccatgaagtcagtatcaataaattgggtggaaggcgtactagttatctgccaatacggcttcataagatccaaataggccgatacatattctccaaaattattaattcctgtttcagcccaaaatttaataaaatctgaagataattcaacctgttttttccctggagcataattgaatttcacaggatctgcatcaaatggcagatacgactccacccatacctctttatcatgaatagactgaaaatatttatcagcctctttggaaattttacctccatcatgatatacgcgagcaacctgttgaaccggcacagacatcagctcttgagatggcgaaggctctgccttaagaacatgcgaaaaaagaaaagaggacatcccagtcaggacaagaagacatgctgcaatagcaccaatacgcttacgctgttttttataaatacaaaaaagaaccgtaataactacgattgcaattaatactgcattcttacgcaactcatattcgcaatataataacagtccaaagccaagacagaaagaaaaacgctcaaacgatttaccgacggtcgtcataacctcaacaatctgcaccgtcaaaggtaataagagaatcgcaaaaacaacatcagaactatataacagattatataaaacatacgtcgggcataaggcaaaacaaagcagggcaattcggtagccttttcttccataaaaaccaagttctttcatcttgcataaggaatacatcactgcaacagtgaaaataccaatttggactaaaccatataccccaaaagaccttgtcatatatatgaaaggaaacgctaagtacccccataataacgagtgccactctgaaggacttcccgaagcaatatctgcaatcgtattttgatgatcagcttgaatatatcctggataagtcataccccaaacaataagagagggaagagctaggacaagcatatccatgctaagccgtaaccatctttttttaatatccgaatgcgtcaagccaacttctacagcgcccacgaaaagccccctaccttttttgcattcgataatctcgcgttacataattcgtatccataatgaaacgtctacgactatttttagcaagcgtatcctgaatgaaacccaacacaatgcatagcagaccaatgacaataagcatgaccgccccgattagagtcggaaaacgttgaacctgcccagtacggaagaaatcaaataccaccgaaccggtaagtacgaatccaattattccaactagtaaacctaatccaccaaaaaaaggcaacggtttatattccctaatcaacctgaatatagtggaaaggactttaaaaccgtcaccaaacgtattcagcttactaactgacccatctggacgatcccggtattgcacaggtaattcatataaccgaatattattatcaaggctatgaatcgtcatctcggtttcgacctcaaagcccttagataaaacaggataggtctttacaaaagagtatgaaaaagccctatagccagtcataacgtcagtaacgttagcggaaaacagtgaattaatcactccgcgtactgttcgatttccaaaattatggaatggccttttattttcttgaaaatatgttgagcttaatcgatccccaataaccatatcgtagccttcaaggaccttctccaccatgtgtgaagcagcttctgccggatatgtatcatccccgtctgtcatgacatatacatctgcatcaatgtcctcaaacattgcacggatgacattgcctttgccttgcctaggttctctacgaacttgtgcgccagcttgacatgctatctcagcggtcctatccgtcgagttattgtcatatacgtaaatatcggctttcggcagtgctttccgaaaatcacgaacgacttttccgatagtaacttcttcgttgtagcacggaatcaacactgcaatcgaaggttcttcattttgaataagcattttgggaattgccctgttccattcaccttcagtttttcattattttattaattttagaagcatcgccccacacgcccggcgaatcgtatggacgatcagggaacgcgccatagtcgagcttaatattgagatcattctccttgatatagcgctcgacgcgttcagccaatgtcatcggttcaccagtgcagcaattaatgacgccatcaaccgcatcctgcgaaacaactgcactaatctgacgcgcaagctcatctacatcgatgaaatcatacttatttttacctgtagtgaatgggaaagtcgctttgccatcattcgctgcctgtagcagctttgagaaaatagagttaccgtgagcatcgtcgccaacaatgtaataagcacgaatccattgcgcagttgcatcatattccttggcaagcattaaagtcgcctcacgcaacgcattcttagcgattccatacatagaagcaggatggcacggagtgttttcatcaatcgcgccttcccaataaccaacttcatgcatggttcccataacagcgatttgcttgagcccagagtcaagcatgtgcttcaggaagcgataatgattggacaaatcacccatatggttatccgaattatgcttaaagccatcacgccaagccatgtgcaggcatacatcaggagcccctagctcctcaaataaattatcatttggctcaaaaatatttgcttgtacttttgtggcgcgttcatcgacaccatcaagccgtaaatccgaagcaatgacgtcctgtccagcatcaagcaatgcgctcacgacatgacgtccaatatatccgccagcaccagttaccaaaattttcttagccatatttacaaagtctaccagcaggctccccgcaggaaacaagcgattgaatgtctagcccaattttcacgttttttagaaaaactcgtacgcgcaagcggctaatattgcatatatggctgaagagacgtttactcccaagaacattattgtgaccggtggctgcggtttcatcggatcgaatttcgtgcattacgtagtgaacaaccatccggacgtgcatgtcaccgttttggacaagctcacgtacgcgggcaatccggagaacatcgcgggcctgcccgaggaccgtgtggagctcgtggtgggcgacatctgcgacgcggacctgctcgacaaaatcgtgccggggcatgacgcgatcgtgcattacgcggccgagtcgcacaacgacaattccatcgcaaatccggaaccgttcctgaagaccaacgtggagggcacgttccgcctgctcgaggcagtccgcaagtacggcatccgctaccaccacgtgagcacggacgaggtgtacggcgacctcgccctggacgatccggcgaagttcacggagcataccccataccatccgtccagcccgtattcgtccacgaaggcggcgtcggacatgctggtgcgcgcgtggacgcgcacgtacggcatccgcgccacgatctcgaactgctcgaacaactacggtcccttccagcatgtggagaagttcatcccgcgccagatcacgaacatcctggacgggcaacgtccgaagctgtacggcaagggcgagaacgtgcgcgactggatccacaccgaggaccacagctcgggcgtgtggacgatcctcaccaagggccgcatcggcgagacgtacctgatcggcgccaacggcgagaagaacaacatcaccgtattgcgcatgatcctgaagatgatgggacagccggaggacgcgttcgactgggtcaaggaccgtccgggccacgaccgccgctacgcgatcgactcgaccaaactgcgcaccgaattgggctggacgccgaggcacaccgacttcgaatcgggtctcgcgcagacgatcgaatggtacacgcagaaccgcgcgtggtgggaaccggccaaggccgcgaccgaggcacgttacaagcagcagggccagtgaggggatggatttcatggatttcgaaaaggacctgagggccgtggagacgaacattcccggactggtcgtgttcgacctgccggtgcatggcgacaaccgcggctggttcaaggagaactggcagcgcgcgaagcagacaaaactgggcctgcccgatttcgggccggtgcagaacaacatcagctacaacgcgaagaagggcgtgacgcgtggcatccacgcggagccgtgggacaaatacatcagcatcgcggccggcagcgtgttcggcgcgtgggtggacctgcgtccgggcgagagcttcggccaggtgtacacgacggttttggatccgtcgaaggcgatttacgtgccgcgtggcgtgggcaacagcttccaagcgttggaggacggtaccgtgtacacgtacctcgtgaacgcgcactggagcctggagcagaagaagacgtacacgttcgtgaacctcgccgacccggacctgcatatcgactggccgatcccgctggaggactccgaacgatccgaggcggacctgcaccatcccatgctgaaggatgcgaagccgatggccccaaaaaagactttggtgcttggcagcaaaggcaaattgggacgtgcaattcgtgaatacgctgaaagccattcattggagaatttcgaatatcacgatgccgatacctttgatatctcggacaccgcctcttatgagaatatcgattgggatttatatggcaccattatcaatgcggcagcctatacttccgtcgatggggcagaaacgcctgaaggtcgcaaagctgcttggactataaacgttcgcggtgttaggaaccttgcgaagattgccacagaacacagaatcactttggtgcatatttccagtgactatgtatttgatggcactctccaattccacaaggaagatgagaatttcgcgccactaagcgtttatggccaaactaaagccgctggcgatgcattagtagagaacgttccccagcattatctgattcgttctagctggattattggagaaggtcgtaatttcgtaacccgaatgctggatcttgctcaatctggagctacggcagaagctccgaacgatcagttcggtcgactgacttttacggatgacatggctggagcaattttccatcttctgaatagcaacgccccttacggcacctataacatgacaggctcgggacgtgtcgtgagctggtttgatcttgctcaaattatttttgctgcagcaaatgccgacaattcaaagattattgcaaattccgtcgaagaatatgccaaggagaataacgcagctttgcgtccgcataattgttcgcttgatttgagcaaaatcgaagatgccggttatcagcccgccgactgggagacatctcttcatgactatcttgcaaaggaactcaacaaatgaaaggcatcattttagcaggaggatctggtacacgtctgtatcctctgactacggttacttctaagcagctgttgccggtctatgataaaccgatgatttattatccgttgagcgtgctgatgatggccggtatccgagatatcctcatcattagtacgccacaggatttgcccaactttgaacgtcttcttggtgacggcagccaatatggcgtgaatttcagctataaggtacagccgtcacctgatggtcttgctcaagcctttattatcggtgaagagtttatcaataacgaaccgtgtgcgctcgttcttggggataatatcttctatggcaatggattaggcaagaccttacgccgtgcagcatcagttgaacacggagccactgtattcggttattacgttgacgatccggaacgttatggtgtcgttgaatttgatgacaatcacagggccgtctcaatcgtagaaaaaccgaagcatccagcttccaactatgctgtcactggtctttatttttacgacgctcgtgtcaccgagtttgctaaacaagtcaaaccaagtgcgcgtggcgaattggagattacagacctaaataaaatgtatctcgaagacggcagtctgcgtgttcagacattgggtcgtggttatgcttggcttgatacaggtactatggattctttatatgaagctggagaattcgtgcgtacagtgcagcgcgcacaaggtttgccgattgccgtcgccgaagaaattgcattcgaaaacggatggattacaacagatcaacttatggatgcagccattaaatatggtaaatctccgtatggcaaacacctcaaagatgttgcggatcataagattatttcgcaacctgatgatgatccattgaaataataaaatgcatgtatgagtggggtccaattggaaaattggaccccactcatattttaaaaaattacagagatatcggcttttttacctttacttttgtctcttgttctcactggcaaccatgctccagagtttatcgaaccaagcaccacgatgccgattaatcgtcatatcaaaaagcagcccccttaataaatcaagggcgcttgcaaccacacatacaataataatacaaagaatagcttgtgctattgcatattttgaatcataaaaatcagataatacaatccatttagaccacagttgttcacgaataaaaggctgctcagtagcaagatatacaccaaaagaagaagtagcaatcatattgattacgctactatggaatgtcgctctccgaagtaattcaaacagaccaaaactaatcatcaaaatcggaatagaccattctttttcaactggccaaagaaaatccataaggagacttgaattatcggggattaacattggaagagctatattccatatcaaaataaccaatgttcctaaaacaaccaaaattgcagcataattagccttaatttctttcatataccatttgtaatatgaaataagcacaaagacgtattcaaatcccactacgctaaggccattatctaagttagaacctggaattagagccagcgctccccataagacaaataacaccacacagcattttttatgattctcttttcctaaatatctaaggcatggaagaacaaatggaagcaaaaccaaaaaaatagcataactacttacataccaccattcatttcgagttagtggaaagaacatattcaaccaactgaaccaccagtcattcacagttctaggctcagaggaaggaagggccaattgacagcacatacctacgatattccagaagaatagttctctccaaagaagccaaattttacggatagcaccttgtaaagtcactcctttatccgcaagaaaccaaactgaaataaacaaaaaaagagcgataccgatttttcccggagcaagatacagcatctggaaaaatagtctttttacgcaaaagggctcattaaataaatcaaacgtagaatgacaaagcaaatgatgcgagacaataagaaccactgcaacgattctcaataactcaattccagattctcttgatttacctcgtttactcatttcttctctcttaaaacccatccccattcatctaggacgtcctacactccaaatgcatacgttcgtgtctcagtcaagagaccattggaggtatacaattcaaaatgcgtccaatatatccctttttttggataccaacgagcccattgtcctttccagcccgcaacccacgtcttcttttgtgtatcatatattttaatttgataatttccccttggattatctgagttgacaccaagcaaaatgccattcttttcgtatcccgcatatgtgccgttaattctgccggatcctggagcatacgcaaaagcaatcgtttgttcatcaatcttctgctttgaattagcgtctcttacttcacaatgaagccaataagtaccctcattatctgcccatccagcccaattcgaagatgaccaatccgcaattgttttccacacacccgcatttacatcgtaggacatccacttgtattccaaagcctgagtattcgcttccactgcagcgccaaccgctatatcttcagctcgaattacccaagtcaaatcaacgctggatttaaattctttattaccgaaagcattcatatccacggaaccgctgatgccattgatctgaccggagctggtgtactgccaaccacgatcgttggtactgaatgcggtaaatcccatttgagcaccatattgcgccacccaacgggtcttcgcatggatgcttgcgctattcaacggaccattcagataattggtgtacgaatacacgccgagattttgatatccacccgactgcaatgcgctgtaccatgcatcggcaatgccgttatacacattcggatcagtcggcggagtgtgccctgcccaagaccattgttcaagatcgtaaaacactgggtatctcagatcgtttggatccactcccatctgacggagcttggcaaccacatcattgccttccgcacgagcgcaattcgcatcatatgcatacgaataccagtagataccgaatggaatgcctaaacgtttgcattcattaatattgcgctgtgctttcttatcagcactattaccccagccataacccaaacggataatcgcgccttccgcaccatcagctttcgctttggcccaatcaatgtcgttctgccatgaagaaacgtcgactacgcccttggcctgctgaacgaacaaattgtttttgtaatcaaagaatgctttcgtattgttataagttccccaatgcgcgccatactggttgccgtcgaacctggcaagctgtaccgtcgacttcaccttcgaagaggactgtttcacaggctgtttcacggcgtctttcacatccgaaacacttactggaatgaatgactttccatccgtcttagccaatgggtcaggctgctgatcttgagtgccaatcaactgcggatcagttaccacttcgccggtttcaatatcttgcacgtcaccttcaggagtgacggcaagattctgtgaaaccatagtggaatcgtccgaaatgttttcgcttaccgtttccggcagcgtcgcgttcggattgtccggcatgctgtttgacgaattctgcgcatcatccacagttgcggcaaaagaacttggcgtatcctcaatcgcaatatcctgcatggcgtaagccggcaccacggcaacggaaaccgtcattgcaaccacggaagcggtggtcgcaatcttcatcaagcttttcggcgatatcatcgtcagcctctctcacaaaacgcattttcactcgttgacgcaattgcacacgcaaaacttaagtgtattctgagatgtccccactcaaaataaagcagatggattccaaaccaaacttcacatttaccgaatatgccacaacatgaagtgctggcattcggaagtggaacgggtaacataccttatgtattgtcatttgggaacagaggaccttgtcggaccacctccaatagacaacatcaaaacggtatcacggactcctggaggaaagcatggcacggcacgaaaagcagccggacaaagctgacggtcaaacaaatagcgtccgtaagccccgaacgttcagcagtaccgcgaccgtcgaaaccagcaaacccgacaattccgttaacatcaccaatcgtaacggaaagcctgaaacagacgcatcaggggtttcctatcaaacaaacaccaaagattcattccaaatcgccatatcgcaaggcgtgcaagatggcgacacttgggtacataaccatgtcaagaacttgattcgccgttccatcatcgtagccgttatcgtcgttgcggtatgcattgtggtcttcggcgtcatgggcgtgagaacatcgcagaaaatgcgcgaactgaatgccattaacgactgcagagacgcggttgccaccatgaacgcttcatattccaaggatttccagctcaagggaaagattgtcgacgcattttccagcatggattcctcatatgatctggaaaagctcagcaccttgtatcaggaagaagtcaaatcgccgaaggcgcttgactgcaaagccgacccgtccgggaccaccagcaaagccaacaccgaacgagccgcatatgacaaacaggccagaaccttcgagcgggcgttgacaaagaacgaggcaaatcagaattgaatacgaaacgattggcaagaacggcacttgccgttatcgtaaccgtaggaatagtcgttgccatcatcgtcgggtgcggccccaaatggggcaacggttcagcattgcaccaaaacgaagaaaccgcacagtcctcaaattcgcaggtttccgtgactttgccttcctactacatggaaaatatggtcttccagcgcaatcagccgttagtggtcaaaggaaccgtcaaattcgcgcatgccagcaaacagattgacgcatcgaaactatccgcaacacttgcccaaggcaagatgactgcgagcgccactgcgaaaatcgcaaaaaatggttcgtttacttgcacgctgaacgcacagaaagcaagcctcgagtcgtattcgttacaggtgaagtacgacggcaaagtcgtaacggaactggcgaaagtgtatgtgggcgacgtgttcgtggcggccggccaatcgaacatggaactcaactatacgcagtattacccggagaacagcgccaattttggcaacggaatcatcaaagagaccgatcttccaaaaccactcgtcgacaagaacgtgaaattcgttatcgcagatcatgatgtgaagaacacggattttccgctggccaacgtcaacctgaacgctggcgcgtggctgaatgcggattccacgaactcactgcatttgagctacttgacacagcagttcgcacttcagctgcgcgcgaagcatcctaacgtgccggtcggcatcatccagaccgcgtggggcggcacgcctatacgcagacatgtgcgcggcggagatatctacgcgaaccatattgcaccgttgaaagattttcatgtggcaggtgtgctctggtaccaaggatgcgacgatgcgatgaattttgcgaccgccacggagtatgagtcgcagatgaccgcgctgatcaaccagtaccgtaccgtattcggacgcaagaatctgccgttcctatacgtgcaactcgcgcgatggacgaactatcagtacacacagaacgtacgtgaagcgcagcggaccacgcttgacaacgcgaatctgcaagaccgttccaatgtggcgatgacggtttcccttgacaccgataaaggcacatccgcgctgattcatccactcggcaaggatattctgggcgcgcgtatggccgcgcagtacctcgccatggaaaacggtacgaaaaacgctgtcagcgtacctaacggaccgcttattgaacgtgcacggcatactgtggacggcaaaatcgccctgtctttccaaatcggcaccgcaagcggactgaaagcgatgcagccgaactatacgaagagcgcaagcgcgagcgcacccgattatacgaaaaattcgaaagcgacccctcttgacggtatcagcaatatcgtaatcccaacgactgcggcattgcagggattcgaggttgccaactcttccgggcaatgggtaccggccaacgccatcatcagaggcaaccaggtggtgctcagcgcggccaatggaacgccacttgacaatctcagcggtataacccaggtgcgttacctgttcagcggcaatccgaagtgcgcgagcatcctgtacaacgactttaatctgccggctagcccattcatcactattgttgagtgatctttgttgggggccgccgctagataaaccaatacgggcgggataagtacgggcggtctgagccgttgctgggcctgcttggtcatgttttgagcaggctgttccggcttctggtttggattctggtttcccgcttaaactatgaagactgctgcagcatcacagaaactagacaaatgtcattttcccaccggtttatttaggcacattcccctcctactatggcatacggaacgaacgcgagcgcacaatcacagatcgaatgcaaacgtgcgcaggagaggaatcaccatgaggaatcgtattgcagcagctgcagcggcgggaatattaaccatcggcatggccgtcctgccttccgcggcttcggccagtgaagtcgcaccgtctacggacggattggccggcagcaccgccatcagcgggcagatcgaccaggatatggccgtgtgcaccgatcaggcgtgcgaggccgtgcagcacttgaacaagacgaatcagcagatcaagtcggatatggaaaccgccaagcagcacgccgagcagctgcatcagaacgcgcacgaggacgccgacgcgcttcgccagtacggcgagcaggcctggaagaactaccaggaggaccgcgaggatataaagaatgcgattgacggcgcggtcaagcgcggtcaggagcgtcacgacgctctgcatcaggatatgcaggacacgcaggcccacctcaaccagatgcatgccgatatgaaggagacccacgacgaactcaagacgaggcatgacgcgtttgcggcgagcagccaccagtggcatcagtcgttcatcgcggcgctgaaggacgcgaactccaagacgggtcagcagggcggctcatccgttgctaccggcacgcatggcatcacggctggaacgaatgccggtacgaccgttactggagtcaacggcaccactggcactgtgcgcacggctgccgacactggcgcgaatggtgctgcaactggatccgtcacagcttccggcgatcaaaccgccgcgtccaccggcgcgctgaccaagtcggaatatggacagcttgcacaaaccggcatcggcatttcccttgcctgcgcagccattctgctgcttgccggccttgcctacgccatgaagacgttcgtgcagtataagcgcgaaaccagcgaagactgagccggctcgctgccggacagcgtttgcttcatcgactcatgaaaaaacggtctcgaatatatcgggaccgttttttcatgcgcgtttttcgtatgtgcttttcatctgctatacgcattgttgcgattcaattggaatgacgtagtacagcgacgtacaatgcagcgcggagcgcgcgtaccatgcgtgaaccgcgtgtatgtccagtattcccactgatttgttacgttggccgttctgatcagtccactggtcaattcgcataatggggagcgctgctggcgattcgcggcgacggcgtatcgtcattccccgccgtccgtccggtactacccgcgctccccacatcgccggccttttcagcattgccgatgttggttctacgcaacgaccccgcggccaacgagcggatagatcgcctgcgctgcgcctgttccgtctgcgaagcggactgaattgcgggaaaagcgcccgttacgggacgaatacgaccggttgcggtcggaataaagcttggtggcaaaacctgcgttgtgatggcgcttatggatgccatttgcggctgctgcgtattatcaggaccatccgcagcgtctttttctttcacggtttgcgattcttccgcacgattcgcgtcatcattcgcatcctcgcccgtttgcaaggcagacccagcttcgctctgcttttcttgtttttcctgcttttcctgcggagcggcctgcacatcactctgcaatacgattggcgatgaattcgaacggcgtcgggcaagcgccgccagagagtcacgagtatcagcatcgcgttggtcagtctgctggctgccggcagccgtcttgtcaaccatcgtcgtgcttctttctctcaacgtcacgatttcgagcgtaacgtagcgcagcgcaaaagtgcgcgtaaaacgacgatgtacgcaactcccccaccgaatcgcaatcaaatatcgacatatgagggcaaacaatcccattattgagaccacagactggcaccaataagccgcagcatggcaatcagagactttcctggatgccggcccgtacacgcgagacttgcgatacgggacgattcaaaaaaccgaggccaacgaaagaagcattcggagggaatctggaaggaaccggaaaacggagtggaaaagaaggaaccccagaaaccgaatgattccaacggttttcggggttccaatccgggcggagaatacgagattcgaactcgtgaggctgttacaccaacacgctttccaagcgtgcgccatagaccactaggcgaattctccaattatgcaacgctttccggtgtctatccgttaagcgcaacttgactagaatacaacaggactggcagaagaccaaatcggcgtgtcgctctaccaaatctgcaaaagatatagagctccaatatcggttcaaggttagtgacgttttgcaagactctccaataatccggcccaacatgtacatctcgtattcacgcaacatagaatgacggataaccacggatggcgtttaatgaccgactgtcgtccacgtaagcgtaaaaggagcggatgatgatcagccgagagaactacgacatactgaaggaaaaatacggagatgcgtccagctgggccgtctggaacacggattacgcggattccaagcccagccgcaatataaacgatctgagcgtattcgactccccgaatctgtccgaattgaacactggcttcgtgttcgtggggctgaaccgctccggtaaacccaaggacggcaacgcggagaaaaagccggacaagccgaaggatccgtggttcaatttccatgcgggaaggaacgatttcaaactgcgatatgcgctgcagggcacacggtattggggaagctacataaccgacgcaatcaaggattaccaagaaaccgattccggtgaagtggaaaagacactcaaaagtaacccggaacgcgttgatgagaacctcaagggattgagggaggagctcgagctactcggtggcaagcctgtattggtggctctcggatacgccgccgagaaaaatctgaaatgcatgaagtcggaagggtatgaagtggtcagaatattgcaccccgcagccttcatcggcaaaaagaagtatcgcgataaagtgctgaaagtcttggacaacattcaaaaataacgagacattcagctccgaaccacatctaaccatctaatccggatgggcatgagagaaaaatgggggttcccggagcgcgaacccgacgggaaccccggaaacgaaaaaggggcctcccgggagccaaaggctcgaccgggaggcccaacatgtgaagcggcggcgtgctactctcccacaccctctcgagtgcagtaccatcgccgcgcctggccttagctaccgggttcggaatgggaccgggcgtctcaccagggctatgaccaccgcaaaaccgcgatcacggaacgacaaccaaaacatggcggccattccggccattatgttatgaaccgtggcggtctgggaaccggctagcggacgcgaggcaaagcctaccgttgtatcgttcagtgaccatcccaacgcatattgccgtccaggacgatccagcacaggaaagacgcggaaccaatcccgcaaaaggatcggaatgttatgtcgccgtcgcccgttagtaccggtcggctccacccctcacggggcttccacctccggcctatcaaacacgtgttcaacatgcgggctacaacagttcaagaccgtacggaatcctaatcttggagcaggcttcccgcttagatgctttcagcggttatccctcccgaacgtagccaaccggccgtgccgctggcgcgacaaccggcataccagaggttcgtccacccaggtcctctcgtactatgggcaggcctcctcaggattccaacgagcgcagaggatagagaccaaactgtctcacgacgttctgaacccagctcgcgtgccgctttaatcggcgaacagccgaacccttgggacctgctccagccccaggatgcgacgagccgacatcgaggtgccaaaccatcccgtcgatatggactcttgggaatgatcagcctgttatccccggggtaccttttatccgttgagcgatgccgcgcccgtgcgccggcaccggatcactatctccgactttcgtccctgctcggaccgtcgtcctcgcagtcaagcccgcttgtgcgattacactcgacacccgattgccaaccgggctgagcggacctttgagcgcctccgttactctttgggaggcaaccgccccagttgaactacccgccaggcactgtccctgacaaggatgacttgtcgaggttagacgtcaaacgagaacagagcggtatttcaccttgcggctccacgaatgctggcgcacccgcttcgaagcctcccgcctatgctacacaatccgcgcctaacgccaataccaaggtatagtaaaggtcccggggtcttttcgtccttctgcgcttaacgagcatctttactcgtactgcaatttcgccgagctcctggtcgagacagtggggaagtcgttacgccattcgtgcaggtcggaacttacccgacaaggaatttcgctaccttaggatggttatagttaccaccgccgtttaccggggcttgaattcaccgcttcgtccccgaagggattgacggatcctcttaaccttccggcaccgggcaggcgtcagtgcatatacagcggctttcgccttcgcatgcacctgtgtttttggtaaacagtcgctaccccctggtctgtgccacccaccaaagctccggacgcaaggtccttcaccccagtgggtctcccttataccgaaggcacgggagtgatttgccgagttccttgaccaggattcgctcgatcgccttggtattctctacctgaccaccagtgtcggtttggggtacgggcggccatggccctcacgccgaggcttttctcgacggcctggacaaccggatatcgaaccataacggctcccatcatcacacctcgccatgcacgccatgcggatttgcctacatgactggctgcgtgcttgaccacggaaaaccacctccgcggccggctcccattccgtgtcacccctgcgctgacctactgcggctacgctcccaacaccacgcggcgataccaacccgaaggaaggaaccaccacgaggcggaggttagtactcaccgtctcggttttgccggtccatggtcggtacgggaatatccacccgttcatccattcgactacgcctgtcggcctcgccttaggacccgactcacccggggacgacgaacgtggccccggaacccttggtcatccagcggacgggatcctcacccgtctctcgctactcatgtctgcattctcactcccacgaagtccacggccggtttccaccgccgcttcgcccctcgcaggacgctctcctacccagcaaccatgaagattgctgccgcgtcttcggtggtgtgcttgagccccgctacattgtcggcgcggaaccactagaccagtgagctgttacgcactctttcaaggatggctgcttctgagccaacctcctggctgtctatgcgactccacatcctttcccacttagcacacgcttcgggaccttagacgacggtctgggctgtctccctctcgacgacggagcttatcccccgccgactcactgccggaatacacgtcaacggtattcggagttcggctgctgttggtacccaacaagggcccgcaagcatccggtagctctacccccgcgacgcaatcgaccgacgctgcacctaaatgcatttcggagagaaccagctatcacggaatttgattggcctttcacccctagccccaggtcatcccccggttttcaacccaggtgggttcggtcctccacgcggtcttacccgcgcttcaacctgcccagggctagatcatcccgcttcgggtccaggacaagcgactgaaaacgccctattcggactcgctttcgctacgcatacgccacacggcttatgctcgccacccgccactgactcgcagactcatttttcgataggcacgccgtcaccccaccagggaggctccgacggtttgtgggcgcacggtttcaggaactgtttcactcccctcccggggtgcttttcacctttccctcacggtactggtacgctatcggtcagacaggtatgcttagacttacccaacggtctgggctgattcacgcgggattccacgaggcccgcgctacttgggacaacacgatcggaagacggctcacgtccaggtacggggctggcaccctctacggccaggccttcaagcctgttcccctggcaagccgttttatgactcccgcccggcccgtcggaaccgggacacgtgatcccacaacaccggcaacgcaacccccgacgggtatcacgcgcaaccggtttggtctgatccgctttcgctcgccactactcacggagtatcccttcctgcaggtactgagatgtttcacttccctgcgtaccccccgcccataggcggtgccggcccatgacggccggcgggttcccccattcggagaccctaggatcaaagccatgttggaggctcccctaggattatcgcatcctcaaacgtccttcatcggtactgtctgccaaggcatccaccatacgccctcgcaagcggcacaacagcaaaaccatcgtcccacccgcgggtttcctgatagcaagatcgccagacgacaaatcttaacactaaaatgatcacaaaacgatcgatctcgaaaccaaactcaattgaagagtttggcgaaatcgcgataagcaaaaagaaacgttctttcagtttctcttgctcgcgtccactatccagttctcaaaccaccacgcgccacacgatccgaccagccacccaggaccggccaccacgcatgggcatcgaaccgcgccacagaaaacccgtggggtggcggtccgggagcccaaaagcatacccataccactcccggacgggacgaatcccatccaagccattgatctcttccacaccagcatccacaacaacgacgccgactgccggcgcccatgtggctcacactgtccaaaaacatggactgtattctccgtagaaaggaggtgatccagccgcaccttccggtacggctaccttgttacgacttagtcccaatcacgagtctcaccttagacggctcccccaaaaaggttgggccaccggcttcgggtgctacccactttcatgacttgacgggcggtgtgtacaaggcccgggaacgcattcaccgcggcgttgctgatccgcgattactagcgactccgccttcatggagtcgggttgcagactccaatccgaactgagaccggttttaagggatccgctccccctcacgaggtcgcatcccgttgtaccggccattgtagcatgcgtgaagccctggacgtaaggggcatgatgatctgacgtcatccccaccttcctccgagttgaccccggcggtcccccgtgagttcccaccacgacgtgctggcaacacagggcgagggttgcgctcgttgcgggacttaacccaacatctcacgacacgagctgacgacgaccatgcaccacctgtgaacccgccccgaagggaggccccatctctggggctgtcgggaacatgtcaagcccaggtaaggttcttcgcgttgcatcgaattaatccgcatgctccgccgcttgtgcgggcccccgtcaatttctttgagttttagccttgcggccgtactccccaggcgggatgcttaacgcgttggctccgacacggagaccgtggaatggtccccacatccagcatccaccgtttacggcgtggactaccagggtatctaatcctgttcgctccccacgctttcgctcctcagcgtcagtgacggcccagagacctgccttcgccattggtgttcttcccgatatctacacattccaccgttacaccgggaattccagtctcccctaccgcactcaagcccgcccgtacccggcgcggatccaccgttaagcgatggactttcacaccggacgcgacgaaccgcctacgagccctttacgcccaataattccggataacgcttgcaccctacgtattaccgcggctgctggcacgtagttagccggtgcttattcgaaaggtacactcaccccgaagggcttgctcccagtcaaaagcggtttacaacccgaaggccgtcatcccgcacgcggcgtcgctgcatcaggcttgcgcccattgtgcaatattccccactgctgcctcccgtaggagtctgggccgtatctcagtcccaatgtggccggtcgccctctcaggccggctacccgtcgaagccatggtgggccgttaccccgccatcaagctgataggacgcgaccccatcccataccgatgaatctttcccagaaggacatgcatccaactggagcatccggcattaccacccgtttccaggagctattccggtgtatggggcaggtcggtcacgcattactcacccgttcgccactctcacccaggagcaagctcctgggatcccgttcgacttgcatgtgttaagcacgccgccagcgttcatcctgagccagaatcgaaccctccacaaaaaaaccttttcatgaagagacatcgacacgatgactctcgaaataagaaaattgacgatcgccttataaggaaaggcgcatcgcacaaaaacctcgccgccgtttgaccgatccctcggcaccacgcgtcagcgtggccggcaacgaactggcaatcattgactataaagaagtagtacaaatacgctcttgagttctcaaaccaccaccactcacccacctcgcaatccggagtgaaccggaccactcgctgagcggcagcaagagataaacttacagcacgatcgcgatccgcgcaacccgggccgcatgaacaacgcgtgaaccgttggaaatccaacgttccatcggcgtgtcgaaacttgacaaatcagagcctcttgttctcccaatcgcctatttcgacgccacgcagccacgcaacacacgtgatcactggcagttgaactggtacaacgcccagcccttcgcatatgaagccatattcgaataatcctgaaccttgcgcatcgtgccatctttggcgtactggtcgatcagcttttgatcgtggaacgtgtcgtactgctgcttgaacgtgaacatctgcaggctcggcgcctggccacccatgctcaggaagtatgcatcgccatccgcgctcagcgggcagacggtattcgtcagcaccttgccgtcgcccgacgcgaacgcattctccgtctgaccgaaaatcgcaccattcttctcggccttcgcgttgtaaatcgggaacagcatatccgcgccgtacatcgccgtcgcatacatggaaccgttcagcggatcggaaaccaccaccgaatcggtaccagtctccttcaccaccttcttgagaatcttctccttcgtggcagtgagctgctcgtccggccgcgcatcgtcaatcgtcatattcgcatagacggcatccgacagggcggaacgaacagtattgccgaattggcaggaaatggcgagcgccgcaagcagaacaatcgcaatgattttcgtgacgttcggcagacggccggcacgcaacaatacgacggcggcgaagacgatcagcggcagcacgccgaacggaatcatggtaagcggtcgggtttcggcgcgataccaggcggcggccacgatgttggggaaccagccagtcagcgcggtcgagcagacgtagacaagaccgaccaggaagaaggccagcagaatggcgatcgcgtcgcggcggagttgcgaggcgtcggaacgtggagtgcggtagctgacggaagtcttgcgattcctacgatcggcaggcatagccgcaaaatcggcaacctgttcgtgcggttgcgctgacgtgctatcggatgcacggtcaatcgcagaagcgccgggcacagtagcggaatcggcgcgattggcggcgaaccattgcgggcggatgatggctgcgacggtgacggcaaacgcgatcagcacgattgcggccatgaaccagccttgcacgccgccgatattgtcggtgacgtagattttgagcgcttcgggcaccgtgcggttcggaacgaaggtgtggaaccagctggcgggattgaagtagcggtccgatttgtagctggacatcatgtatacgaggaacacggcggcgccgagaaccactacgccagcaaggcctgcgatggctttccacggcagtcgcgtcagtacgaagggggccatgagcaggagccaggtgaacacgatgcgcggatgggcgaacatgcagacgccggcagtgacgaagaaccatatgatccatttgacgaggtgttcgcgggtggcgagcgcgtcgagcaggcgaagtgtggcgtacagccagaacggcagaagcgtggcggccaggccgaaggcgatcagcggaccggaagccagcatttggaaggggtgcgaggcggaagcgacggcgagcggggggatgatgagcgcgagtatcgcggggaatagcggaactacgacagacgcgacattgcgggccgaggactttcgtgcgttcgcaaatcggggggagcatacggattgtgccgaatgcgacaggcgacgcgtgaaataggaagcgtacagctgaatcgcaatcggccaaaccaagccggatgtggccagccagaccgtgttgaacgcgacgtaaatcgacagattgacgccgaacaagctggcgagcttaatcatgccggctgcaagcagatggaacaacggcggatagtatccgtcgttcggccacaggtgggtggccgcgccgacgccttcgccgaggatcttgcggatgaagtaatagtgcgcgggcgcgtcgatttcgtgcaatgggttcgtccaagcggcggaaccgtgcggaaaccaggcccatacgatcgcagcggcgagcgcgacgccgatggcggaacagaccggcagtgcgatgcgggataagcggggaacggcggaatcgcaaggcaaaggcaaagtatcgttcgtcgtcttgcttgatatcttgtccgtcgttttagccgtcgtttcgtctgtcgtcttgcttgcggcgactgcgctgtcggcttcatcgactgcgtcgtcggccgctgtgggaatcgtattgtctgtgctgtgctgcttcatcgccatccatcgtagccgaagccgcgaaagcaagccacaaatcgcaatcgcacctgcattttgtaatccaaaactggaccgtgcggcaacaaaagctggaaaggcatctaaaaacggatggaacatgcgcgggatgggcgcaagacggacgcggaacgcgggaagaataggcggacgtagagcggagacgagcgcgagcaggaacaaaatcgccgcttatccaaccttcgattttcaggaagtattcagacttcacacagaggtataacagtgttgcgcaagaaaacaatcacgttggatgggcaggatgattgcacggggcgcattgcgctgtgagcgtactcgctgtcgttgcttgactgtgtgcgtcccggccaacgctggcgtcggcatgcgtcgacgcgtaactacagagaactggagaagtaccgcatgttcgttctcaagaacgcatgggctgcgctcggtcgcgtcaaatggcgtaccgcgctgacggctttgcttgcactgctggtgtcgttctcagccgccgtggatctggcggtgctgagggcagatgacaaggcgaataacgaaacataccaatcgcagaaagcttcggcggtaattcggccgagcgcgaaagtcactgcgaaacgcgacggcgcggactccaattacaccgccaattacatgacgtgggacatgtacaccaagtacgcggaagcggtgcagaagaacaacttgacgttcgaatacacgctcgccacgtcggtgccggtgcgcgccagcaagtcgctgcaggcgatcgcggcgaaaagagacacgagcgaggacaagaccggcggcaacctgacgttgcaagccttctacacgaacgatgcggcgaaaatcaacgactacggcacgttcaaagtggtcaagggcaagcagctgaactacaagacggccaacgacggcgtgctggtctctcaggcagtggccaagaagaataatctcaaagtgggcgacaaggtgaccgtcggcaatccgacgaaggcttccgaaacctacaaattcaccgtgcgcggcatctacgagtacaccggcgagacgccggccggatacggttccgacgcgaaatacgcgaaagacaaccgcgagaacgtggtgtacacgtcgtacatcaacttcgcgcaaagcggtctggatgtggccggcaccaagggctgggccatcccgaacctcaacatcatcttcacgctgaccgattcggccacatacaacaagttcgtgcgactggtgacaaaggccaagctggacacgtcgaagttcacgatctcatcgccgtcgcttgatgcgtacaagaagcgcatcgcaccgctggacgccgccgccaaggccgcgcgcacggcgttgttggcgaccctgatcgtcggcgggctcgcgctgctggcattggtgctgtgggccgcgatcggtggacgccgtgacgaaatcggcatggcgatggtttccggcgtcaccaagggacgtttgggatggcaattcatgctggaaacgttcatgatgaccgttccaggctgggcaatcggattgattgccggcgcgctgctggccaagccgcttggcaccgcatgggccggtggacaggctgtggccatcacatccgcatccgtgtggaacatgatctggtacggactgggcgcctgcctggttctgggcatcatcgcgttcatgcgcgtgggattcttcgatttgggtcagctgttcgcaggccgttctgacgattcgaacgaatctgccgaagcgaagaacgcagacgagccggaggaaacagtcgagtcgacggaacgtacggaggtgaacgcatgagcgagaaagacgtgaaagacaacgaaaccgaagcattgaacaacgatgctgcggaaaacgcggacatcgaggcgggcgaaaccgatatggccacgtcgatcgaatcggtcgatttcgcggtggtgtatgacgatggaggcgattccatcgcaaccgaatcggcagaaaacgcggaaaatacggaaggcatcgccacggaagacagcgttgccagcgacaacgcgaatcgcgtgaacgaaacgctcgcattgggcgcgaccgacgacgaacagtcgctcgaccagcacgaaaccgtacaggcggactccgcaaccagcgtgtcatcgcagatcgaccgcgaaatcaaacatcatcgcaagaaggacgcattcttcttcaaagcgaacccgacattcgcgctcgaccatgtgacggtgcacaaccgcaaaaccggtcgcaacgtgctcaacgacgtttccctggcgttccatgccggcgcgacccacgcggtgctggtggatgccgaagatgtcgaacagcatcaggcgctggtggccaccatggtcggcatgatgcggacgaccagcggcaacgtgatgcacaaaagcacgaacctcgccgacgcgacaccggtcgacgtgcttggacaccgcatcggtttcattccgcagcggttcgccgtgcgcggcgaccttgacgcggaaggcaacgtgttgtacgccatggacgcgtcgaaccgcaatttcctgcagcccaagccggtgattgcgcgcgagctgctcaagcgcgtgggattcgaggaagtgacttccggtctgccggtgggcaagatgagtgcgttggaccagcgtcgtgtggcaatcgcgcgtgcgctgagctgcgaggcggaggtgattattgccgacgagccgaccgctggattgaaccgtgacgacgccgccgtggtgctggggctgctgaagaaggccaagcgcgatgaagatcgtaagcgtgcgattattgtggtgaccgataatccggaggtcgccgatcagatggagcattgcgcggagcttgagtagcgagcggcgttctgcgaggcgaaagccttgcggactggtgttgcatgccagtccgcaaggcttttttcgtgctggttcgttccggttcattctgggcgcatgtcatatgcgctatgtgtggcagattctttcatctttggaatctcaaaaccgctatgtgtggcaggttgtttgacgcatcgtgagttagaggggcggttttatgcccccctaatgtatggcgggaaagagaagtgccacagatagcggctttcacttttccgtagatggagaatctgccacagatagcggttttcagtgcgcaaaactcgggcggcggccaggcttcgaggaattttcgggtgtatctcgcttatgaatggcggatttttccgctcgacgcgtgctatctcgcttatagatggcggatggttttgccgcatgagacttagaggggattgaacttgccccctaacacctagtctttctgagacacccgccattcataagcgagatagcatccggcagacaccgaaatccgccattcataagcgagataagtaggttcgctactcggcgatgcgcatgtggtactgctcggcgagcggtttgacgtcgaggacgccgtagcgttccagaaggcgcagccattcgcgcttgttgctttcgccgaaacgggcggccttgcgcgtgtaggcttcggcggtcaggaacttcggcggaatcgacttgctgttgtacttgtccgccaccatgacgacctcctgctcgaggttcatcggcacgtagtcggccgggggcaacggcaatccctgcgattccacggtttcgcgggtgaggcccacacctgtgtggttgcgtgcgaactgggcgatcgattcgtcaacgccctcgttcagcaagtattcgtagcctttgagcccgtgctgaacatagtgcggaccgtcgaatttgagcggttcgccgtcggaaccgtcctgcttgagcaggaaatacgtgccgatgtcgtgcagcaaaccgccaatgaccaccagatgctcgtcgatgagccgcggcggaacggtacctccggtcagcccttccgtggacggcaccgcaggcatgtgcaacatgccgagcgattcctcgccggtattgtctttcgtcagttccagcccgaagtcgccggttttttcgggagcgtccgtcggcagggtgcagcggcgggtgaacagcgcgttctgccggcgggccatgcggcgggcgatgtcggccacgaccacgcaatggccgtggataaggtcgtatgcggcttgcgattgcgcgattttgcgatgtagctcatccacttgcgcaagagtggggatatagccggtcgtcggcttgttcgattcggttgtttcgttcgattcgttcgtcatacgcccatcttaggcacgttccatcacgcccagcatacggttcttgacgcagtttccaaaacggttcccaacagccgaagagattcatacaccacgccagataaatcccggaatggacacggattcaacggtttctccgtcttgtcaacgatgttccaaggaatgccgccttaaaacgagcattcatcagctgctcgcagcggacggcacgatgcgcggggacgttatgtgcggaaaatcagatggaacggacgcggaattcgccggtgcggttggaagccacgatcatctggtcgttttcgaggcgggtccagccgtcttcggcgcgctggtcgaaaccggagctggccacgaccacgcccttcgactgatcgtcgtttccgccgagcgcacggtagcgcagcacgcgatagtcgcgcgcctgctcgccgcgaccgtactggtcgtagatttcgacgatgcgcttggacgtgacctcacgtccggccgcgcacagggcgatgaactggtcctggctttggatcatgcagttgtagctggacttcggatagcttttgcgcagttcacgcacggcctgcgccaccgcctcgtcgagtgcgaagccaaagccgatgtattgcaggatgacggcgaagaaaatggcggaatcggaacggccgccagtggactgcacgatgctcggatcgaccgggaatgcacggttcgtaatgatgttgcggccctggtcgtcagaaatgtcgccattgtggatgaagctcaggccgttcgcatagaagggctgctggttctcaagaatcagcggcaggttggagctggccaagcgcaggtgccacaggccgccgcgcgccggagtgttggcgagctcgtcgaaaatcggatcatgacgggcggcgatggtgtttttgtagatcgcggtgccggtttccggagtcggcgcaccgccgtcgcgacggtatggcgattcgtctggcacggtgatcagcgcggcgccccagccgtcgttgtggatctcgctcagatttcggaaatcgcgcacgttctgcatgccgagcacgccattgaggttggtgttgctgcctgccgtcgcgaatccaagtaatctgcacatggttgattactttagcgacggcaggtttcgacgcgcgcgtgccgttatcggagttggttatagcctgcgattcatccgccgattcatatgcatcgcacgtcgcaaaacgcacgtcacgaacgtaagttgtcccgcaaacgagcaggaggaccgacatatcctgttgcagaccgtaaaaactcggcctgagcggcccggagcgtgtcggtaataggatatgccggtcctcctgcggacttggcggtattcagccaaaggaaaagggctggggcatctcgttcgtgacacactcaaggccgttcggccaagcctacggtcacaaacgaaatgtcccagccctccttgcgtagataagccgtgctcgcagagcgaattcacacgcgcttcagacgcggcggacgctcggtggcgaggaacagcggctgaatctcaatcagcggattgtagggagcgagtccgaaccatttgaccggagagccggccaaatgacgaatcgcgtacttgatctgcagtgagatcgcgcccttctgggacaccttcgactcgggcatcaacgccttgtgaatcagcacgtagcggataggtccgatgttcggatcggcatccagcttcgggtagcgggtggtctgcttgggcagatcgccggacttcgacagatcgttcatgatctggtggatgtatgcaggaatcgactgcgacaccttgaagcccaagcgaatacgcacgcggaacaggaagtccgtgccgaaattctccaccgaatactcgcgcgtgaacgggttgtcggacgtttccaccgacaccgcccaccatgcgcgggcgcgcttcggatggtccgcgaaaatcgagaagaagatgtcggtatcgacacgcttcatttccggatcggacgtcagatagacgatgttgtccgcgaaatacggaatcgaatcgtcctcatgaagccgcttcagaaccggcacgcaatcggcgggctgcatatgccggcgttgcgcgcgttccagcttcgtgccttcgttccacgtgtacataatcagcagaatcgccaatgtcagcagcatggtgaaccagccaccgtgcaggaacttcgccatcgaagcgaagaagaacaggaactggatggccaggaacaccactgtgaacacgaccgcgccgacgcgcttgccatcgtgccaaatgtagacggccagcagaatcgtcgtggtgatcatcgtgacggtcaatgccaggccgtacgcggcggaaatatgctccgaatcgcggaacatcgccaaaaccagcagggtggagacgcacagcacggcgttgaccaccggaatgtacagctggccgcgggtacgagccggatagcgcacctgcaggtggggcatccagttgagtcgcgtcgcttcggaaaccatggtgtaggcgccggtgatcaacgcctgcgaagcaatcacgccggcgcacacggacagcagcaccgccacgtaacgcacggacggggtcatcatttcaaagaacggattaaggccgtgcatgtggttgtacgcggtgtcgtcccaatggttgagcatccacgcgccctggccgaaatagcagaacacaagggcgatcttgatgaacggccacgtgaagtagatgttgccgcggccgacgtggcccatgtcggaatacagcgcttcggcgccggtggtggacaggaacacggtgcccatgacggcgaggcctgccgcattgtggtggctgaagaggaactccacgccgtacaccggattcagcgcttcaagcacgctccaatcggagctcaggttcaccaagccgacgacggcgaggaacgagaaccagatcatgaccaccgtgccgaacgtgcggccgatgcgttcggtaccgcgcgactgcactgcgaacaggcagacgatgatcacaatggtgatcatcagcgtcagttctttgtttccgctcatgatcggttccagcagcggcagtgtttccaagccttccactgccgagctgatcgagacggccggcgtaagcacggaatcggcgaggaacgcggcgccgcccagcatggcgggaatcgcaagccatgccccatatttgcggatcagcgaatacagtgcgaagatgccgccttcgccgttgttgtcgatgcgcatggcgatgaacacgtatttgacggtggtgatcagcgtgatcgaccagaagaccagcgacaggatgcccagcaccgcggcgcgatccgtatgcgccaaaccgccttggccgttgaggaacgtctgcatggtgtacagcggcgaggtaccgatgtcgccgtataccacgccaagcgccacgatggccatggccggcgtgattttgtccgggccggactggagacggctccaccagcggccgatgcggcccttgctggcggcctcgtcaagtttcgcggcttcctgctgctgcgcctcgtgctccttgatgagcgtctggcgctcctccttggtcaggaccttgtgcgagacctttggcgcctgcgtgtacgtcgctgcgtgaagcagcgactgttcttcttcgttcggctcgttagccataacgcttcctccaagtggcgggccttccaacccgctccccaaaataaaacgcaaggtgtgacaccaggagcttggcaaaccattgtcaaatcttcacacgtgattcggcacgtcacgcatgaaattcacatatgcttagtcgtttgtattttgcttattttctggcgattacgcaactgttacgttgaggcccatgcgaccgtcacggaaccgccacgggattaccgcgaaatcgccattctttttagataccgtacacttcgcgcgtcgtttcacgcgtggctttggcgatttcagccaacggtctgtcaagatagtcggcgagcgcctgcagggtgtacgggatcatatacggcgcgttggtgcggccgcggtagggcatcggacttaagtagggggcatcggtttcgaccatgacgtggctcatgccgacgagtttcgccgattcgcggattccgtcgttgcctttgtagctggatgtgccggaaaggctgagataccaaccgttttcgcgggcgatttcgcccatttcggcgtcgccggagtagctgtggaacacggtacgttcgggggctccgtcggcgagcaacgtttcgatgacttccttgtgcgagtcgcggtcatggatttgcatgggcaggttgagttccttggcgagcgcgacgtgggcgcggaacgcctcgcgttgcagttccttggcggattcgccggtacgaaacaggtccatgccggtttcgccgatggcgacgacctggttggggtaggtggtggcgaggcggtgcacttcggccatggcttcgtcgaaggggatgtcgtgccagggcttgtatttgatgggcaggccatcggggccgggtgcgccgcggtggccgtgcagcacggcttcgttggggtgtatggcgattgcggcgtgcacggttccggggtgttcgcgggccatgtcgatggcggtcatgaggttgggcagctcgcagccgcagtcgattacgccttcgacgccgactttctgggcttgttccagcagttcgtcgacgctgtagacgggtacttcgccttggcctttttccatggcttcgtgactcatggcttgggagaatggcacgacggatgcgacgtgggtgtggttgtcgatgacgtgcgcgtcttcgggcagcggctgtggggccggggcccaattgcgattgcggtggtgcttgctcatgttttccagattagtcccgattggccctgcactgcgggcgaactctcgttcgagggttcaaacgagggtccgcccgtttcgcggcatacacgtcacttaatcgtgatggtggtgaacgaccatgccggtgccgtgtagtcgccgtctgtcagatcaatcgcggtctgccgcggcctggtcggtgattcctcaccgacctgtcccgcatatggattgtctccggctaggacggtggccgtggcggatgccgccgatgctgtggaaatattcaactcggcaagaatctgacgtaggtcaacgcttattggcgcgtccatggcattgaccacgcgcacgtaggtctctccggctttgtcattacgtgatacggtgacggtacgccttggctcgtccttaacctccgtgccatccgcaatcagcgttccatcgatgtacagcttcatggcttggccgcgatcggtgacgtcaacgtgcacctgccaagtggtgcccggtcgcacttcgttcatggagacttcggtgccggcaagcgcgtaggcggtgccgtcgcggaccacgcgcacgctgtgtcctcgaccaagtgagatgatgttgtggttcttgccgtcgatatcgccacagatgaggtccatgccccatcgtccctcgtaatagacgacggtagtgtcgatactgtaggaatcagcgtgcagatcgagggcggtgtcgatggttctgccatcgtaggccacgttgccgagattaatcgtctccccggatgcggtggtgatggtgagattgttgagatcggctttggcattgcccgcgatgcgtagtctcacggtgtccggcaggctgcgacgcaatgtggacgggccttcgacggtgacgggccacgcggtgtcggccgtggtggtggcgtacatctgctgcacccaatagctgtaggggtgataggcacgctcgttgtcgaagtagataaggtccggattccagctgtggtggccgttcttggcaaacagcggagcgtaggaggccatggccaccacgtcgccgttgagttccatgcgtcccatgaaggccgcttcggacaggccgttgatcagttgggtgttccaggagccgtattcgccgaggtagaccttcggccccttgcggtccgtgtggtcgtagtggtcgaggttgtggaaccaccagctggacgactggtaggaatgttcgtcgacgatcggcagacccgcttcgcgcgcgtacttccagccttcctcgtaatcctgaccgctgggggcgggaccgacggtgccgacgacgacgatgtccggatatgcggctttgacggcgtcgaaaatctgctggaagcggtttttgaacacgtcgtcgataagatcctcgttgccgatgccgaggtattcgaggccgaacggctccgggtgacccatggcggcgcgcttggcgccccattcggtggcggtgctgccgttgcagaattcgatgaggtggagtacttcatcgatgtaagcgggcatatcctcctgcgccaccggcaccgggccttggctggtgttttggcagctcacgccggcgggcagcaccggcagcggcttggcgccgatagtttcgcacaggcacaggtattcgtagtagccgatgcggaatgactggtggtagccccagaggttgaagttgtgcggacggtgctcgaccggtccgatggtgcggtcccagtggtacatgttgtccatgccgaggccgtgggtgatgcagccgccggggaatcgcatgaatcgtggtttgaggtcggcgagcgcctccaccagatccgggcggaaatgcttgagaccgtggtaggtggtgcgcggctccaaggcgacgaagtcgaggtcgatgacgccttcgccggcgaaggccagacgcaatgtgccctgtgtggccacgctcgagccggcatcgccgtgctcaggaacggtcagcgaggcttggtatgtcgtccatgccgaggctgagacggtgatggtgttttcggcgatgatgctgccgtcgtctccgcgcagcgagaccgtcaccggcatcgcgctttccgatcgcacgcgcatccaggcggtgaaatcgtaggtttctccggcgcggaacaccatgccgtcccagccggtgttgtccagcgcggcaggggcatgttcgacttccaccgtcgcgtaatgcgggttttcggtggcaaccgggtcattgtcatggataccgaaggctgcgaacgagccttccggcacgattttgcgccagaagctgtagttgctccaatcgatggagtcggcgcggttgtattcgaaggcaccgttctgcacgaggtcggcgttgaggccgccgtcgccggagtagctgatgtcttcgaagaagatgccccacaggtcggtgctgatggcgcgcacgcccgctttgtcgagtgtggcggtgagtttgtcggtcatggtgtgtccttgaatggtgttggttgttgggttggatggtgttgaggtatgtgcgattgcacggtttggcgttcgtttcgcggctattcgccgccggctggcgtcagacgggctcagtcgagcgcgaaccagaggcagccgtgcgcagggatggtgccgcggatgacgcggtcctcgccttcgccttcgatgcggacgtccgatcggatgccgtcgggcgattgcggagcgtcggcccacaaatcggtgagcgtccagtccgcgttgcgttggtcgatgccgacgaagctttgcagctggatgttgcccttgagctcgtacggttcgctgccggtccagaagatcgcgccgtagtggccgcacgcatgtgccgacgtggtaccgtcggcccagtcggccgcgtcggcggtccatgcgatgagctcgccgatgaaggattcctccacgttccattcggcgaacagccgttcccggacgatttcgcggttgccggacgagccggcggtcacttcgcgcagggccgggttggcgagcagtgcgatggtgtcagcgttgctggtaggcagatcgccgccgaccatcaacggggatctgcccatgctccacagggtgagcagtgttttctgctcgtcgcgggtcagtttcgattggcggtcatcgccgcgttcggcgcgcaggccgatatgtccgagcggcagcatgtcggcgtcggcccaatggccggtgcgctgcatcggcgcccatcgcgcgagccgggggaactgctggtagatgtcttcccagcggtcccacaaatcgtcggagatgcgccacatctgcgagacaccgcggagaaaatcgacatgggtgctggccacccagcctcccggggacagcgatagcgtgatcggtcggccgtaggcggcttccgcgcgttcgatggcgtgatggtaggcctcgatctcctctgggaagaacggggtctgcatgtcgtcgaccttgaggaagtcgagcccccaggaggcgagcaggtcgacctgtgcgtcataccaggcctgcgcgccggcatcgccccgcttgagaccatagttgtcgtgattccatgcgcaagtgtgctcggtgtcggcaacgtcctgcgcatgcagcgcggtgcctttgaccggcaggttctcgtgcacggcctgtctcggaatgccgcgcatcacgtgcacgccgagtttgagaccgagccggtgcaccgcgtcggcgagcgggccgaatcctttgccgtctgccgcactcgggaaacgttgctcgtcgggaatctgccggccatatgcatcgatgcacaacggcgtgccgtcggaatagccatgtgcatgggcgttggggtcgaaccagccggcgtcgatgaccagcgtgtcccagccggcgtccttgagatgctcggccatgaagcgcgcgttgtccagaacctcctgctcggtgatggtggtgccgtaggagtcccagctgttccaacccatcggcggacgccaggctttgactggcatggcctcgggtaccgtgtggccgtcagccggatattcgtcagccggggcgacggaaacggtggttgggatcgtcatcgaacctctcttttcgttcgggatcgctatgggggctgtgtcgcggaaagcaggacgccgtcatgcgaaccgtatatgtatcgttacatatactagcgcaaatccaatcatccgcaatggaggcaatatatcggtgagtctttgtatttgcaacgattttacagaatcaagagaatataatatcgttacatatcaatcataagttttcaaggagcggcatatgaccagcagcacaccgacgctacgcgacgtggccgcggaagcgggcgtctcccccatgaccgcgtcgaacgcgctgcgcggcaagccaggcgtcaaggaatcgacccgcgccaaagtgatcgccgcagcgaagaaactcaattaccgcatcaatctgacggccagcatgctcaaatcgggccgcagcaacatcatccacgtcatcgtcaacgaattcgattcgccgttctattcaaagctcacgcaggcgttgagcaacgaaatcgtgtcccgcggacttattccattcatcgagcagacgcagtattcgccggacgctgccgagcacgcgctgagcagcaatccgttctctgggcagctgttcgatggcgagatcctgcacgccacaggcttgggcacaaatgtgccgctgtccaaactcaatggcggcagaccattcgtgctgctggacgcctgcgaggagacgccgaccgtcgatgccgtgaacttccccaacgaggaggccgaacgcgcggcgatgcagcatctcatcgaccgcggatgccgcaatatcgcgatcgtcggccaccggttcgcccccgcgccgatctggcgcatgcccagaacgcgttcgctctgcgattgcgcggcgcatgcggagcgctgtccgacgccggactgccctatgacgagtcgatggtgttcgaagccggggatgtggccaatggcatcatcgccgggcatgcgattgcggaacgtattctcgccgcacggagcggacatggtggcaccgagttcgacggcgcgtgctgcgccaacgatttcgcggcgttcggcgtgatacgcgggctcgcggaccgcggactgcgcgtgccgcaggacgtgaaggtgatcggtttcgacggcgtgacctccggctcgtacacgacgccggcgttgagcaccatccaggtcgatttcatgcagcttgcgaaattctcggtcgatatgctgtccgaacgtatcgatcatggagcagacgaggcgttgccgccaagacgggccatcatcggctaccagctggtggaccgggaatcgaccgcggtctgaggatgacgcccctatggcaggcaatccgccataggcagcagccttcgcagccaatcccactcaatcggaatcactcaatcggaatcaatcgccatcattcatcaaggaatctctaggagcatcatgagcatcgacacccaggcctatctgttcgtgcatttcatcggcgaggaacgcaatcccaccgacgaacagctgtacttcgcgctgagccgcgacggcgtgcattggagggatctgcgcccggccggcagtccggcgttgacgtggctaggcggcgagaagggcgtgcgcgacccgcatattgtgcgcgacccacgtggtggattccacattgtggccaccgatttgagcatctattaccgtggcggctgggggccgaacgatggcgccaccacgaatggatcgaccggcctggtgatctgggactcccctgacctggtccattggagcgagccgcgcctggtggacgtggcctcgaagattccggacgctggcatggcttgggctccggaggcgaattgggatccggatcgcgggcagtggatcgtgttctggtccacgaagagcaacgccgaaagctccgcggatccgttggccaacgagctcggcgatccgacgaatgtgtattatgcgacgaccgttgatttcagggtgttctccgatccggtcaagtggatcgatcgtaagaatgtgatcatcgattcgaccatgctgcgcgacgatgacggctggtggtaccgcgcgtccaaggactcggaaatcaccatcgaacgcacccgtaacccgtatgcgacgacctacgaggtgctgcgcaccgacgacccgaatgagtggtcgtatgtgggcacgctcaccgacatcttcggcaatggccggtattccatgcactacttggaagggccggaactgttccgttacaacgacgaagacgtgaaggtggtcaacggcaggaccatgccattcggcctgatgtgcgaccagtacgcggagtccaggggctacctgtcgttccgcgccgcctcgctcgcctcgcatgatccggccgattggcagcgcgcagacgatatcgatttcggcgcgctgaagaagcgtcacggcgcgattctgccgatcacggccgccgaatacgacgccatcgaaaccgccttcgccctgtaggcggcgcgattgcccatccgtcgcaaccgctcaggcgcggcggatggcgaagatgcgggcggacggctgcttggaggtggccgcgttgagccggaccgtctcggggtccatgcgctcgacggtccacggcttggcgtcgggcgcatgctcgggaacggccggattcgggaagatctgctcgatatggcagtcctcggacagcggcacgttcacggaaggcgtgccgccgcgacgccagacaatgatgtaatcgcacgaatcgtcgtcctccgacgggaggaatgacggatggcgcagaccgacgacgagccaatcgccatcgaaatcaggcagacgggccggccagaacggcaccaattcctgctgctcggtcagcacacggcggtgcaaggccaccgcatcccgcaccaaggcaagccgatgctcgtccatgcggtcaatgaatccggacaggtacaacctgccgagtatgcccgtggccagcgtgaagacggcggtctcatcgtccatctcctgctgggcgtaaccccagttgccttgctgttccggcagaatcgtcagtccggcgccggcggcgatcgcggcgtaaatcagcggatcacactggtcggaggtggattgcaggtccaatcgttgcaactgcgcgtaatcggcgcgcatcgcaccggaaccgcagttttcaatcataacgtccggatggcggcggcgcaggtcgtcgagccagtcaagataggcgcggcaatggccgagcaggccagcgccggcggattcggcgtcgagatcagtgccgacgccggggacggtgttgtagtcgaatttgaagaagaccgcgccgaaatcgtcaatcagccggttgacggtgcgagtgacgtgctcgcgtgcggcgggcgagcggaagtcaagcaggtaccggcccgaatcgcagacgcgcacaccgtgacgctggaagaacgcgtcatcgggcagactttgggcgagcggcgatttcacgccaatcacctcaggctcgagccacaatcccaagcccatgccatgcgcgcggatggtgtcggccaaacccttgagtccagcttcgccgaaacggttcgtggaggcctgccattctccgaccatgtcccaccaaccgccgtccgtgctgtcgtaccagccggcgtcgatgcagaagatgtccgcgccgacgcgtgccgcgccctcgacgagcggcagctccttctccaagcgcgggtcgccgaacagggtgttcatgtaatcgttgtagatgacgagtccctgcgtgcgttcgaactgctcggaacgacccaattcgcgagccttggcggcacgcaacgcacggcgctgcaatgtcatttcggcgacggactgctgccaatcgccggccgagatcgcgaaggagaccggcaccgattcgaaatcgtggccttcacccagctccgtataccaatggtggtcctgatattccggtccgaacgcgctgatgtgcaaaccgggatcatcctcgccgatctcccattcccatgggccgttgtgctcgatctgccacatcacggagaagtcgcgcgattggcggcgcgaaccctccacctgcacgatgccggccggctcatgcacgccggtgctccatgtggaggcggagctcatggcgaatcgcgagctggactggccgggattgatgacttgattgcgattgcgcaccgacacgtcgcgcagtggacggctgcgccaatcgttttccaccgcccacgcggagtctccccagaatacgcgggaatggtcgattttgccgcagttgacgcgcatcggcaccgtcagattcaacgacgacaccgcctcgatgggcagcgggcgcgcggagctcaaccgcgtgtaagtgcgcactgcggacagacccgggaacgcttcgaatacggaagtgactaccagcccagccgtggcgtcggcatggcggacggtttccggcgagggctgcgcggcggcttcggcccgttcggcggcggtcggttcgaacgcgcgcccgtgcggctccagttccgcatacgaagcgaattggacgatctccaaacgatatggttcggcggacccttcctccggctcggaagcggcggccgagacgaatcgcaatacgctgcccgccaccgtggcgatcaaggtgaggcgattgtcctgcgatccggtgttggcggcacgcacttcgacgattggacgcggatcacgttccagcacggttcttccatcgtcggtaacacggccgccgatgggccccatgccgcggcctgcaacgttgcacaatcggacgggggaatcgcctgccgtgtcgaacagcatggaaaccacgccattgccccattcgagacgcccgtcctcacggggacatacggggttcattgcaccggcaccgcttatcatcttcgactcctcaaccgtgttcagataccgcctgatcattgacgtgcatcgattgacgtacctggtactagcttaagcggcaaatggggcaaatcgcacgtgcgtgtctactcgaagcggagatatgcgatgaacttgactggcgcatccttggttttggcgatgttgccgaaaccaaggacagcccctttgtcgggcagtcccttcgtcactcgtcatgctcacccgcgtaggaacaccgtcatctcgttctcgccacggttggcccatgcgaagtatggaatcagcgtggccgtcgtcgtcttgcgttcggcgggacgccaatcatggtacaacgcggaggtttgcgcggagtcttccacttcacgccaagcgggaatcgccagcgtggtcatcggcatatcgacggcgtccacctcgccgagcccctgctcgtcctgcgcgacggcgccggcatggaagacgatgcgatcaacggacacgcaggacgggtcggatgcgatgcgcgcggtatcggcgtgcagcagatgcaggttcgcgccattatcgacaccttccgcgcagtaggccagcggtccgcgcacgaacgccacctttccggcgtcctcgcgcacgaacggattcgcggcgaccatgtggaccggcatcgggaaatcgaaatcgacgacgtcgccgtcatgccatgcgccggtcagatacaggtatccgtctctgatgacgcgggagatgtcgtcgcggccgcgcacggtgaccgcatcggaagcggtttcgccaccggcccaggcgggcagacggagggcgatcgtgaaaaccgcgtccttggatgcatcggaagcagaatcgcctgcatcaaagcccaccgcgacggatcccttgccggaccagggcatatcggacatgacgtcaaggcgcacatcggtgccggaaagcctggcatggacgccgccgcccatatacagatgcacatacagggtggatgagtcgtctccgatcgtgtaggcgtactgctgcacgtcctccacgatgcgtgcgatgttcggcgggcagcaggcgcatccgaaccacttctggcgcaccggcttgacgtgcgccttgcgttcatcgcgatggcatgcctcgggcaccacttcgagcgggttcacgtagaagaagcttttgccatcgagtgccatgccggcgagcgtggtgttgtacagcgccgattccatgacgtccgcatattcggatttcggctggatttccagcatgcggcgggcgaagaacgcgagcgcgatggcggcgcagctttccgaataggcggtgtcgttcggcagatcatagtcgaaggagaaggcctcccccatgtgtgtggcgccgataccgccggtgatgtagatctttcggtcgacgatgttgcgccatagtcgttcgcaggatgccagcaggtcggagtcgccggtcaggcgtgccacgtcggcggctccggcgtagaagtaggcggcgcggacggcgtgtccgagggcctccgtctgttccgtgatcggcttgtcggcctggtagtaggcgtagttctgctcgcgcggcgcgtagttgcggccgtcctcccgggcgcggcggcggtcttcgagctcgaaatagagcggctgccggccgcgttggcgtacaaagtattcggcgaggtcggcatagcgctgttcgccggtggtctcggcgagtttgacgagtgccatttcggcgatttcgtgcccgggatagccgtgcagcttgccgtcggcggtgccgaatcgggaatcgatgtaatcagcgaaacggcaggccgcgtcaagcagcttgcgtttgccggtggcttgatagtaggcgatcgcgccttcggtcaggtggccgaagcagtacagctcatggtggtccttcaggttggtgaagtgccggtccatgccgttgaggatgtagtaggtgtccaggtagccgttgtcgagctgcgccgcgcagacgatatcgatggcggtgtcggcggtcgcttcaaggtcagcgtccgggtggtgggtcagcgagtagccgaccgcttcgatccatttggagaaatcagtgtcttggaacacgaagccgtagaacttgtcggaatcggggtgcgccgggtcgtccggcagggcttcgaagccgcggaacgtgtatttcggcggcacgaaggccttgccttccttgtggtgttctgcgttctgcgcggcggcggccttgaagttgtgcatgcagtagctgggtgcggcgccgggaacgttgtcgttcagcgcgttccactggtagggaatcacctgggtgcgcacgagttcctgccgcgatgcccagaacgggtcggtgacggtggcgtcgcgcaatgcgattggatggctggtgcgattggtggtagtcatgagtgcaagcgctccttagtgcatcgttgtcttgttaacgctcacaatccattattccacgggttgctccaaagtacattccgcatggcggcatgtccgacgggaatcccaccgcggcagccggcccaagatggccgcgcattggctgcgcgaccgttggacaggcatttcggattgcggatatacgggctaaggggcagagcagctagccgccggggctggcggccggctgctcagaccttgatcatggcgtactgcgattcgtagagccggtagtaggcgccatggcgggcgagcagctcggcatggttgccctgctccacgatctgcccgtggtcgatgtagcagatctcatccgcattctcgatcgtggacaggcggtgcgcgatgatgaagctcgtgcgtcccttgagcagatggttcagaccggcctgcagcgcctcctcggtacgcgtgtcgatattcgacgtggcctcgtcgagaatcaggatgcgcgggtcggcgagcagcacgcgcgcgaacgcgatgagctggcgttggcccgcggacagggtcgaaccgcgctcctccaccacggtgtcgtagccgtctggcagttccatgatgaattcgtgcgcatgcacggccttggcagcggccacgatctcctcgtcggtggcgtccagtttgccgtagcggatgttctcacgcacgttgccggagaagatgaacgtgtcctgcagcatgacgcccatctgccggcgcaggctttccaacgtgacggaacgcacgtcgtggccgtcgatcgtcaccgagccttcggcgacgtcgtagaaacgcgacagcaggttgatgatcgtggttttgccggcgcccgtaggaccaaccaacgcgatcgtcttgcccggctcgacgtgcaggtcgaccaggttcaggatgttgcggccgtccggctcgtagcggaagacgacgtcgttgaagtcgacgcgaccctcgatctgcggcagattgacggcgtccggcgcgttacggatctccggctgcacgtccagcgtttcgaagatgcgctcgagatacgcggagcaggtgatcagctggttgtagaagttaccgatgctgatcaccgggttccagaagttgttcgcatagccgacgaacgcgatgagcacgcccgtactcacctccactcccccaaaaccggtgacgccgacgaagtagatgagcgcgatggtcatgacggaaatcgtctggatgcccggccacatgaggaactggatgtgcacggccttcatccacgaggtacgcacatcgttctgctgctcctggaacgtcttgaactgcgcggcctcctgggcgaaggtctgcgtggttttcacgccggcgatcgattcgtggatgtacgcgttgagattgctctgcttgttggacagcacctggtaggcgcgacgctggaaatgctgcagcaccagcacccatgcgatgaggaaggggaacagcgcgaggctgaacagcgccaatcgccagtcgatgacgaacatgaccaccagcgtgatgaggaacgtgaacacatcggaaatcacattgattaggccggagctcaacgtatcggacagcgtgttcacatagttgaccacgcggatcaggattttgccgtgcgggcgtgaatcgaaatagctgaacggcagcgtctggatatgcgtgaagatgtcgcgacgcatgtctttgagcatgagctggccgacgcgtgtgatctccacggtgcggtagcgcaatcccagttcgaaaatcacgatcagcaccgcaagcaaggcggtcagctcgccaagcagcgtgaggtttttcgtcgggatcgcactgtcgatcatgactttcgtcaggtacggcaccaccaccgcgatgcagctcatcatcaccacgaccgcgaggatgcggaccacgcgtgccatgtacggcttgagatagacgccgatgcggaggatgtcatgcaggttgatctgctcctcaagttcctcatcctcgcggaacgtattgcgttttgccatgatgatcctcctttctagtcgtcaaaaccctgtgcgcggccggcttcgaggcccagctgcttgcggtagatctcccaatatcgcccatgcgcggccaccaggtcgtcgtgggtgccgcgttccaccacgcggccatgttcgagcacgagaatcaggtcggcatccttgattgacgagatgcggtgcgcgatcgtcacaattgttttcttctcgtccaaatcacgcagatgctgttggatttccgcttccgtctccatgtccacggcgctggtcgtatcgtccatgatgaggatcgacgggttgtcggcgagcgcgcgtgccaggctcagtcgctgtttctgcccgccggacaggccgacgccgcgttcgccgacgacggtatcgtagccttccggcatgctgcggatgaagttgtccgcgcctgcgatggcggccatgcggcggatgtacttttcgtcgtattcgcgctgttcgccagcgccgaagccgatgttgccgccgatggtgtcggagaacaggaacgtgtcctgcgcgacgatgcacacctgcgagcgcagggtggcgagcggccagtcgcgcgcgtcgatgccgtcgatgagcacgcggcccgcggtcgggtcgtagaatcgcgaaatcagattgacgagcgtggacttgccggcgcccgtctcgccgaggatgccgagtttcgagccggcggggatgtggaagtcgatgtctttgagaatcggggtttccggatcgtcggggaaggcgaagctgacatgctggaagtcgacgtcgccggcgatgcgcgcggggcaggccgcggacaccgcggtggcgctgtctgcttcatggacaccgttggtccggccgttgacttggctgacgatagcgactgcctgtttgacgctttcctcagcgcccggcttctcctggatacgcgactgcgaggtcagcagtttgcgaatcttgatgcaggacgcgttgaagcgttgccaatcgttgatcagccagccggattggcgcacgggaccatcgatcatccacaggtaggagttgaacgccaccaggttgccgagggtcatatggcctgtgatgaccaggaatccgccgaatcccaaggtgatgagctgcagggagaagccgaggccgtcgagccatggcatgtatctgcggctgttgtaggcctggtccatattgcgctgcatgtagtcgtcgttgcgctcgtcgaatttcttggtctcgtacggctcgcggacgaacgctttgaccacgcggttgccttcgatgttctcctcgaccatcgagttcatttccgctagggaattgcggatggcgaagaacagcggccgcgcatgcgaagataggccacgcgtcaggatgaacaggaatggcgtgatgcaggcgagcgccagggcgagacgccagtcgatggtgaacatcatggcgagcgcgccgatgaacatgaccacgcagtcgagcgcctgatagctgacccagcttagcgcgtggcggatggcgtccgtgtcggaggtcatgcggctcatgatgtcgccggtgcgggtgtggttgaagtaggtgaagtcgagctcgtgcagtttttcgtattcgtcgctcaccaggcggaatacggagttttgtccgaaacgttccatccacatctggtagccgtagcgcgaggccacgcgcacgatggtgaagacgagcatcatgacgcatagtcgggtcagttcgtccacatggccttgggtgatgacgcggtccacgatcagtccggacagcagggggatggtgagggccatggtgttgttcacgcagaacagtacgaccgcgccggccacgcgcggcaggtcgggtttgcagtatggcaggatccatgcaaggttgcccgcctgctggttgcgtttcggatcgacatacatacgtagcgttccttcgaattgtttgcttgggtcttggttgggttgttgttgggttgttgttgggttgtggtgttgcggccattcgttgccgccacgattcacgtccgtcgtgtgtcgagcgtcccgtcaccggcatgccgccgccggccgaaacccctgttcggattcgcaaactcgacttattttaaacgaaccgtacgccgatgcaacagatgcgttttcggcgtgtcgcaatcataataaaatcaacatatataccgttacataccactggtttgcgggtgctgcgaaaaccgtcatcggagcctggctcgccggaatcagagcatcgcatcggaacatcgcacgataatggaatcaagctcgaactatcgatacgagcatcggcgacgcacgtcgaggaaaggacggcaaggatgacggacttggagcacatccgcgcgaagttcgctgcggaatatggcctgtcggaggacatgctcaggaacgcggaacgttggacggagaccacgggcgacctcgaaggggttcccgagaacctgctgccgggcattctgggaatgcgatttggcgcgatcaccatcgatacgccgcgttccgaacgctggagcacgccggaagacatcgatgtgatcgccgacctcgcctacctgccggatggcgggtacgatacggccgcgggagcgtgccgcggccatttgctcgacctgtatctgccgcatgacgcggtattgcgcggtgggcacaccctgccggtgtacatcgatatccatggcggcggattcacttacggatacaaggagctgaaccggaatttcaacgtgcatctcgcggaacagggcttcgcggtgttttcattgaactatcgtccggcgccgcagaccgacttgcgtgggcaattggccgatatccaggcggcattgcgttggatcgcagcccatatggccgattatccggtcaatccgaacgcggtgttcctcaccggcgattccgcaggtggcgcgttgacgctactgaccttggccattgaaaacaatgcggaagccgcggctgcgtttggcgtcgacaagccgtccggcatccgattcgcgggtgccgctccggtgtgcggcgcgtacagttcggcgtcgttggagaccatgggccgcaagctgacggtcgggtatgacccgaaccgccgtatcggtcttgagcagatgttgggcgtcgatttctttgcggggctcgaagccgctgatccgaagttcctcaccgctgagggtctggcgttcaacgtcgatcttccacccttgctcatcatcacctgcggcgacgatttccttgaagccgacaatctggcgttggccgccgccttgtcgcgcaaaggcgccgattttgaattgttcgacccgaagccgcgccgccatgagacgttggggcatgtgttcgtcatcggcatgccatggcttgaggaaagccgggaatgccttgatcgaatccgccgcttctcatacgaacgctgttgaataacgtgaatggggtgaatactccttcggagtgcccgccccattcaatggccgtcgatgccgcgacgccgtatcagcggcggaccatttcctcttcgatctgttcgagcgacttgcccttggtctcaggcacgaaacgcagcacgaacgggatggacagcgcggagaacacgccaaagatggtgaacgggccgccgacgttgttgccgaacatggccagcagcatgaggaagaactgggagaccacgaaattgcccagccagttggcagcagaaccgaaggagctgccgatgccgcgcacgctcaacgggaagatctcgccgatgagcacccatgcgatcggaccccacgacagcgcgaagccgaggatatagcaggcgatcagcaccatggtcggcacggccagcgtggccacatcgccggtgaagttaagcacggccagcaccgcgagggcgatggtcatcgtcaccgatccgaagatcagcagcttcttgcggggaatttgtccatgataagcgtggccgcgatagtggccacgaagttgaccacgccaatgccgaccgacacccagatggcatggttttcggggaatccgaagcctttgatgaacacctgcggcaggaaatagatcacggagttgatgccgacgagctgctggaacagcatgatgccgatcgcggcgacgagcgcaggacgggcgatgcggaacagctcgcggacaccgcccttggtgttctgcgcggcgacggccttgatctcgtcgagctcgagctgcacctgcgtctgatcgacgtccttgcgaataagggtaagtactttgaacgcctcacgatccctgcctcgactcaccagatatcgcggcgattccggcagcagcaggccgccgatcagcagcagggccgccggcacgagcgccgaccccagcatccaccgccaatcgcggatgccggcgatattgtggccgaggaagccgagattggacgcgtatgccagcaggatgccgaaagtgatcatcagctggaatagcgtggacagcgatccacgacgttccttcggcgcaagctcggcaagatatgccggagtcagcgaggaggccgcgccgacggcgagaccgaggatgatgcgggccacgaccatcatcaggaatcccgtggatcccgcgcacatgcccgaaccgagcaggaacagtatcgccgccagaatcagcagcttcttgcggccgaaacgatcggacagcgcgccgatggacagggctcccgcgcaggaaccgatcaacacggatgatgtgatgaacccggtctgagccacggacaggccgaaatcggattcgatgagaggcgaggctccggagatgatgccggtgtcgaagccgaacagcatgcctcccagcgcaccgaacgtgaagatgaacgcgctgttgagcgggaaacgtgtggaaacgccacgccccacctcccgctcgacggcgtcgatcgtcgcgccgacctcatggatgccggcttccaccgcaccttcggcgtcgtgtactggattggacgtctgcaccgcagtcatgatttcaccttccattcccatcgatcctcatcgatatgagatgcagcaatcgcagcaaacaaaaaagacctggaacgacgtatagtgacgtcgttccaggtcttgcctcgcattgagtagcaaccctgccgcgcttgtatgctgcgtatattgcattcaagtgtaggtcatggcggcatgcgacactccgattttttagaaaacgtttaccggttatttttcagtgcaggaaagcgtgaagcacaggccagcggcacatgcttttccctcgtgcggagagcctcctcggatatccacgagcaagcggaccgaatcaagccgtcaaccatccacaagcaagacggcaaaaagaaagccggcggagagaaagccgccggctgagagagaagagagaagaagggttcagttatgggattccaaaggaatctcgccaacagccgcaaccgttgacatggtctatataaccgcccgacccttggaggaacgatgtgcgttcctgtcaattccctgagaatttcgtagcggaaatgtcacgacggtgcgaattcgggggtttatcccactgaatatcgccccaacggccttcctgcagcttgttcagcgcggcaacagacgatcgcacggcatccgccatacggacaccgtcatgagacaccgctatacgacgccgtacactcacacgcaatcgtgcgtctcactcagcgaatttgtcgacgcggcgatcgtaggtcagcaggccgttgagctcttcctccacgtcggaaacctgcgtatacacgtatcccgcaagtccgcgcgattccagtgcggccgcggaggcgagcacggaacgcacggcggcccgccaatcgtcgatcgaatcgtattcaccgtaaccgtaggcgcgcgacaccgccgcatgctccggtacgagctgcgccaatccgccgaattccgaaatcacgaacgcgcgtacgccgtgtcgtgcgaccggcagcaccacgtaatgcgcggccctgcggcgacggcggtgcttcttctcgaattcggccacgtatccgcgcaacggacccttatccgggtagatttccagcggacgaaaatagttgtgcacgctgtggtaatcgccacaatgctggtcgtaccagccgctggtcgcgtcaatcggacgggtcgggtcgagcgcgtggatgcgttcggttgcgtcgcacgcgtcgaattggccccagccttcgttgaacagcgtccacgtcacgatggaggggtgcccgccgagcatgtgcaccatcgcgtcgcacgtacgcgaccaatcgcgccggtagatcgggtcgtccgcgccgagcgccgtgaaatgtttggcggtgtcgtcgcggaatttgttccatgtggagcggatgagcgtcggcttacgattcgtggtccacgcattgtattcgccgtccgtgccgccgccggacaccgcgtcctgccagacgagcatgccgaggcggtcgcaatggtagtaccagcgggccgactcgattttgatgtgcttgcgcagcatgttgaaaccggcgtttttcatggccgtgatgtcatgcgtcagcgcctcgtcgtcgggcgcggtcatgagaccgtccggccagtagccttggtcgagcacgcctttgacgaagagcggcttgccgttgagatggaagcgcgccacccccttcgtatccggtttgatttcgacggaacggaacgcgcagtaggaacttacgacatccatcggctgcgattgcacgaccgccgcatcacccgccgtttccgcgggtttcgccgacccgtatcgcaattcggcccgcacgtcatacagatacggatcggccggcgaccacagatgttcggcagctgttgcgatttccgcacgcaccttgcgcacacccgccggcagcgtctcatccgccaccaccgtgccgtccgcagggtcggtgacgacgatgtgcagtttcgcgttcggcttgtcgccgccgatttccgcgcggacgaacaacttgccgtcggatgcccccttgagtgtcagcgtgcgcaggtaggcttccggcacgatttccagccagacgctttgccaaatgccgctttgcgcggtgtaccagatgccttcgcgctcgattttctgcttgccgcgcaactgcgtgcccgaatcgttcggatcgtagacacacagcgcgatttcaaacgcgtcatcagggtcgataaatgccgaaatatcgacgtcgaacggcaggtagccgccgacgtgcgtgcccgcgagctggccgttgacatagcaggcacagacataatcgaccgcttcgaaatgcaggatgaggcgattcgcgtcgccgatttgccggaccgtttcctctccgccgagcgtgacgggatgcacgacggtgcggtaccacagcaggttgtcggggtaaatggtctggtgcacgccggacagcgcggattccggcgagaacggtacgaggatcttgccgtcgaacgtttgcggaatggcggtttccttgactgcgcggaccgcttcgtcgcgggtcagcatcgccgccgttttgcgccatttcggcgcggtctcatcttccggaatggacacgatcgcgtaatcccaccagccattgagcatggtgcagttgtcgcgtaccatggtcgggcgcgggtgctcgccgagtatgggggtacgaccctcgtccagcgtgcgttcgccttcctcggcgggattgaacgccttgttgccggcgcgggcggatagccattcgtgctcgattcgttcaccccacggcgtccacaactgctgcagcggctcacgggaacgcattttcgtaggcgcggccttcagtacgcgtttgatatccagcatggagagccccttcctgcagctttgcacgtctctgcgttttattgtactgagcggcttgcgttttttaacgattcgtaccgcggtttgaagtaccgtcttgcgacaccccgccaagaccagctgaaaaatcgcacgcatttctacccaaaacaatgcgaaagcaaccggaacatacctacgacaaggatgcggtcggtcgtatatgcgttgtaaggccataggcttggccgaacggccttgagtgtgccgtcaacgcatacctcgaccggccgccgggcccgccaatcgcacaaaacgtcgcacaggtggaaacgtgatacgggaatgagacgctgaaacggcacaaaatgtcgcacgacttcgatttttcggcacttttttcaagtcatgcgacacggcaatcaaaacaaataccccctaaccgccattttccggtcattttgacctaaaaacagcagttagggggcacttatcgcaccgcagctgtcgcacgacttgaagaaatcgtccaaaaatcaaagtcgtgcgacgcgtacgggggttatgcgacggaatcagccttccagcttcgccttttcggcggcgagacgggcggcctcggcttcgcggcgggccttcagctcggcatcgaagcgggcgagctcctcttcgacggcctccggcggaatcttcgcgaagatcgggtgcggcttcggcaccgaggtgccggccacgatcggctcggaagcccacggatgcacggtttcgcccagcttgtagtcgcccgtgatgatcgggtacgtgaagcccggcttgtcgagatcctcgacctcttcgaggcgcggcagcggcgagaagacgccggttccgccgagggcctcccacaccttctgtgcggagtgcggcaggaacggggccagcaggtggttggcgtcggacacggcctgggcggcggtgtgcagcacggtgccaaggcgggccggattgtccttgatcttccacggttcggtggcggagatgtacttgttgatgtcgccgaccacgcgcatcgcttcggacagcgcgttcttctggcggtgattctcgatgagtccgccgacggtttcgaacgcggccttggtttcggccagcagcgcacggtcctcgtcggtggcggaagcctcgtcgaacgccggaatctcaccgaagttcttgttgatgaggttggccacgcggttcaccaggttgccccaggaagcggcgagctcctcattgttgtggcgcacgaactcagcccaagtgaagtcggaatcggagctttccggtccggccacggagatgtagtagcgcacggcgtccacggggtaacgggcgaggatgtccttcacgtagatgacgatgccgcgggaggacgagaacttcttgccttccatggtcatgaactcggaggccacgacctgctccggcatgttcagcggaccgagcttgccggtttcgccgcccttggagccctggccgttgtaggccagcatttcggacggccagatctgggagtggaacgtgatgttgtccttgcccatgaagtagtagcccggggtggtcggatcgttccaccatgcgcgccatgcctccgggtcgcccttgcgtcgggcccattcgatggatgcggacaagtagccgatcacggcgtcgaaccacacgtacagcttcttgttcgggttgtcgatccagcccttgaccggcaccggaataccccagtcgatgtcacgcgtgatggcgcgcggcttgacttccttgaacaggccgatggagaagttgatgacgttggtgcgccagccttcacgggtcttgagccacgcgagattggcttcggcgagcgccggcaggtcgaggaagaagtgttcggtttcctcgaagcgcggggtttcgccgttgatcttggatacggggttgagcagctcgtccgggtcgagttcgttgccgcaggcgtcgcactggtcgccacgggctccgtcggcgccgcagatcgggcaggtgccttcgatgtagcggtccggcagggtgcgtccggtggacggggagatggcgactttctgggtgcccttgtagatgtagccgttttcgaggcactgtttgaacagttcctgcacgaccttttcgtgattgccggtggtggtgcgggtgaacagatcgtagctcaggccgagatcgcataggtccttggcgatcacgcggttgtagcggttggcgagctcctgcgcgctcacgccttccttgtcggcttccaccaggattggggtgccgtgctcgtcggtgccggacaccatcagcacgtcattgcccttcatgcgctcgtagcgcgcgtacacgtcggacggcacgccgaagccggcgacgtggccgatatgacgggggccgttggcatacggccatgcaacattcaccaaaatatgactcatggtgcccgattatacaaagcgccatatcccgtgttttcggcgcattccgattggcggaagacgggcggatggggtcgatgacgttctcgcagaccggcctgcatcaggctacggtagtccacaaggttatccacattgttgtatcacgcaacaatcatcgtccacttatccacttttttcgcgaagccggtggcacgccgctttccgtatcagctacggtaccccgcatggacacctcccctccccttttgggcgacgccgacctgcccggccccatttgtttgaatcgtttgcattccctaggcgtggtatgcaaacttgacaacgacaacgcctactcgtatcacgattcgcgcacgctgtacggccgcgccagcatcatctcaacgctgacgccgagccgttccgtggcgtgcgccggcaccgctgcgtgggtgtggttgggtggcatgtttcccaacacgatcgacatcatttcaaaagcgcattaccgaacggcgaggtacggtcgcaaagtcagcgttttcaaccgacaggcgcccgacaagcatgtcaccgacgtcggcccgatcaccgtcaccacgcccacacgcaccgcatgcgaccttgccatgaactgcacgccggaaacgcagtcgccggtcacggaaatcgtatgcatgctcatgcaggaattccggttccgccccgacgattgcctgcaggtcatgcaggaggccacccatattcgcaacgcgccacgggcacgccagtttttccggacgattgacggaaagcagtgacggatatgcgcgaatcgcaacggccgtcggaaaaaccacggcagacgggacagacgcggcaagcgtcggcaaagtcgcggcgcacggcaagcaagagatatgaagagcgcgcgaaacgtagcaaacgtcatgggcaacgacatgaacagcatggacaccatggcaaacgccacgaacgacgtcgcgcgccgccgaaatatcagccgcacgcgcggcagcgggcattagtcgaaccgcctgcgccgccaatcgaattgacgccgttggtggcgtgcagcgccgacaccgcgcaagatgtgctgtggcatatcgcggaatatgcgccgcgattgcgcaagtggctggtcgccaatccttcggcgacaccggcgatgttggaatatcttgcgcaggtcggcgggccgggtgtgcccgaagcgctgcggatattgctgaaatcgttggaaatgaacggttccggaagcgatcagcccttcatcgcaagcacggcattgtagacctgcttgcgattggcgagcgagccgtcagacagcggatgttcggcgacgacctgtgaaatcgcgtccttgatacgcaggttgtcttcctgcgcgcgatcaacggacagcaccgccagatcctcgatggacagcgttgcgggcgcagccgcgtcggcctcctcttcggaagcgccggcgatgacgagcaccatttcgccacgcggcggatcgtcgacgacgctttggcggatttcggcgatggtgccacggcggatctgctcgtaatccttggtcagctcgcgacacaacgccattttgcgattcggtccgagcacgtcaagcaggtcggccatggattcgtcgatgcggtgcagggtttcgtagaagacgatggtgcgacgttccgatttgagcgcgcgcaggtgctgcacacgttcgctgtgcttgcgcggcaggaagccttcgtagcagaagcggtcggtcggcaggccggacaggcacagcgcgtcgagcacggcggacgggccgggagcgcaggtgacgggcaggccgcgttcgatggcgcggcggacgatcgccagtcccggatcgttgatggtgggcatgcccgcgtcggatacgacgagcacggtggcgccttgttcgacctggtcgagcaggccgtcggccttgtcgcgttcgttgtggtcgtggtaggcgacgacgcggccgggcacgcggatgccgaggcggttcgcgagcgcgtataggcggcgcgtatcctcggctgccacgatgtcggcgccttccatgagggcgatcaggcgggcggacgcgtcgccggtgttgccgatcggcgtggcggcgagcacgaccgttccgcgcggaatgttgacgtcggcgaccagtccgtcgagcccgaattcggcacgttccgtggcttgcgcggtttcctcggcattttccgcgttctcgccgatttcggcaatctgaccaatatttgttttcacggtttgtttcacggcgttaccagccttctcggcatcagtctgttcgctcaagttctccatatttccagtatcgcccacagcgtccccaaaccatcagctcccgccatttctccgtctttcgcaaccaaccaatcgaaacccgaccaaaccacctacgacgccacacgtcctcaccggtaaatcaaaatgcacccctcacacatccgggtttccacccgccacgcattcggatttttcttcgtacgacattcggattttcctttgcgtaggattcggattttctcagacgggggtgagacggcgattcaacacgactttggacatgccatcgatagcatggaatcatgcgttattttgaagatgaaatttccggaatcgacggcagcacggccacgttcgtcggctactgccttgacaacagcagcgaaatcgacccgaatcgcaagcgcccgtccgtgctggtgattcccggcggcggctacgaaatgacgtccgaccgcgaagccgaaccaatcgccatgcaattccttgcagccggcttcaacgcgttcgtgctgcgctattccgtgaagccgtccatttttccggtcgcgctgctggaagcggccgaagcgatgcggcggatccacacgcatgccgacgaatggcattgcgatgccgacgctatcgcggtgatcggcttttccgccggcggccaccttgccgccaatcttgcgacttccgccagcgacgacgtgcttgcggcgcatggttacgacgcggatgcggtgcgcccgaacggtctgatgctcgcctacccggtggtcacgtccggcccgctcgcccaccgcggcagtttcgatgcgctgctcggcgaccgcaaggccgatccggaagcgctcgacgcggtttcgatcgagaaacatatcgatgcgaagacgccgccggtgttcgtctggcataccgttccggacgattgcgtgccgtacgagaacacgctgatgctcgtcgacgcctgcaagaaggcgggcgtgagcgtcgaggcgcacctgttccccaacggcggccacggtctgtcgctcggcaccgccgaaaccgcatggcagggggtcaacggcatcgaaccgtgcgtacaggtctggccgaaacttgcgattgcgtggatgcgtcgcacgtttgccgctaccgacgccaccgccgccatgaccggctctgccacgaccgtcgcgattgccgaataatcgccattcctgcgtttttttctgcgtcttttcacgtcttttttgtcgcacgacttcgcttttcggaccaaaaaacaagtcgtgcgacatttaatcgagtaaaaataccccctaactggcattttccgggcgaaaacggcacttaggaggtattcggcgtcgcacgacttgaaaataaccaccaaaaatcaaagacgtgcgacgtttcgcgccacctaatcgccaaaatcagatgggacgcgactcgtgcaccatctgacgatcgccgtaatacaacgagttcaggccaggattcgccggcgtgccccacgcggacgccggacgcgccggacgcaccggacagccggtgagcacgctggacaaccaccagacaaccaccagacaaccaccgggcacgcaccggccggacaccacctacaagcacacgcacataggcgcccataggcacatattgacgatttgtgcagatttgccacccgtcgtcgcactgcggcgcacactgcatagacccgttggtagtctgtgattggttcgcaacggcacattcgttgcgcacgatggaaaagcaagccacacgaaccgaccccgcgcaaccgcgcaaaaccacacagagagacctatgaatatcatcaatttcttcgtcaacctcatcaaggacccccgtaccgcgatcgccagctggattgccatgggcgtcgcgccgaccctcggctttattttccttatcgtcttcattgagaccggcgtggtgttcttcccgttcctgccgggcgattcgctgctgttcgcggccggcttcttcgccgcccccgacgcacagaccggcgtgtccgcactgccgctgttcgctctgctgccggtggtctggtgcgccccggtcatcggcgaccagtgcaactactggatcggccatttcttcggccgtcgcatccttgaatccggcaaagtcaaggccatgaccccggagcgcatcgagaaaaccgagaagatgattgagaagtggggcccgctggccgtgttccttggccgtttcttcccgttcatccgcacgttcatgccgttcatttccggtatttccggcatgcgttggagccgtttcacgccgttctcggtgctcggcggcctgtgctggtcgacgctgttcacgctgctcggctatttcttcggtggcattccggccgtgcagaagcattttgaattagtgattattgcgattcttgtgctgtcgctgattccaacgatcgtcggcctgctcaaggccaagttcggcaagaagaagccggctgccgaggacactgcggaaaccgccgacgccgaataagcagcgttcaatcgtcgtaaaaatatcggcgaatacaacgcaagcacaacacgcggagtgtggaattgcatttttccacactccgtactaatatttcgagagttgtcttgctaaacaaggtgacgcacatggggctgtagctcagttggtagagcgcttcgttcgcatcgaagaggtcgcggtttcgactaccgtcagctccacgaagcccgctgcattcattccaccgcagcgggctttttcttttgttttccgccgtttccggcatttcggcttttgattacagccgcgtcaggcgttgcggcggcgtatataggcgtcgagcgtggcggcggtgatgccgtcgtagccgttgattgaggcgaattgcgggccgttggaattgtcgatgcgcatgaagccggtctggccaagcgtggtggcaccggatgcggccgcggagcgcaggccggacatggaatcctccaccgcgatgcaatatttcatgtcttcgggcgcgatgccaagcttgcggcccgccgcaagatacggtgcgggcgacggcttcttctcgacatcgtcatcaccgcacacgtaaccggcgaacgtgccgtccggcgcctgcgcgatcaggttttccgccagatgacgcggcgatgtggtgacaagcatcgacggcacgcccgcctccttcagcgacagcagcacgtcctcgacgccatcgatccacggaatgcgttcgaattccttctgcgccacataatcgatcatgcccttgccgatttcttcgatcgacagcttgcagccgtgctccaccatgcggcaggccacgtccggaaccggcgttccggaaccctgccaagcgaggtcctcatcccagtatccgccgtggtcggctgcgattttcagctcgccttcgtgccaatacggttcggaatcgatcagcgtgccgtccatgtcccagaacacggctttgagcatcagcttcgaaacttcctgggcgccgttctggataccgttgttcagctcggtcattacgtttcctcgcaatcgttacgcttcgttctccgatagctacattcttcgtcagctacgaccatttcagcagagcggcacgacggaagcgcttcagcgcgcagaaaaaacaggacggttccatcaagccggtccgccaatcggttcataccaatcggctcgcaccaatcggttcacgcaaaccgactcatgcacaagccaattcgcgcaagccaacgcagcaaccaacccatagcaacggaggcacttgggaatcccccaagtgcctccgcaacgaaaaacacatccgacgaaatcggtcggtcgcaatcgcagcaatccgtcatagaccccttttagacgaatcgcaagacttgcgtgcgactactcctgagcctcctgctcctgagcggccttctcggcatcctccgccttccagcgggcgatgcaacgctcgacgcgcttgtaaccgatgatcttcggatccaagccggcctcgcggaaaatcgcggcaggcgaaccaccctcggcatacctgcgcatgcagtcgtcacggaattccttggaatagcgaattcgatactgagtgactgattccacagcatcgagagaccccaggtatttgcgggtctttgcggtgaacgcaactcttggcactgtacgctcctaacctttctgtatccaccgcatgccctcccccgattcttcacggaaataagcagtcatatttcatcgaagctgtgggccagccggaagaaatacgaacttcaatgcggatacgtaacattatttctcacaatagagacatcattgcgagacagatgcggcgttatgagtagttgcataccaaaaatcgggcatacccccgcgatatatgcccgattttgctgtttttttagatttttttagggttttccagcgcttttcaggaaagtcagcgaatgggctgtcagcgaattccccaaactaccactgacctggagcccatatcgtccccctcttccgcacgttccgcccgtacggattcgcgcgacggaagctgccgtgcatcggctcgcagctgcctgcgccacatgcgcgcgcgctgggaccgctcgacttccacaatgccaccgtccgcgtccgcggcgaacacgctggaaccggccggcttgcgcagccgctccacttggcggcgcagctcgcggttctcttcctcaagttcgaggatgcgcgtgattccagccaagttgatgccctcttcctggctgagttgctgcgcttgcgcaagacgggagatgtcgcgcagcgaatagcgccgcgcgccaccttccgtacgttgcggtacaaccaagccaaggcgatcatactggcgcagcgtctgcggatgcacgttggcgagctcgccggccgcaccgaccgagaagacgggcagctcgatgtcgaaaccgacttcggcggcaccgtccaggtcggcccggccggccacgatcgccatggcgcacatttcatacagccgcttgatctgccgtgcggcgcgcgcttgggaggcttgggaagtccgcgatgagcgtgccatggcggtcagcgctcccgagcgagctcgtcggcgaagtcaccgcacgccttgtcgaattccttcgcggcatgcttggcaacgaggttcggatgctccggaatgcggatctccacacggccgaccaaatcgccgttctcgtgcggattggccacgcccttgcctgcgatgcgcacttccgcgccgctggacgagccggcaggcactttgaaggcgatttcgtttccgtcgatatccgtggccgtcactttcgcgccgttcacggcttggctgacggtgatgggcagcggcatgatgatgtcacgtccgcgcagggtgaatttcgggtcttcggcgacggtgatatgcaggtacagatcgccgtttttgccgccattgcggcccggcttgcccttaccggtgagacggatcttctgcccgtcacgcacgccggcggggatgtgcgtcttgaacttcttgccgtccgcggacagcgaaaccgtggctcccttgacggcctggcggaaggtcagacgaatcttggagttgcggtcctcgccgttttccggctgcggctgctcgtaatcgtcagcgccgtagcgttcgtaggcggagcctgcgcccgggccgcccgcaccgccaccgaacatcgagaagatgtcgttgaggttcggattgccgccgccattggtctggaagcgaatgcgcgagccgttgccgcccatgcctgcgccgccaccgaacatcgagccgaagatgtcggagaacgcgcccgcgtcgaagccgccctggccggaaccgccggcgaaacgcgcgccgcccatgccgaactggcgaatcgcatcgtatttctgacgattctccttgttgctcagcacgtcgtacgcttcggagatgtccttgaacttctcctccgcttccttcgtcttgttcaggtcgggatggtatttgcgcgccagcttgcggtacgctttggtgatttcggcgtcggtggcgtctttggagacaccgaggaccttatagaaatccttgctcagccattcattctcagccatgatgtgcctcctttcgtgaggttttcatgcagtaaaaagtacagtttttcaaactttcaaacagttgtcgttgaaccgttgtttcaggtaatcgaaggcccctcgtttttcagaggggcccgattactcgtcacatgcgtttcgcgcggatacgcggattgtgcgaatgcgcgatcagttctgcggagaagccacgaccacacgggccgcgcgaatcacgcggtcgccgatgcggtagccggcttccaccacggtgtcgacggtttccttctcggcattcggatccggcttgtgcaggatcgcgtcatgcttcgtcgggtcgaaatcctcgcccttttcgccgaacttctcaacgccgaacttctcgaacgccttgtcgatcttgttggcgacggccttgaacgaatcgtccatttcgctgtgttcgcgaatgcggtcgatgtcgtcgagggccggcagcagggcggtcagcacgtcgatgatgccgtgctgacggaagcgttcctgctccttctgcgcgcggttgcggaagttgatgaactccgcgcgttcgcgctgcagcgcctccagatattcggcggcttccttcttggcctggccaaggggggtcagcgtatcgtcggccttgccgtcggcagcgcctgccttgtcagcaccgtcagcggcagcggaatcgccattttcttgcgattgcgcggcagccggctgagctgcaccttcctgcgttgcgccagcggcggcagcggcggaatcggcggaagcggcggccggggcggcctgcccggacaggtcatccatgtcgggcaggtcgttcaggtactcgtccttgttgaaatcggacatgattacttgttgtccttgtcgtcgtccacgacttcggcgtcaaccacgtcgtcgtcggagccgttggaagcggagccggcagcgcctgcgccagcagcgccggcagcgccggcggcgtcggcggcgccctgctgtgcgtagagggcctggccgatcttctgggcggaggtcatcagctcggtctgggcggacttgatcttctcaatgtcctcacccttcagggcttccttgagctcgttgaccttgtcggtgacttccttggccacatcgtcggagagcttgtccttgttgtcattgacgagcttctcggtctgataggcgaaggactcggcctggttgcgggtctcggcgtcttccttacgcttcttgtcctcggcctcgtgggcttcggcttccttgaccatgcggtcgatctcgtccttcggcaggccggaaccaccggtgatggtcatggactgttccttgccggtgcccttgtccttggcggacacgtgcacgatgccgttggcgtcgatgtcgaaggtgacttcgatctgcgggacgccacgcggagccggagcgatgccggtcagctcgaaggtgcccagcggcttgttgtcgcgagcgaactcacgctcgccctggtagacctggatgagcacggacggctggttgtcttcagcggtggagaagacttcggaacgcttcgtcgggatggcggtgttgcgctcgatcagcttggtcatgatgccacccttggtttcgatgccgagggacagcggggtcacgtcgataagcaggacatccttacggtcgcccttgatgacgccggactgcacggctgcgccgacggccacgacttcatccgggttcacggactggttggcttccttaccgccggtgagctccttgacgagttccttaacggccggcatacgggtggagccaccgacgaggaccacgtggtcgatgtcggagacgccgatgccagcgtcgcgcagcacgttgttgaacggggtgcggcagcggcccagcaggtcggaggtcatttcctcgaagtgggcacgggtcagggtctcgtccagatgcaccggagtgccgtcaggggtcatggccaggtactgcatggagatggaggtgctggtggagctggacagttccttcttggcctgctcagcagcttccttcagacgctgcagggcgatcttgtccttgctcaggtcaacgccgtacttgttcttgacttcgccgacgagccagtcgatgatcttctggtcccaatcgtcgccgcccaggtggttgtcgccgttggtggcctgcacctgaatggtggagaagccgtcgtcgtccttgccgatttccagcagggacacatcgaaggtgccgccgccgagatcgaagaccaggatgcgctcgtcttccttgcccttctcaaggccgtaagccagtgcggctgcggtcggctcgttgatgatacgcaggacgttcaggcccgcgatggtgccggcgtccttggtggcctgacgctgggcgtcgttgaagtatgccgggcaggtgatgacggcgtcggtgaccggttcgccgaggtaggcctcggcatcgcgcttcagcttcatcagaacctgcgcggaaatctcctgcggcgtccacttcttgccgtcgatctcaacggtccagtcggtgcccatgtggcgcttgacggagctgatggtgcggtcgacgttggtgacggcctggcgcttggcgacttcgccgaccagaatctcgccggacttgctgaaagccacgaccgacggcgtggtgcgagcgccttcggcgttcacgataacggtgggctggccaccttcaagagttgcgatgcaggaattggtagtacccagatcgatgccaactgcgcgtcccatatttggtctcctttgcaataggttcgctatacgttcttttcgttcttcgctcgagtttcggatcgccgtttccggattgccgtctctcatgctttccaaaacttgagcctacaccactcaactttgaatcgcaagttattattcccaaaatcgcaaaaattcttgagcacacctcactcaactttgcgcaaaacccaaaaccgccggcgctggagagtatctcagcggcggcggttttggggatcatcggaggttattcagccaatcagcggtcgttcttggcggccttcacggtcttgatgagcatcgcgacggcaaccagcatggcgatcgcaacagccgcagccagcaccgcggtgccggtcttgccgagcagtgcggcgccaaacgggccggccttcgtatcgttgttgaccttgccggaagcgatcacgccgttcttgtcagcgttgccagcgcccggcttgccgttgttcttgtcagcggagttggcggccggagcctggaagtcgacggtcacggccttgccggactggcggccggtgacggtgagcgtgtattcagagccttcggtcacgccgtccagcgcgatcggagtggtctgtgcggtcttgacgcgcacgccggagagcggagtggaggaatcggacgcggccacggtcttgccgttcttgtccttcagctcgtagctgagcacagcgtcgccgttgaagccgtcgacgtccgcggtgaacttgccgtcggcagcggagaccttcacagtgccgttgtcagacagtgccttctgcgattcggcggaagtggccagtcccagagcgccggcgatcgtgtagaagttgtcggtctggtcggtcaggccgatgacgcgctgtgcgccagggccggaagccgcgatacgcagctgggtgccggtgtgctccatgtcgccgccgttgtagccgccgtctgcatcgcgagaatcgtcctgggcggtgccgtaggagacgaccatgttgttgccatcagcggtcttcagcacggtggacagtgcgtaagccggctgggcgttgaggatctgggaggtgtgcgcgtggtcggcggtgacgatcaccagcgtgttcgtgaggtccacgttctgcatggcgtaggcaatggcctggtcgaagtcgtcggtctcgccgatctggccgcaggcattgcctgcgtggtcctgcttatcgatcgaggcgccctcgacctgcaggaagaagccgttcttctggccgttcgggttgtcattcagcaaatcgagcgccttcttggtcatgtccttgagcgaggagccctgattgccgagccagtcggcgttcggggtgcacacggtcgggttggcgtccttggctggatccttggcggtggccttggacgggttgaacttggtcggcatgttaccgtcgctcatcagggcgagcactggctggccgtccttgtactgcagggcgttcatcgcggccggatcgttctcgacggtctggaagcccatttccttggcctgttcccacacggtcttgcccttgtattcaccaccctgcacggtctgacggaagtacttggaaccaccgccgatggttacgtcggcgcgggtgtcgagcagctgctcggagatggagccgatgccgccgttttccttaagctggttgatgaggcactgcttggaggcattgttggacgtgccgtcggtcttgccctgtgggccgtagcaggcacgttcggacgaatgcgattccagcacggccggggtggcatcctggatttcggcggtggtcacattgccggtggctttgccggccgccttggccagctcgaagaggttcagctgcggattgccgtaaatatcaacgtcaacggcgttgttgtaggtcttggtgccggtggcccatgcggaaccggatgcggaggaatcggttacgggggtaagcttgcccggattggggttggcgaccagcttgccgtcgccatccttgccgacggcgctgtccttgctgccgttgccgacggagaaggtcgtgtactgaccggtgccggcctgcacgtcgccgagcgcgccgggctggccgaccgcgtcgagaccgtcgaagtggccgttggcgcccttcaggtagtcgcgggcgacggtgatttccgaatcgcccatgccgtcgccgatgaacagcaccacgttcttggcgtttttgttgccgatggctgcgatgcgttgcgcgccgccgtgctgcgccagttccgcaacggacttgccgttggggctgtacgtggtgtcggctgcgagcgccggcgcggcaagcgcaccgagcgttgcgacggaggcgagggccgcgattgcgcccgtgagagccttgtgcttactcatgtttcttctttcttccatgcagtttcgtctgtgccgtccggtttcgtcgattcgttgcgatcgaggcggtttcccgattcggtttcccgatttcggagtcccgttttcggctataccttccagctatgcggaacctttccgcaactgcatttgcttggatctttcgattccaccgcccacgctatgcgccgcaagccaacgcacaccgcactacagaagaacggcagatgaacactcatcgccatatgatgaccgcaacatatccaccgcatgaacagggggaatacggccaataaaatcgccatattccgtcaaacaacacccccaccgcaccccacaagccaaaatcccccactggctggataaatccaacctctcagaccccactcacacgccaaaaatcccagtgactggataaaaaccacctctgacgcaccactcacgcgactaaatcatccagccactggaaaaaatgcccgcgccactcagccccgcgcaacccgcgccgcgcgcgtggcctttacggccacgaacacggaccgcaccagcagcacgcacagatagcaggcgaacataatcgccccaactcgtggcgaaacctcccccgcaatccacgtgccgagcggcgcggtcacagccgccgtcacgccaataatcagcgcggttttcacatgcgctagcctgcgcttcaagttcgccgcgctggtcgtgatcgaattcggaaacattgccaacagcgaagtgccgcgcgcaaccaggtcggacgcgccaaacagcatcgacagcgacggcaccgcaagcgcaccacccccaatgcccagcagccccgccagcgtgccgatgaccacacccagcaacgccaagccaatgccggtcaccaccgtcatgacaatctggtggtcgcgcgacggcacaaaactcacctgattgatcaccacaaacacgagaaacgccacgaaaatccaccgcagcaccaattccggcagccgcgacagcagccaactgccgatctgcccgccgacaaacataccgcaaaacagcaacgccgcggcgagccagtcgacgtgcccgccggtcgcgtacgaaacgacgccggaaatggaggtcggcacgatcgccagcgtggacgtggcggccgcgttgcgttgcgacaggccgagccagacgagcgcgggcacgatcaccgtgccgccgccgatgccgaacgtgcccgacagcacccccaccaacatgccgaccacaatcagcacgatgatgctgagcgccgacccgtcaagcgccgtctcccccgctcgcgattccatcttttgcgattccgttcgtacggcatccgcccgatccgcagtttccccttcatcacacatggcagctccttccacgtcttccgcgcccgatactacccacctgccgcgcgcagcaatcagccgattccataattttgcgatttcgccgccgcagcgcccggttcacgcgctttctcgcttatagatggcggattcgcgggatcgacggatggtatctcgcttatagatggcggccccttgcgggaacaagacatctagggggcatgcatgctaccccctaacgacctattgcccaaaccgacccgccacctataagcgagataccaccggacgcccggccgaatccaccatctataagccagatacccagccaaaaccacgaccgcacgcctacacccacgcctacaccggcacacccgcgcgcctacacccacgcaagacccattgcacacacccccgtacgcacacgaccgcgcgcggaccggcaaaatcgcaagtcatgagcgaaaaggggcatcaaaagcgtccgaaacagcccgaatcacacccccatccgctcacagacaagcaaaaccagcccaactcacaagtcgtgagcaaaaggggaggccacccaacatcaaaacagcccgaaacatccagaatcgtacccccatccgctcacaaccgcgccaaaaccgtcaaaaccgcaagtcatgagcaaaaggggcatcaaaagcgtccgaaacaggccgaataatacccccatccgctcacaacccatgcttcagcacgattcaggccatatgcgcaccgcaacaacacccctgcgcaacatcagacatgcacacgcacgcaaacacaagtacacacactgaaacgcaacacgtaccacaagcacacaaacaccacgcaccacataccaagcacgaccagacgcacacccccgcacaccggagaagcgatgtcaccggcttgcggcggcgctaggctagacactacccccgaacaccagacgaatggcgcgcgccggccccggcgcacaacccgtgccgcacaatccaggagcgtcgccatagccgcgcgagccccacaaaagcgcagccagccacaaacacgagcagtccgatcaccgcagccgccacggctgtcatttcgcccggctcgtcgtattgcgtcttgtctggcactttggggttcggaatccggtgcccgcgcacgagcaacctgtgcgagttgatgccgtacggcgtgcaggtgatcagagtcgcgtaatcggcgcccggctcgatgttgagtttgctgatttcgcttggcagcaccactgagatctggtccactttgtacgtgtacgtttggtcgagcacgtggaatgcgaacgtgtcgcctttctccagctcgtcgagaccggttagcaatcgcgcgctcggcagcccggtatgcccggagatcaccgcgtgcgtggtcgctccgcctacgggcagcgatgtgccggccaaatgtccggcggcgatctgcaatacgccgtcactggtgccgtgatagacgggcagtttcactttgatgcgcgggatggtcacgtatcccatgatgccggtgccggtcacgtcgagcgtttcatcatattcgcgcttctgcgcgtcggtcatgtgccaccgatcgccgttcgcggcgagccgttcgttgtattcgtgcgccgctttcagcatggctttgcgttcggcgccggacatgtctttggtttgttccacgtagcctgccacggcgtatgactggtgcatgcggttccaccagtcgctgaatgtcggatacgcgatgaggcccagcgccccgatcatggctattgcggaaatggcaatcatcacattgagcagcgcattcgatttcttatgcttggcagccggtttaacctgcgcacccggtttaacctgcgcatccaattcgacttgcgcagctggcttggcgtccgattcatccgtcacgttacttatgctacgcccgcttccgcaaagccgtcttggcaacgatcagcagcaccaaacccgcgcccaagatggccacggcaatccaagcggcctgctgcacgtcggcgccggtgtgcggctggtccggcgtggtgggtggcgtgtgcgtgttggtgatttcagtggagtcgccttccacatcggagatggtggtgtagccgtcgggcaccgccgcttcgaccacggtccattcgtggtccgcgtcgagcgctgtccacgaatgcgtccacttgttggactcgttcagcttcacgttttccacgggctcgccgtcgcgcaggagtttcacggtgatggattcggggcgcttgccgtcagaattgttccggtcattccagattttgcgcacggtgcgtttcacggttttcggcggttgcgccacacattcggttttcggttcgatactcagcacacgcgacccgccggagacgccgtcttcgggcactgcgacgagcatgctgccggaagagcacgtccatgtctggttctttccggaggcgttggcgaccttcacgtcaacgctgtcggacacggccaagtacaggccgtcggacagtccggtgaaggtcagatgcccggaggtgttggcgacgccggttgccgtggcgtcaggttggttcaccgcgatgagtccggcgagcgtgttggccatgtctcgccacacctgcgcgtccttgccggtcatcttcgaccagtcgacggggtaggcggtggagtcggtgaacggtgcgacgggttcgaaggtggcgccgccgcttgccgggatctgcccgactttgtagaggttgaagctggcgtccgaaatggcgaagttggtagaatcgtcgccagtttcggagtccgagcttttatgttggtacgaaatggcgatgctgccgctggcagagtctgttgttggcgccgcgacggcatcgcgagtaatgaatgcacaggctgccgcggcgaatgtggcggcgattgcgcagcatgcggcgatgacgcggcttgcgatcgtgcgttccttcattgccgacccctcttctgtggattggaaagtaagcatgtttgattcgcccccaacggcaaaccggaaaatatatggagccaggctggatactcaagaaaattaggcagtgtacaagggattgaggtctttatgtctgaccggcctcccctcgtctcgccaaggtgatcattgctgccgctcctttgccctgagggccaggagaccaaccatgatcgcggcggtcagtgagcgggcgcgcgaaagcacgcgaccggatgccgatcgcattcccgaatagtgctgtggcgcattctgcatggtaccgttacgcagctgcttcatcctgtccccctgccgcacgactacagccccctctaagttcctttccaagaggtgacatcctttgcaggaacgtcaactcccatgctcttcattgcgcatatagcggcctgctatacacttctcctcgcttcataccctcgtttgagtacccctcaatgataacctttgcagttatgaaatgaaacactgctaccctacccccgcgacgcgttataccctcctcaaaatactgcaataaaggcaaacatcggctgatataccgccgttcccggcattgcacagaccacactatctctgcaaatttattttcactatcacgcaggaaatcgtacccccttctacgtgttgcaacaaataattctgcaaacattttcatattttgcatgcatcattcgttccgttgtacaacgaaaacaaagcaaaccgcccctaaaaacagcccccgttataacgccatcatgaccacggcaccattaccagcgaaactgagcgaatcgcatccgcaacgacaatcgaagcctcccgaccgacatgcagatgcggagcaaaaaaatgtgtcacgatcctgattttcgccgcaaatttcgaatcatgacacatccagatgccgaaaaagccaatttttcaaccgactcatacccccgacacgcaatttcggcggattcgaaccagtacgggggtgcacgatgtgtcacgatcccgaaaaacagcccaaaatcagaatcgtgctacatatacgggggtgcggaaacacaaactcggcccccgcaataaaaacatcaacaatccacagaagtaaaaaaacacacgaagacacaaccggcaaccaatgcaactattacggacgcaccgacttcctcacaaacgtcagcagcccatcataatcgagatccccattcgcaactgaaagaatggaatgaagcagctcaccatgatcaaaagtcgcagcaatgccgccttcgcgtaaaagaaccagcatcaacgccaatcccgtacgcttattcccatcaacaaaaggatgctgcgtaatcacctcatatcccaacctcaccgccttctcgcacaacgtaggatacaagtcctcgcccgcgaaactcatccaaggagaagccacgcatccctcaagacaagacaagctccgcacgccaccagatccaccatgacgacgtatctgcaaatcgtgaatagcaagcaccgtaggaacgtcaatcggctgcgtaacactacgattcacgcgcaagaacctcgaagacatcgcgatactcatcatctatcgcccgggcagcatcaaggtaccgaccctgcaccgcatcctgccgcgacccttgagccggtgccgcaaccggatccagcggaacgatcttgaaagcaggcttgttgttcttaaagacggtaacggaaacacggtcatgcatgactttgtccgtgatggctttcaaatcgcgacgcacatccgtatagctagccgttagtggcatcacagcccccatcctttgtatggcaccatattcagtacattatattgtacagaattcttttatcggacagcgcctgtccaacttccggatcatcgatacgtgaagactgccaccggcggcgcggatgcggaacaaaatgtgtcacgatcccgaaaaacagcacaaaatcagaatcgtgctacatatacggggtatcgaagcattatgacgaggtgcaaaggcattacggggatgcagggacgcaaacccaaccaccaaaccgcacaatcaaacagcagcgttacccacaaggttgaaagcacacgggggcgcacaccacttcgaccccgcaaggattccgagccctacacaacgcagccaaaataccagccaaaacaccgcggttccgaataagaccacaatgcgaccataccccgctcatcttcgaccccagcagcctcggcgaaatcgcgcccaggcccagaaccggaacctactgctccccgccgaacacggaatcagtgccacgcagcaccagctgcgcacgcaccacttcgtacgggttctccagcggctcccccgcgatgagcttcatggccttctgcgcggccgcgcgacccatcgcatacggatcctggcgcatggtggtcaggttcacagtgtcggcgtacggcgaatcgtcgaagccgataatcgagtaatcagaaggcgtgtggtggccgtaccgttccaaacgcagcaccagcggaatcgccatcatatccatctggcagcagatggcgtccgggaattcgtcgaacgccagcagcgcggtcaatgccgaatcggcgaacgtcttgccacgcggcacggaaacgacgcgccacttgaagtcgtgcgtgctttccatggtcttgcaggcgcggatgaagccctgtccacgcgagtcgatggaggaattgatggagtcgatggcgtcggagcacacgtacacgatgtttttgtggccaaggttgatgaggtgctgcgcggcggtgaacatgccgtcctcatcgtcgatggagatggtggcgtcgaatccgctttgcgtcggcgtattgatgccgatgatcggcacgtggatgcgtttgagctgctggatttccttcggatccacgccgaacgacgttacgaatacggcgtccacgttgcggcggacgggcagattcgtgaagaattccttgcgattttcggcggtgtcgacatgctggaacagcgagatgtcgtacccggcgtcgtgcatgacggagtcgatgccggcgaacacttccgtattgaaccagctggtgatttcctcgttcatcagcatcgccacacggtacgattggccggatttcagcgacgtggcggaacgggagatgttgaaatcaagcttgtccgccgtttccagcaccttgcgacgtgtacgttcggacaccagttccggacgcttgaacgcgcgcgataccgtggaaatcgacacacccgcggccttggccacctcgcgaatgcctgctctatccatctctcaacccctttgcggttctagcatcataatcacaaacgtttccaaccttggaaacactcgcttgagcggtgatgctctctcaatccgtttctatcatattgcgaacgttgtcaaaaatcacgccagtgttgcacaaatcgcacaaattatcaaaataaccgggtaaaccgcgtaaaaagcccatttcgtccactgatgcttatagcccagcttgccgttgtagtagtgcacgaacgccacgcccacgcccggcgcgatcatcatcacggcgccgaacaggccggctgtgaacatcatcgaattctcatactggcgcatcagagcgaaaatcagcacgaagccaagcgtcaccgaaccgatgctcatcatgtgctggcgtaggccgatacgcagcagcaggtcccacagcagaccaatcaccaccagtccgaccgacaacagcaccttcatggccttctgatagcgcgacgccacccagtcgagcgcggcaagcacaacaaacgcaacgaacaggccgaaaacgggattctgcgagcccaggtcgaaagccttatgcgatgtggcgaggtcgtacggcacctcgcacaccacggcgagaatgaacagctgcaggccgtacgcgacccggctgtgcgtttcacggaaaccctgcaccagcagccacgcgtagatcggaatggcgaaccaggacaccacttcgctcaggaccatcgccgtcagcgacgtcatattgttggtatcggagccgaagaacagcggcacgatggtggtgctgccggcggacaaggccaacgccaccgcgccgatgaccttaagttggaacaccgtcagtccgcgacgctttttcctgttgcggcgagcgccgccgaatccgatttggtcggtcgaatcggttcgagctccctgctcggcatagccttccatatgtcctcctattgcgatttttccgcgcgtcgcacgtggcacgtgcaccttacgcacgccttacgcacgtatgccttttacgacttgcgacttttccttgcgactttcccgcacgccacagcggcttcccgcacgtcccatgcgatttaagctcagcgcccaccgcgcgccttatgcgtccagcacgaatttcagcagcccgtcgtagtcggctccggtaaacgaacataccgcatgctctgacgccgccggatcattggcgggcgaaatctccgtgcggaaatacgcggcatcaagtcccgcggcattggcgccgatgatgtcgttgcgttcgtcgttgcccaccatgagcgcatgcttggcggtcacgaattcacggtcgagcgccagcatgtacagctcgcgggacggcttgcgcatcttctcctcactggagatgatcacgtcgtccagcacgctcgccaaaccggtcatctccagttcgggcctcgtgtagcatgcctgcgcgttgctcagcagcaccaccacgacgccggcgtcctgcagacgttcgatcatgtccagcgcgcccggatacagacggatcatgctggtgctggcctggcggaacgcccatgcggccttttccgcggcctgcggcagcgccaatcggcgttccgcctcatcgtcgcggttcatgagcagcgagcggtacacgggcaggatgtcaaattccccccacccgtcgcgcacgatcgcacgattggcctggtgcaccatctcacgcgcctcaagttggtcgaaccgttcgcgcatctcgtcaagcgacccatactgcgcgcccagttcatgcacgcagtcatataaagcctgccaggcggcttcgctttgctcatcggtacgaatatcgatcagcgttccgtacaggtcgaagaacaccacctcatatcgtggatcttgcgctccggtttccactttcgtgtcctttctggtcttccggcctcgttgccgtagcgggggcacggcgaccgccactttgcgatcgccgcatgggttctctcttcgagagtattactgcaacctccagattgcaaacgtatgcgccggcatgatcagataatcgtcgtcacctccccctgtgctgacgccaccccctctgccggacactccaaggcagcaccagtaacgatgcatctcaccggaatcgccttccacagccgcggcggccacgtccaccacgccggtgcgatcggacggattgacggccaccaagtaatcaccgacgcggaacaccagctcatcgccttccgtgtcgacgatcttgcgattgccgtcgaaccatcgcgcatcgcttttgcgcagggcgatcagcttcgcatagaaaccgatcagatcgcgcatatgccaagcgcggttccaatccagccagttgagctccttggtcgaatcgtacgaatcggaattgccgtatttggtgcgcgcgaactcctcgccggacagcatgaacggaatgcctgccgatgtgagcacgatgccggcggacagacgattggcccccagcacatcgtgcaacgcctgtgccatctccggtccgacggcgtccagtccctgttcggagaaatcggcgtcatgcagcgtcttcggcacatccaccgtgttttcctcgtcgccttcggccacggcgctgcccagcgagctcgccgcaagactggcgcatagcttgtcccacaaggtcaggtcatcatgcgcggaaacgtattggatcacctgcccagcaacgccttccggccggtcgctatggcgccaggcgtccaccgcctcgcgcacggccacggcgttggcgtgcatgccgccgttcacgtagccggggcgatccgaatagaacacgtggcctttgatggtgtcgcgcgtggtgtcgcagaagtggccgatgcgatcgtccaactgcgcaagcccctgcttgccggcgagcagcgtgtccgcgggaagtggcgccgacgcgcctgcggaccacggttcgccatacatgaggatgtcacggccgcggccgggaatctcgttcaacgcggcgcgcacggcgttcatggtgtccacgtcgatcaggcccatcagatcgaagcggaagccgtccatgtggtattcgcgcgcccagaacgtcacggattccacgatgaaccggcggaacatcttgcgttcggtggccatatcgcagccgcagccggatccgttggccagcgcgccgttgggcttgcggcgcaggaagtatttcggcaccgtacgttcgaaccaattgtcggtggagaacatgtggttgtaaaccacatccatgatcaccttgatgcccgcactgtgcagcgcctgcaccatctgcttgacttcgcggattcgtgtggtgccgtcgaacggattggtggagtacgagccttccggcacattgtaattgatcggatcgtagccccagttatagcggtcgcaggtcgtttcgtccactgaaccgaagtcgtaaatcggcatcagctgcactgcagtgacaccaagcttcttcaggtacgcaaggccggtcggaaagtcgggatggccttccaacgacgtaccgtcatcggtgaacgcaagatacttgccgcggtgcgattcggggaaaccgccggcgggatcattgctgaaatcgcccacatgggtttcccagaccaccgtctgcgcaagcggcacgtccggcatatggtcgcggtaccaaccatccggattggtgcggctgaagtccacgaccatgctgcgccggccgttcacaccggccccgcgcgcccacggatcggcgacgcggtccacggaaccgcaatcgcgttcaatcaaaaagtcgtaatacacgccgtgcttgttgtcggcgaaaacgaaattagcggcacttcgctgcgtctaggtctgcaaagctttgcaattctcgaagccgagtagcagacgagcaatgccccgttgaaataatcgtttgcaatgcggagcgctgcgccttcgtattgcaaacgatagtcaatatgaaaaaacaattccggttatctatattcctgaaattagagcaaaatcgcaatatagcaacactctcttaccgcaaaacacgctttgaaaacgatatcataccgtgatatagttatctttggtgcgaatgccaccagcatcgaagctgcggcaatcgcaagcaatgtagcatgtcagccgtcacaaacggcgcggaaagaagggacccatgacacagacccagcagaccgaaagcgcagaacgcatcgcacggcctcttatccagctcgccaagctcaatggcatttccacgtcgtatatcgaccagctcggcacctatgtggaaatccgcgacgaagtgctcgtctccgtattggccgcactcggtgtggacgcatccagcgacgaagcgatcaccgcctcctatgcggcgacccagcagcgcatcgcagacacacttgttgagccgaccgtcgtgaagttcatcggcaaggaagccgtcacgccaatccgcgcgaaaggaaacgacgtggcgctgaagctgacgttggaagacggcacggaatatgcgggcgatctgaccgcgtatctgacgggctcgaacgcagatgacggctcgctgcaactgacgctgccggacgatattcccgccggctaccacacgctggccgtcgatgccggcccgctgcacgccgaagccgcgctgatctgcgcaccggcacgcatcgaactgccgccagcagtagcggaaaagcaacgttggggctggatggcacagatgtattccatccgttccgctgaatcctggggcgtgggcgactatggcgatctgaagctgctgctgtccgacgcggcaacgaaatcgcatgccgatttcatgcttatcaacccgattcacgccaccgcgccggtgccgccgctggagccgtcgccatatcttcccgaatcgcgtcgttttctcaatgtgacgtacatccgtccgcaggatatcgctgaatatgcggaactcaacgaggcggaccaggccgaagtggcgcgtctgcacgcggaagtctcgccagccaacgacagtatcgagccgctcgacatcaattccgcttggtggcacaagcgccaggcgctgcagcttgtgtacaacgtgccgcgttccgtcgagcgtcaggccgcgttcgacgcgttcaaggaggccgcgggtccggatctgcgcgcgttcgccgcatggtcggtggcgttccaggtgtggggcgcgccgtgggaaggcacgtggttcaaggacacgaaccgcgattcgcctgaagtggtggagctcatgcgcgagcacgccgatatggtcgatttcgaatgctggctgcagtggatcgccgacgagcaggtgacagccgcgcagaacgccgcccgtgacagcggtatggcactcggcctcatgcaggatatggccgtgggcgtgcactcgctcggcgcggacgtgtggtggaatccggaacgtttcgcagtaggcagcgtaaccgtgggctgcccaccggacttctacaaccagcagggtcaggattggggccagccgccgttcaatccgaattatctggccaaaactggttatggcgtgtaccgcgagatggtgcacaacatgttctcgcacgcgggcgcggtgcgcatcgaccatgtactcggcctattccgtctgtggtggattccgcagggcgaaggcgcgcgcggtggcgcgtacgttacgtacgactatgaggcgatgatcgcgatcctgaccattgaagcgtcccgcgtgaacggtttggtggtcggcgaggatctgggcaccgtgcctgattacgtacgcacggtactcggcgagcacggcctgctgggctgcatggtggaatggttcgcccgcgtggacgactcccccaacgccggcgacccgtacgccgatccgtccacgtaccgcaagtacgcgctggcttccgtcaccacgcacgacctgccgccgaccgccggctacctgcagttcgagcacgtcaagctgcgcgaacagctgcacctgctgtccggcccggtcgaggagttccaggcttccgccaccgccgaacgcgacgcgatgatggaccgtcttgtggagtccggcctgatcacgccggaagtggcgggcgatgtggaaggccacatccaggaaatcgtcgaggcgatgcacaagatgctgctcaagtcgccgtccgtgctgctgcaggccgcgttggtggatggcgtgggcgagacgcgcacgcagaaccagccgggcacgtccagtgaatactccaactggcgtgtgccgctggcaggcccggacctcaaggtggtgcacaccgatgaggtgttcgatctgccgcgcgtgcaatcgcttgccgccatcatgaacggcgagaagtagcgtttagacttaccattcccctttccttacaaaccaaaattccggtcctccttgtggagggccggaatttttcatatatgcaaggcgatttgggagcggttaggccgcctgagaacaatcgcaacctcagccagcagtgcaacggccaggttcagcggtcgatcagcccagcagcagccagacggaggcgtcgctatccagcttgccgtcgtccgtcaacggcacggaatttgcgatggcgaccgcatcgtccggcagggcgatcggctcgtcgccgaaattggtgacggacaggaatcgacggccttccgtggccggacgcgagtaggcgaccaccgtatcgcccatgtccagcaggtcggcggacgtgtctccggtcgccgtcagcaccgtctgccgcagctgcaacagcttgcggtacaagtgcagcatggaaccgttgtcatcggcctcgacgtcggccgcgaaatccttgaaccaggccggctgcggcaggtgcgcgtcggcggaatcgccctgctccgggccgaaaccgaacgtgccgccggtgatgaagtccgggctccacgaagccggttcgccgcaatcggcagccttccacggcatcggtgcacggcagccgtcacgacccttgtcggtgaagttgcgacgggtgttgaacggcgtcggatcctcaagacgatcccacggaatgttcgccacttcgaacaggcccagttcctcgccctgatacacgtaggcggaacccggcaggcccagttccatcagcgcggctgcgcgggcgcgacgggtgccgagctcacgattctcgcggtaggtctctccgtcacgcaacagccaatcgtgcgccagctggtggtacggagcgtccttcacctgcggcagaccgaaacgcgacggactgcgcggcacatcgtggttgttcataacccacgtcgtggtggaaccgtgagtttcctcggcggcgcgcaagccgtcagcaatggccgtacggaactcgtcggcgaaccagttggcttcggcgaactcgaaattgaacacctggccgagctcgtcggtggacgcgtacagatgctgcgattcggccttcacccacgcctcgccgacggcgaaacgcggcggattgtactcgttgaacacctgacgccattcgcggtagatgtcgtgcacttccggacggtcccacagcgggctgaacgcgccgtccgccggcagcacatgctgcaccgcggccggatccatgtcggccagcggcacggaatcgaggtccttggccaagccgtgcgccacgtcgatgcggaagccgtcggttccgtggtcggaccagaatcgcaatgtcttcttgaattcctcgtgcacgtccggattcttccaattcaaatccggctgctccttggcgaacatgtgcaggtaccactggccgtcgtcgacctgctgccacgccgggccgccgaacagcgactgccagtcgttcggcggcagctcgccgtgctcgccgcggccttcgcggaagatgtagcggtcgcgtgcggccgaaccgcggccggcggcgagcgcctcgatgaacatcttgtgcttgttggacgtgtggttcggcacgatgtcgacgatcaccttgatgccggcttcatgcgcggcggcggccatcgcgtcgaaatcggccatggtgccgaggcgcgggtccacgttgcggtagtcgatcacgtcgtagccgccatcggccaggtcggacgggtagaacgggctcagccagatcgcgtcgatgccgagattcttcaggtaatccattttctcggtgacaccggcgatgtctcccaacccgtcgccgttcacgtctttgaagctgcgcgggtagatctggtagacgacggcttgcttccaccaatcgtcacgcatgttgtttgctgtcacgataaccccttttgtcgtagtccatcggatgcggagcactgtctccgctacatgaaaacgataacatcaagcaaagcgaaacgctaatgaaaacttaatcattgcagcacatcaaacgtttgacgaaaatgtgcatactccagctgtatcgagtagaatcgcggaagattcgacttgcatacgttgccaacggatgccatacgaaaggcgattatgaagttcctctcccccgattccggctttatgcgcggcctgagcgacgccgtcgacgcgatctggatcaacattctgatgctcgtcaccagcattccgatcatcacgatcggcgcggcactgaccgccggccacgacgccgtccgtcgcacgctgtccggcgaaggcacggcgacgcgcaattatttcaaggcgttccgttcgaattttgcgaaatcgaccggctattggctgattttcggcacgaccggcacgctgtgcgtctactcgtggatcgtgctgcagatcacgccgctgctcattccgaaattcgcgttgacgattgtgtggctcatcggtttcgaatgggtgtgggcgttgcaggcgcggttcgagaactcgttctggcgcacgcttggcaacgcttttgtgttcggcgtgagcaacatcggccacacgttggcattggttgcgatcgacgcagtgtacgtggcgctgctcgtggccagctgggtttacatgccgcagggcctgttcctgctgctcatactggggtatggcacgatgctgatgctgcattcgccgattctcgagcatgtcttccgcaagtacatcagcaagtaattaggcacgaaaaaagggactgattcgcatcagtcccttaaatttttctgggtgaaaatcagcccttcaccgcgccgccttcggccctgcaattaaggaccgcgctacgcgcgggctcaacgttaccctcgcggcatagccgctcgggctggagcctgggaacagcgcactgcgctgttccctaagggctgatcgaagatcagcccttaacggctccagccataacacccttcacgatgtacttctggcagatcaggtagaagatgatgatcgggatgatggccatgaccaggcatgccatcatggcgcccatatccacggaaccataaccgcccttcagatactgcaccgccacggaaatggtcttgtacttgctcaaatcgagcgtcaggtacggcagcaggtagtcgttccagatccacatggcctgcagaatggccacggacacaatggacggcttcatgatcggcaccacgatctggaagaagatacgcggcacggaagcaccatcgatcatggcggattcttccagcgattccggaatgcccttaaccacaccggtgaagatgaacacggccagaccagcgccgaagcccagatacacgaagcacagaccccacggggtgttgagcttgagcatatcggccagcttggagagggtgaacatgaccatctggaacggcacgatcatgttgaacaggaacaacgtgtacagcagctttgcagcccagttgttcacgcggacgatccaccatgcgcacatcgaagtgcacaccagaatcagcgccacggaaccgacagtgatgagcagggtccagccgaaactggcaaagaagttcgtggtctcgaggccacgcgtatagttttcaagtccaacgaacgccttaccggtcggcagggagaacgcgttacgagaaatatacgccttctgcttgaaagagttgatgatcaccagcacgatcgggaagatccacgccagcgaaaccaccgcgaacagtacggaccacagtgcgccgtgcttgactttttctccggagttcatgcctccacctccttgctcgtggtgagcttgttctggatgagcgccacgatggccaccagaatgaagaacagcactgccttcgcttggccgacgccttcccagcccatacggccatagaacgtgcgggtaatgttcattgccagaccttcagacatgttcgacggagcgccgttggtcaatgcaaggttctgatcgtacagcttgaagccgttggtgacacacaggaacgagcatacggtgatcgacggcatcatcagcggaatgatgatcttgaacatggtctgggtgccgtttgcgccgtccacggaagccgcttcgagcacgtcggtcggcagcgactgcatgcctgcgatgtagataatcatcatatagccgatctgctgccagcacaccaagatgaccaagccccagaagccgtaggttgcgctatacgtcaacgcgcggccccagtgagcgagaatgccgttgagcagcagcatccagatgtagcccaggataatgccaccgatgaggttcggcatgaagaacaccgaacggaagatgttggagcccttgatggccttggtcagcatgtatgcgatggcgaacgcgactacgttgatcacgatcgtcgtgatgatggtcagtgccgtcgagaagcccagcgcgtgcaggaactccttatcggcaaaagccctcttgtagtttttcagaccgacgaattcggcgtcggtgacggtggtgaacttgcagaagctcagatacacacccatgatgaacgggatcacaaacccgatgatgaacgcggcgaacgttggcagcgcgaagagcgcccaccactttcgtatcgccttgccagccatgctgatcatagcctgcctgctttctttccttctccattccgcgtaccgcgtcaacgcgggcgggaattccattccccagaggaaccatccacagcattgtttcctgtttctccagtgcttacatcagtcatgataaacggcatgactgcaaatgtcaaacgttgtcattttcgtatgtcacgcacggcaaaatatgaaacgttgtcaccaaaaaccatctctagagaacgcttatattccacgcaatgcccaactaccaccactttatgaaaacgtttgtaatgaataagttgcaaattggacaagaacacggtcttaatggtgaggggaggtagcattacattattcaagcaatcactgtacaggggactcgatgaaaagcagtagcattcaggatgttgcgcaactcgcgcacgtgtccatttccaccgtctctcgttccttcacgcgccctgacctggtgtcgaaagccaccagagacaaggtgatgaaggccgcggacgagctgaatttctccatctcgcgttctgccgcggccttgaaaaccggccgtgcgctgcgtatcgcggtactcgtctcaggccggctcaacctatggttcagctcctccatcatcgaaggtctgaacgaggtcttccacgatgagggctacgacatctccatctaccagatgtccagcaccgaggaacgcagcgagttcttcgacatgctgccggtgcgccgcaacgtcgacgccgtgatcgtcatttccttcgacatcgccagcaacgaaatcaggcaactcaggtcagtcgatgtgccaatcatcggcatcaattcgagcttgccggaagagcgcggcttcaacgccgccgtccgcatcgacgacaagcagggttcggaactcgccgcacgccatctgatgatgcttggccaccgcgacatcgtctacatccgttccgaccgcgaagtgacgctgcacttcagcgtgcagggccgttacgaatcgttcatggcatgctgccaggccaacggcgtcgaaccgcgcgtgcttgtcaccgacgctggcaggaacaggatcagcaaggtcgtgacgcagctgctcagcctcgaccacatgccgacggccatcgcctgccaggaggatggcatcgcggtgccgctgctgttccagctggaacgcaacggtttcaccgtgccgaacgacatctccatcatcggttacgacgacagcgtctacgcgcgcgacctcggcctgaccaccatccgtcagacccctgtcgagatggcccgcgaagcggcccgcatgacactcgcgctaatcgagaagcagccgctcgacgaaccgttcaagacgttccccgcgcagctgatcgtccgttcgaccaccgctcgtctgcatagctgattttccggcaacatacagcgaacgtagcgacatacacgaagggccgtcatcgcaagtaattacgatgacggcccttcgtgtatgtcgtcacaaccaactgcggccgagagaaggaaaggaaaaactctcggccgcagttgttctattcagttattggtttgatcaagcggtgatcagtgaacagcgtcgtactcggtcttccaaccgtccacgaacgccttcttgactgcgttccagtcgccggtgccctgagcgtattcgaggagggcggaaccaagcttgttcttccactcttcggacggcatcatggtgaagttccaagagactgcagtcttgccggagttctgatcatcaacagcagcctggaccagcggattgtcggacttgacgtcgctgaaggacttgaacggggtggtgaagcccatgtcgctggacagagacttgatgccagtcttgctggtgacgacccacttcaggaagtccttggtggccttcttatccgcgtcggaagccttggagttaatgcaccagtagttctcggaaccggtggccagaccctggttcttctcgcccttgacgccggtgtagatcgggatcatgccgacggactcggccttcatgccagccttctgcagatcggtccatgcccaagtgccgttctgatagaacgcagcctcgccgagggagaactcggaggtagaatcatcaccggtcttggagctcagctgggtcggctcggtggtggagtccttcagatacaaatcgaagatgttcttatattccggcagataggtgcccttgatggtctccggctgcttggtgacgttgtcatccttgaactcatagtaaagcggcaggttagccaaatgggtcttgaaacgccagtcggagctggaatcgaaaccggcggaggtgaacgcgcccttgacaccaagctggtccttcttagcctggatgtcatcggccacggccttcaaggtatcgaagttgtcgatgtcatcgacgctcttgatcttggcgccgtcagtggcaatgtacttggccagcagatccttgttgtagatcaggccataagtctccatggcatacggaacaccgacgaccttatccccatccttgagggcgacatccttgttgataagctgcttgtacggctcagtatcggacatgtcttcggtgtaggacgaccagttctggtagccgacagggccgttgacctggaacaaggtcggagcctcggacttggcgatctcggacttcaaagtctgttcgtatgtaccggaagcagcggtctggaccttgacctcgacaccggtttccttggtgtaatccttggccagcttcttccattcgtcgctggattccggcttgaagttaaggaagtacaccttgcccttgccgttatcggaacttgagctagaaccaccgcaagcagccaacgtgccaacagacattgccgcgatagcgaccattccaactgctgccttaatagtacgattcatcatcgaacctttctcttccattcctgttcccagcttctcgttgggaaacaatttgcggtatcgcgtcatcacgattcctaacaaccactattatgccgcattcccccgatttttgcaaacgtaggcaaaatgaattcaaaagtcagacgtcataccatcgaaagaaatcccgaaaatcatttattttcaatacttttagagagcatacttttatgcaagcgtttgcgacacgccgcagcaaagtggcaagtcatgcatgcaataaagaggcggttccaaggagggaccgccataatattcagcgatatcaaacagttccgttcaataattcagcaattccaatgttcgataacattgtcacctttatattggcttaatacacaataatgcgcagtgtccaatcgcagcaaccgcgcgaaatgcggatcaacaccgagccattgcgacgtcaagatacgaagaacgtgcgcatgcgccaccagcagcacatcgtttccagcgtcgagcaacggtttgaccgtggcgatcgcctcacgtgtgcgcgccgcagcttcctccaccgtctcacccggaccgttgtgcacgggcacctgctcgccgttcggcaacgtctcgacccaatcgccctccagtgattcggggagcgaccgcggtccgtcgcgccacacatcccaagcgaaaccgcccgccgcgctcacatcctgacgcgtacggccctcggcacggccgtaatcccattccgcgatttcgggaagcaccttaaaatcgccatatccggccagctgcgccgtctgctgggctctgcgcaacggactggcgaacatgcacccctgcgcgaaaccctggggaaacgcctcacgcaaccgttcgccggcggcacgagcctgatcgcagccaatgtcagtcaacggaatattggtgcggccggtgtgctgtccggattcgctccacacggtctgcccgtgacgcaacagcaccaagcggccaggggtgattgcggaagcggcattgcctcccagttgagtttcagtcatgtctctactctagccgacgcaagctgcgttttcatcccattccgccacgtgtcccgcacatattccggcatgttttccgacgcgttacactggtttcatgagtgaaatgccgaatatggaatccagtgcggaccgcgtggtggcggccctgcacaccgtcgacgagaaggtgaatgcgatgcgcgaccagagactgaacgatcccgattcatttggcgataagattttcaagtccgtcgtgcccacgttggccggactggtgctcggcaaggcgttcgagatggtgtggaagaaaagcgtcggccgcaaggccgtccgtgccgacggtaccaagaacgaggctgcggaagcggcgctcggcatcgtattcgccgtggtttccgccggtttcggcgcgctcgtatcgcaactgtccggccgcgggtcgaaggcgattgtggacaggcggcacgcacggcaggcgcatcgcaagtaaatacgtcgcaaatatcgcaaagcagtctcaagtagatatgttctcacagggagacggatttagcccgattcccttgcaaaatcgcgccgcgcggacaacaatggcggtatgagcaacattcttcataacgcaactgtcgacactctgctggagcgtcgttccatccgtaaattcaagccgaagccgctgccggacgacgtcgtcgaaacgttggagaccgtagcgcagcatgcggcgagcagccagttcctgaacgactggtccgctatccgcgtcaccgagccagccgccaagaagcgtcttgccgaaatcggcgggcagccgtatatcgcgaccgcgccgctgctgtacgtgttcgtgctggacgagcatcgcaatgccgcgatcgccgcgcgcaagggcgtggaagtggcgtccgacgcgttcacgctcaatggcagctatcgtttcacgcaggcgcagaacgacgcggttctggcactgcatgcgatggagacggccgcgtactcgctcggcttgggttgcgtgattctcggctcgctgctcaacgatgttcccgcgctgatcgacctgctgaatctgcccgaatacacgtacccggtgctgggcattgcaatcggcaagcccgatcaggagccggccgtcaagccgcgtatgccgcgttccatgcagttcttcgagaacgagtatccaagtagcgatgagaagctgctgtccggcttggattcgttcgacgccgaagtgcacaagtattacgatttgcgcgatactgaacggccggtggacgcgttcagcgaccagattgcggcaaatgcgatcgacgagggcgtgaacgccaaggccgttgccgtgcaggcgaagcgacagggcttccgtttggagcggtagatacatggcagcgctcgtatcattgatacgaagctgatacaacacaaggcccggtggattgcaatgaatccgccgggccttggttttatatgttgccttgttctcggtattgtcctgttatgccctgctattgctctgctattaccttctgcggggcttgtagcccttcttgcgggaatgtggcttgagctgctggttaagcggaacatgcatgtagctggattgtggatcgcgatgcgtgagatgccaagtaccgcagaaatcgcaacggtatacccaaagctcagtgccgcgttcgcgccaactctggtcggcggcctgctgagccgttgccttgtcgtgatacatgatcttgttcgactcggtgcaacgtttgggtacgaagtaatgcatagttgcccagtctataaacccattacgataaaacgcttgcgccctacttgtgttcagggataaaaaatggggtttccggagcgtaagctcgacgggaaccccggaaacgaaaaggggcctcccgggagccaaaggctcgaccgggaggcccaacatgtgaagcggcggcgtgctactctcccacaccctctcgagtgcagtaccatcgccgcgcctggccttagctaccgggttcggaatgggaccgggcgtctcaccagggctatgaccaccgcaaaaccgcgatcacggaacgacaaccaaaacatggcggccattccggccattatgttatgaaccgtggcggtctgggaaccggctagcggacgcgaggcaaagcctaccgttgtatcgttcagtgaccatcccaacgcatattgccgtccaggacgatccagcacaggaaagacgcggaaccaatcccgcaaaaggatcggaatgttatgtcgccgtcgcccgttagtaccggtcggctccacccctcacggggcttccacctccggcctatcaaacacgtgttcaacatgcgggctacaacagttcaagaccgtacggaatcctaatcttggagcaggcttcccgcttagatgctttcagcggttatccctcccgaacgtagccaaccggccgtgccgctggcgcgacaaccggcataccagaggttcgtccacccaggtcctctcgtactatgggcaggcctcctcaggattccaacgagcgcagaggatagagaccaaactgtctcacgacgttctgaacccagctcgcgtgccgctttaatcggcgaacagccgaacccttgggacctgctccagccccaggatgcgacgagccgacatcgaggtgccaaaccatcccgtcgatatggactcttgggaatgatcagcctgttatccccggggtaccttttatccgttgagcgatgccgcgcccgtgcgccggcaccggatcactatctccgactttcgtccctgctcggaccgtcgtcctcgcagtcaagcccgcttgtgcgattacactcgacacccgattgccaaccgggctgagcggacctttgagcgcctccgttactctttgggaggcaaccgccccagttgaactacccgccaggcactgtccctgacaaggatgacttgtcgaggttagacgtcaaacgagaacagagcggtatttcaccttgcggctccacgaatgctggcgcacccgcttcgaagcctcccgcctatgctacacaatccgcgcctaacgccaataccaaggtatagtaaaggtcccggggtcttttcgtccttctgcgcttaacgagcatctttactcgtactgcaatttcgccgagctcctggtcgagacagtggggaagtcgttacgccattcgtgcaggtcggaacttacccgacaaggaatttcgctaccttaggatggttatagttaccaccgccgtttaccggggcttgaattcaccgcttcgtccccgaagggattgacggatcctcttaaccttccggcaccgggcaggcgtcagtgcatatacagcggctttcgccttcgcatgcacctgtgtttttggtaaacagtcgctaccccctggtctgtgccacccaccaaagctccggacgcaaggtccttcaccccagtgggtctcccttataccgaaggcacgggagtgatttgccgagttccttgaccaggattcgctcgatcgccttggtattctctacctgaccaccagtgtcggtttggggtacgggcggccatggccctcacgccgaggcttttctcgacggcctggacaaccggatatcgaaccataacggctcccatcatcacacctcgccatgcacgccatgcggatttgcctacatgactggctgcgtgcttgaccacggaaaaccacctccgcggccggctcccattccgtgtcacccctgcgctgacctactgcggctacgctcccaacaccacgcggcgataccaacccgaaggaaggaaccaccacgaggcggaggttagtactcaccgtctcggttttgccggtccatggtcggtacgggaatatccacccgttcatccattcgactacgcctgtcggcctcgccttaggacccgactcacccggggacgacgaacgtggccccggaacccttggtcatccagcggacgggatcctcacccgtctctcgctactcatgtctgcattctcactcccacgaagtccacggccggtttccaccgccgcttcgcccctcgcaggacgctctcctacccagcaaccatgaagattgctgccgcgtcttcggtggtgtgcttgagccccgctacattgtcggcgcggaaccactagaccagtgagctgttacgcactctttcaaggatggctgcttctgagccaacctcctggctgtctatgcgactccacatcctttcccacttagcacacgcttcgggaccttagacgacggtctgggctgtctccctctcgacgacggagcttatcccccgccgactcactgccggaatacacgtcaacggtattcggagttcggctgctgttggtacccaacaagggcccgcaagcatccggtagctctacccccgcgacgcaatcgaccgacgctgcacctaaatgcatttcggagagaaccagctatcacggaatttgattggcctttcacccctagccccaggtcatccccccggttttcaacccaggtgggttcggtcctccacgcggtcttacccgcgcttcaacctgcccagggctagatcatcccgcttcgggtccaggacaagcgactgaaaacgccctattcggactcgctttcgctacgcatacgccacacggcttatgctcgccacccgccactgactcgcagactcatttttcgataggcacgccgtcaccccaccagggaggctccgacggtttgtgggcgcacggtttcaggaactgtttcactcccctcccggggtgcttttcacctttccctcacggtactggtacgctatcggtcagacaggtatgcttagacttacccaacggtctgggctgattcacgcgggattccacgaggcccgcgctacttgggacaacacgatcggaagacggctcacgtccaggtacggggctggcaccctctacggccaggccttcaagcctgttcccctggcaagccgttttatgactcccgcccggcccgtcggaaccgggacacgtgatcccacaacaccggcaacgcaacccccgacgggtatcacgcgcaaccggtttggtctgatccgctttcgctcgccactactcacggagtatcccttcctgcaggtactgagatgtttcacttccctgcgtaccccccgcccataggcggtgccggcccatgacggccggcgggttcccccattcggagaccctaggatcaaagccatgttggaggctcccctaggattatcgcatcctcaaacgtccttcatcggtactgtctgccaaggcatccaccatacgccctcgcaagcggcacaacagcaaaaccatcgtcccacccgcgggtttcctgatagcaagatcgccagacgacaaatcttaacactaaaatgatcacaaaacgatcgatctcgaaaccaaactcaattgaagagtttggcgaaatcgcgataagcaaaaagaaacgttctttcagtttctcttgctcgcgtccactatccagttctcaaaccaccacgcgccacacgatccgaccagccacccaggaccggccaccacgcatgggcatcgaaccgcgccacagaaaacccgtggggtggcggtccgggagcccaaaagcatacccataccactcccggacgggacgaatcccatccaagccattgatctcttccacaccagcatccacaacaacgacgccgactgccggcgcccatgtggctcacactgtccaaaaacatggactgtattctccgtagaaaggaggtgatccagccgcaccttccggtacggctaccttgttacgacttagtcccaatcacgagtctcaccttagacggctcccccaaaaaggttgggccaccggcttcgggtgctacccactttcatgacttgacgggcggtgtgtacaaggcccgggaacgcattcaccgcggcgttgctgatccgcgattactagcgactccgccttcatggagtcgggttgcagactccaatccgaactgagaccggttttaagggatccgctccccctcacgaggtcgcatcccgttgtaccggccattgtagcatgcgtgaagccctggacgtaaggggcatgatgatctgacgtcatccccaccttcctccgagttgaccccggcggtcccccgtgagttcccaccacgacgtgctggcaacacagggcgagggttgcgctcgttgcgggacttaacccaacatctcacgacacgagctgacgacgaccatgcaccacctgtgaacccgccccgaagggaggccccatctctggggctgtcgggaacatgtcaagcccaggtaaggttcttcgcgttgcatcgaattaatccgcatgctccgccgcttgtgcgggcccccgtcaatttctttgagttttagccttgcggccgtactccccaggcgggatgcttaacgcgttggctccgacacggagaccgtggaatggtccccacatccagcatccaccgtttacggcgtggactaccagggtatctaatcctgttcgctccccacgctttcgctcctcagcgtcagtgacggcccagagacctgccttcgccattggtgttcttcccgatatctacacattccaccgttacaccgggaattccagtctcccctaccgcactcaagcccgcccgtacccggcgcggatccaccgttaagcgatggactttcacaccggacgcgacgaaccgcctacgagccctttacgcccaataattccggataacgcttgcaccctacgtattaccgcggctgctggcacgtagttagccggtgcttattcgaaaggtacactcaccccgaagggcttgctcccagtcaaaagcggtttacaacccgaaggccgtcatcccgcacgcggcgtcgctgcatcaggcttgcgcccattgtgcaatattccccactgctgcctcccgtaggagtctgggccgtatctcagtcccaatgtggccggtcgccctctcaggccggctacccgtcgaagccatggtgggccgttaccccgccatcaagctgataggacgcgaccccatcccataccgatagaatctttcccagaaggacatgcatccaactggagcatccggcattaccacccgtttccaggagctattccggtgtatggggcaggtcggtcacgcattactcacccgttcgccactctcacggccggagcaagctccagccgatcccgttcgacttgcatgtgttaagcacgccgccagcgttcatcctgagccagaatcgaaccctccacaaaaaaacttatgcggaaagccaacacgtgactctcatctaagaaaattgacgatcgccttataaggaaaggcgcatcgcacaaaaacctcaccgtccttcaaggcctcccggccactcgcaaggagcggacgatgaactggcaatcattgactataaagaagtagtacaaatacgctcttgagttctcaaaccaccaccactcacccacctcatgtcccggactcgtccgggccactcgctgagcggcagcaagggattaacttacacgaacccgtccacttgcgcaaatcggcattccgcaaaccccgtaaaaacccttgcggcgcaacgcattcatcggcgtgtcgaaaaccgcctatcgcacgccgcatcatcgcagaaatacttcagacaagcctcaaaacggcctgaaattcatcagaaaaacctgtctacgggcgtgtcgtgagcctgcaacggtttccaaatacggtcggaaagccgaaaaagacgcatacggaggaaaccgcgcggtggtatgtatggaggtatgagcaaaaaaatcgcagtattgacgggcgcaggcatctccacgtccgcaggcatccctgacttccgcggcccggacggcgtctggaccaaacatcccgaacaaatgaacgtgtacgacatcgacgcgttcctagccaataaggaagaccgcgagtattcctggcgctggcaaaaggaatcgccagtatggaacgcgcagccgggcaccgcacacaaagcgctcgtcaagctggaacaggcagggctgctgacgctgctcgccacgcagaatttcgacgcgctgcacgagaaggcgggcaatagcagcaacgtcatcgtcaatctgcacgggaccatcggcacctcgcactgcatgaagtgccacgcgaaatacgacaccgccgaaatcatggcgaatctcgacaacgagccggatccgcactgtcatcgcaagctgccgtacagcggcaatatgccgtgcgacgggctcatcaaaaccgacgtcgtctactttggcgaggcgctgccggatggtgcgatcgaaaaatcgtaccgtctggcggcgcaggccgacgaattgtgggtgatcggctccacgctggaagtgatgccggcggcgagcattgtgccggtcgcggcacaggcgggcgtgccgatcaccatcatgaacatgggacgcacgcaatacgatcgcttggccacacggcttatccgcgacgatattgcgaccgcgctgccgcagttggttgatgagacgatcgctgaagaacagggcaaataacaccgaatgaacaagcaaggctcctcaacctgattgggtttgaggagccttctttgatgcggaagatatgcgagaatccgcgcttatccaccgtgggaaatcagtagatgcgcttgggctggaaaccggccgcgcgcatcgcgtcaaggatgcggtcgatgtgctcaggaccgttggtctcaacggtgacgcccaaggaaaccgaatcagtgtaatggctggaagccttgaactggtcgtgatcgagtgcgatgacgttggcgcgctgctcggccagaatcgtggccaccttgaccagctggccaggggtatccggaagctcaacctcgaagttcatgatgcggccacgggcaatcatgcccttctgaatcaccgcgctgatggagacagtatcctcattgccaccggaaagaatcggcaccaccacatgcgggcccttcgcctcggcgaacttgcgcgagcgcagattcaggtgctcgagcgcggccagagacacggcaccggcagcctcgaccaccagcttgtgcttctccagcatgagcaggatcatctcgttgatgtcgcgctcggtgacggtgaccagatcgtcgaggaactcgttgagcagcgcgaaggtcaggtcgcccggacgcttcacggcaacgccttcggcggaggtacgcacctggtcggctgcgacgacgcgaccggcggccaacgaattcttccatgccgggctgccttccggaatggcgccgatcacacgcacctcaggcttgaacgtcttgatggcgagcgccacgcccgcgcccagaccgccgccgcccaagggcacgaccacgtcggtgacgttcggcacgtcttcgaggatctcgagaccgatggtgccttggccgcacagcacctcataatcatcgaacgggggcacgtagatcatgccttcgttgtcgctcagttcctgcgcgtgcgctgcggattcgtcgaacacctcgccgcacagcaccacgtccgcgccgtacgctttggtggcatccaccttcagcggcggagtgatctgcggcatgcagatggtggccttcgcgccacgttcacgggccgcgtacgccacaccctgcgcatggttgcctgcggaagcggtgacgatgccgtgagcgagctgctcgtcggtcagcgatgcaatcttgttgtacgcgccacgaatcttgaacgatccggtgacctggagattctcgggcttgagcagaatctcatgtccggtcatttcggacagcacaggcgacggaataatctccgtgtggcgtgcggtgcccttcagtcgttcggcggccagtttcaattcagcggcatgatcgcgccgcaatgctttgagcacctcgttttgttccatggacgttattgtaagcgcacgtctgccgaagccgacgcgtggtatcggcatgtgggtgccgggcagacgggcggcttggcggaacgggaggagcatcgcaagaaggtagtaaaaatgcccgagtggttccgtgatgagccactcgggcatttctgcagagagttatagggaaagatcgatcagagctgaatcacgactccctcccagcgagcgagctcgccacgagcgatcgatttaacactatgcatagcatcataggtgctgagcagtacttgcggatcggacacgccgtcggaaagcagctccgccacgtccgaaggcagcgccgcggacctgtcggtgaggttgaccacgacaagaatcgtgtcgtcgccattggtgcgcgtgaaagcatacacctgatcgctgtcggcggcgagcagatgccattcgccagtggagatggtggcgctgttgtgccgcatggcgatgagcttcttgtagaacgtgtacacggaatccggatcgtcgaattcctcggccgcgttgatttccacatgattcgggttgacgctgatccacggttcggctgccgcgtccgccggggtgaaaccggcatacttggaggcgtcccactgcatgggggtgcgcgcgttgtcgcggccgatgagggcgagggcggccatcatggattcggacgactggcacttggcttcctccacgcgctggcgatagccgttgagggcttccagatcgcggtattgttccagcttggtgaagtgggcgttggtcatacccagttcctcgccttcgtaaatgtacggggtgccgcggtgcatgtgcagcaccatgccgaacgccttggcgctcagttcgcgcgaatcgcggtcggagtcgttgccccaacgggagaccacgcgcggctggtcatgattgcagaagaacaggctggcccaaccggccttcctcacggcctcctgctgctcggtcatacggtcgcgcaggtttttgacctcgaacggcacggtattccacttggagccttcctggtcgatgccgacatggtcaaacaggaatagcatgtcaagttccttgttggccggatcggtgacgtgctcgttacgggccggggtgatgcccggagcctcgccgacattcatgtagccttcacggccttcgaatacctcacggcgcatttcggcgaggaactcgtcgatgcgcgggccgtcggagcagaacggatacgggctggaataaccttcctctccaaccggattatcggcgatttcggatcctgcctcccccggcaacttgccgttcttgtcgatgaccttggaaatctgggtgatcacgtccatgcggaagccgtcgatgccgcgatccatccaccagttcatcatcttgtagacggccttgcgcacctcgggattctcccagttgaggtcgggctgcttcttggaatactggtgaaagaagtattcaccgcgcttcggatcgtactcccatgcggagccgccgaaataggagccccactggttcggctcggcaccgggcgtgcccggctcatggcccggcttggccggacgccaccaataccaatccgcatgaggatcgttcttgtcgcgggaagcctggaaccaggcatgctcgtcggacgtgtggttcacgaccaggtccatgatgaccttcaggccgcgcttgtgcgcttcggcaagcagctcgtccatatcggccattgtgccgaacagcggatcgatgtcctggtagtcggagatgtcgtagccgttgtcgtcctgcggggacttgaagaccggggacagccatagcacgtccacgccgagatctgcgagatagtcgagccggctggtgatgcccttcagatcgccgatgccatcgccattggaatcctggaaggaacggggatagatctggtagaccaccgcgttcgcccaccacggattcggggtggcgccattcgaacggacggtgtcagaaagagtggaacgattgaaattcgtcatcgcgattgagctcctttgcctaagtggaatggatgaactttgctatatcccatggtacgtaaagcgttttttctttcttgcctgcggcgcgttttgcaaagcaggaaatgaaagatatattgcaagcgggatgcgcccttcggaatcacatcaatgcatacgaaaagcgggaatcctcgaaaaaggggaaacgaggattcccgctcggcgctgtgaagttttacttcacaagcagacggcctacggccgcgttgttcctgccttcgctcgcctatcggctcgctcaggaggaacctatgaacagtccacaggactgttcacttcacggctcctctcatcacaccaccgacgacccacttttgggcgaagacgtagacgataagcaccggggccatggccatcaggtaggaggcgaaggccatcggatagttcgacgtgaactggctctggaacacgtactgcgccagcggaatcgtctgattgctctggtcggtcagcgtgatcaacggcagcaggaagtcgttccatgcccacagtgcggtcaggatggcgatcgtggcgttgatcggtcccatcagcgggaaaataatcgtccagaagatacgccaggtcgaagcgccgtcgatgcgcgccgcctcttccaacgaaatcggaatcgaacggatgaagccgatcgcgatgaacaggttcgtgccgatgccgagaatcgtgtacagaatgatcagaccgagctggttgtccaggtgcagggtgcccatttccttggcgatcggcagcatgacgacggtgaacggcacgaacatcatggccaggaagaagtagtacaggaagcggaagaaccgcttatccatgttccttgccacggcgtacgcgacgaacgtgttcgtcagcagcgtcagcaccacagcgcacacggtgatgatcgcggaattgagcgcggccttcggatagttcaccttgttccacgcgtccgcgaaattatgccattcccacgtggtcggcaggctgaacgtgcccgcttcgcccggcgtcttcagcgcggtgacgacggcgaagtacagcggcacgagcaccgtcaggctcagcacggcgacggccgccgtcagccaccagttgatgctgtggtccttgcggatcttctccggcttcgcttgcgattgtccgctttgcgcggcggccggcttggttgcaacagttgcgctagtcatgatttcttccccttactctcagaccttttccttgccgctgaagaacttcagctgcacgaatgcgaggattgccagcacgatgaagaacgtgaccgcgttcgccatctggtaggagtattcgccgttgcccaggccgttctggaagatcaggtaggagacggtttcggtcttggaatccggaccgcccttggtcaatgccatgacctggtcgaacgcgccgagcgagttcttgaggctcagcaccatgttgatggtgaagaacgggccaatcagcgggaacgtgatctgccagaagttctgccaggcgttcacgccgtcgatggacgcggcctcatagatttcgttgtcgatggtctgcagacccgccaagtacagcagcgtggagtaggccacaccctgccagatggacaggaacacgatcgggaaccatgccagatccggattggagatcatggatgtggacagccaatcgatgtgcagcgcctggccgagggccggcagcggggtcatgaagatgtacttgaacacgtagccgatgaccagcaccgacagggtgtacggaatgaagaagatggctcggaagccgttcttgaaggcgattttggagttcagcagcaccgccaggaacatgccgaggatgttcgtgccgagcgtgatcagaatcgcgatgaaaatcgtgaacagatacgcgtggccgacgcgtgcgtcctggaacatcgcgatgtagttcttgaagccgatgaacttgtaatcgccgtaaccctgcgaattggtgaacgagtacatcgcgccctgcaggaacggcaggtacaggaagatgcacacgagaatcatcgcgggaatggtcatccagtagaacgccggatcgaccttgcgcttggagtatttcgaaaccttcttcggcttctttgcggcggccttgtcggccttggccgagatattgccagtcattgtcgttcctcccctcacctaaagttcctggcttcgatcttgtcgtattccgactgcatgctgttcaggaatcgtttagtattgcccgactgcaccaacgtctgcaggaaaccggcgaggttgatgcttgccggcacgtagtggtcacagaaatcagccagcttgccggccttgtagaagtcgagcacgccattcaacgcttcatcgccgacgtacgtatccttgtacggggtgaacgcagactgctgcttggagtaatcctgcacgttctcctcgctcatcaggaagtcgacgaattcgcgagcctcggtgtaatgcttcgtatgcgcgccgatcgtcagcatcacgtcgtcgccggcggtcagctgctgttccttgacgttgtcggtggccggcatctgcgcgaaccgcagattggcgtccttgttgatcagacggatctgcggaatcgcgtacgtgccgagcggcagaatcgcggccttgccggaagcgatgtcctgcgtagcctgctggtaggtgacggccggattcttctgcgtgtagttctggtaaatttcaatcagcttgccgctgacgggcgtccacaagtcggagaaggtcttgctgccgtccttgagatacgcgtattccgattccggcaccagcgtcgaattcagcgatgcaagcggcgcctgcaacgtccacggatcggcggtgctcgcctcaaccggcgtgacgcccttggccttgagccgcttgagcagcgcgatgaattcgctccacgtctgcggcggattgtccggatcctcgccggcctgcttccacacatcggcgttgatgatgtagccgcttgcgttgcccgcgtacggaataccgtacagacgcttcttggacttgtcggtggtctgcacgaggctcttcgcgatgttcaccatgcccggattgagctcgtcgacgatctcgtcgtcggtgaaatcgtggaagacgcccgcttcggcgagcatgccgtaattgatgtcgccgttgatggtgatgacgtcgggttcgcggttcttcaccagtcgcgtgcgcagatcggtggtggcgtccgacgaattgttgacattgactttgatgttggaatgggttttctcgaattcacgcgccttggcggtgaaccaatccgccgcctcggacttgaattggaagaaatccaaggtgaccgtgccggcggtgctgttgccgcagcccgcgagcccaaccgtcagcacaatcgcgcatgcagccgtaatagcacggcccgcgatccgcctgaaggtgcctgtgttggcattggaatcaggtttcattctctcgactcctttgtattttcctttttcacggcaggccggcttcattaccagcctccgttgctttttaattgtagaatcggcttgttttcattcccagtttccgcgcgcccgcatcgaacggaaataaaaaacggttattttgttattcttggaaagtaaataggcgataaggacggtacgatatggcgatttccccgattccacactggtttgaaggctcggagtacacgcataaggttgcggcctgcattatgaagtacggtccgatttcgcgcatcacgctggcacagatccttggcctttcgcaaggcgcggtatcgcgcatcaccagtgatttgatttacgctggcgtgatcgaagagacgccaatggcagcggggcatggcggcaagttaccgaaagatttcttgcggaaatcggcacaaaagtcaatccagaaagaaaatacggaacgtcgcggccgtccgcagaccggactgcgcatcatcgccaatgcgcgcacgttcgtcggcatgaaaatcaacaccacccatatcactgccgtaacagtaaacgcgcttgggcagatcgtgaccggctgccatgacctgccgctcgacgacgattcgccggaatcggtggtcgacgtcatcaaacagctgaccatggactgcgccgacgaggcgataatggcgggattgccttcgccatgcgcggtcggcgtctcgttgggcggacacatcgtggatgattcgatggtgacgttcgcgccgttcctgcattggtcgaagcccgtggagttttcggcgttgatccaggaggcgaccggcctgccgaccggcatctacaacgacatcgactcattggtggtggacgcgtgcatgttcggctcgggcgtcggattgaacagtttcgccgtggtgacgatcggcatcggcgtgggatattcgctcaccgtcaacggcgagccgatcgacaatcccgacaaaagctatggcctggtcgggcatattctggtcgaccccgacgggccgcgctgcatttccggacataaaggttgcgcgacgtgcctaactgacaattcaatcgcaacagaatattcggaaatgatcggacatccggcgacgttcgacgaattcgcggccgcagcgcgcgccagcaaaacgcaggccacgaatctggtgaaccgcacctgtttccgtttgggtacattgatcgcgaccatcgccaatcttgccatgcccgacaaaatcatgatcgctggcgaatcgtcgttcattgcgaaactcggcatagacaacctgcgtaacggcatcaatatgtatcggcatagtcaagccgcgccggtcgatttcgaaatcgccgagcacgactggtcgctgtggagcaaagcggccgcagcgcaagccattcgccagtatgtagggtaagtcgttcggaatcgctgtcgcagtgtgaggccggtacgcgaaagtaccagcctcaccatacaaaacagatactcagatgcggactactttgaaaaggacggcctgcgcaggatgcagcgccggcggacggatgccataggcggcgagcgcacggccggtcatcttcacaccatcggcggtccaccagccgagcgggctttgtccgttgccgatgtcctgcttggccaggtcgaggctcacgtcgagcggggacaccacgtacacggcgtccgggtcgaggccaggcagacgtacgggggcggacggataggtctgcgacgtggtcagctgcgtgaagcggtagatcgcggcagccttgttcggcatgacgcagccgtccacgcgcacggccggatcggcggcgtcagaatgcaccgcggtgtcgacggcgaaccattcgcgatgctttttgaattcggccgtccattcggcgagcttgtcgatgtcctcctgcggttccttgagcagattccattcgatgcccatgtggccgaagaaggccatggccatgcgcatctcctgggaggtggcgcggtgcgtggaatgcgccggggaagcgcccacgtgctctccgatcatctccggcggcacgagcagcgacgtgtagcgctggatgtcggcgcgttccaccgggtcgacgcagtcggaaccccagatacgatcggcgacttcgaggataccgaggtcgacgcggccgccgccggacgagcagctttcgatttccagaccgggatgggccgctttcaggtcggtgaagatccgatacacggcgagcgtctggttgtgcacggcgggacgtccggtgcgcggcgacaccgcttcggtgacgtatttgttgtgatcccatttgatgtagtcgatgccgagttcgccgacgagcttgtccatggcgccgtagatgtacgcgtacgcgtcaggattggtgagatcgacgacctgctgagtgcgcccctgcatcggcagacggttggcggtgggcttcagcacccagtccgggtgggcgcggaacatatcggagtccgggttgaccatttccggttcgaaccacaggccgaactccatgcctttgccgtgcacgtagtcggcgagcgccttgagggacttgtccccatcgggccaaacgtcctgtgagatctgccaatcgcccagaccggcggtgtcgtctcggcgggcaccgaaccagccatcatccacgacgaagcgttccacgccgctttccacggccttgtctgcgagcgcggtcagggtgtcgtaatcgtggttgaagtagacggcttcccatgtgttgaggatgaccggacgcggcttgggcgcgatgccatggtccacgagccagtcgcggtgcacgcggcggatgtaaccatggaagcgtgaggcgacttcgttgagcccctcgccgtaagagccgacgagccatggcgtggtgtagctttcaccgtgttccagaccgacttcgccgccgaagagcacttcgctgccaccgatcacgccagtggtgtagggcagtcgttccgcggacagcacgctgttgccgctccatgccacgtgcgcggagtagacgttgccgtgggtgaaaccgaagccgtgttcgccaacgctgagcagcagggtggcgtcgaagtcggggcggccgatcatggaggatttggcgaagcgcccgatggtgaagtcctggcgctgtggggaacgctcacgcagatggtgaccggtggtggtgaggatctcgttggcgtcggcgggcacgctgaatgcaagttcgatcttgccgatctcgagtcgtccctcgccggtgttcgtcacctccgcatgctggcggatgaggccggtttcatcgagctcacaggtccacgtaagtttcacgcattgttccacgtcctcggcagtgacggtgacggtaggcgtctgcttgggctcggaggccacgctccagctggggtagccgtctttttcggccatggtgtaggttttgccggcggccacggtttcggctttgatgtcggtgacctggaacttgcagaacagttccacgccgtcacggcgcacgtcgaaacggtcagagccggaccacgcttcggactgtgtcggcagcacgctcggccatgcggtgtagtcgagggctccggaaacacgctgcggagcgagcgcgtcgaacgtgttgatcacggtttccggtgcggtgagcgggcgaccccaatgcacgaatctcggcaaatcgctgccggggaacaccagagcaaaagctgcggcggcagccggctgctcggcatacacggcggtaaggggtgtgccgttggaagcggtgccgtggaaagtctgaatgagcgtcattgcagcatccttttcttgcgattcttggttggtatgacgctttgatgatactgcataccgcttttcttcccatcgccctgcgtgtttgtttctttcggaaagtaattagcgtcggcgcgcgaagaaatcggtcatcaatcgcccgcattctgcttcgcgcacaccgccaatcacttccggtacaagtccgacgtgcggatcgcggggaatatcccataccgaaccgcatgcacccaacttggcatcccacgcaccgaacacaatacgtccgatatgcgtctgcaggcaggcaccggcgcacatagggcacggctccaacgtaacgacaagcgtgcaatcagcgagattccaagtgtcaagcgaggcggccgcttcagccatcgccttgacttcggcgtgggcaagcggatcggcatgcgtctcacgcaggttccgcccgcggccaatcactcggccgtcagcggcaagcacgacggcaccgaccggcacctcgccatccgcggcggcttcgcgggccagcgcgaccgccagttccatatcatcgtcccatcgcatacgccacagtgtagcggcggccatacgaccgctccgcacgactggtccgcacgtccgacctgcatgcccgacctgcgcgcccaaccgaagcggcacgaacgtcagcccatagcgaaacacgctcataaccgcctcttggtaggctggaaaaggttggaaatacgcgcaaaggaggcacgttggcggtattcgagttgattctatgcatcatcgctgccgtcgtactgtcctcgttcctgagccgattcatacccaaggtctccacgccgctcgtgcagatcgcgttgggcgcgctggcatcacaactgccgttctttccggacgtaacgctcagccctgaactgttcatggtgttgttcatcgcgccgctgctgtatttggaagcgcacgaaatcgataaatcggaactgctcaaatcggtgaaactgtcgttgtcattggcgatcggtttggcaatcgcgacgatggtggcggttggtttcgcgttgcatgccgtatggccggcgattccgcttgcagcggctttggcgctcggtgccgcgcttgggccgacggatgcggtcgcagtgtcgtcgctcggcaaggaagcggcgctgacgcaacggcagacgagcgtgctgaaaggcgaatcgctgttcaacgacgcgtccggcatcgtcggcttccagttcgccatcgcggcggccgtcagcggtgtattcgaagtgggcgaatcggccatgcaattcgtggcgtccttcttcggcggcgcattcttcggcatcgtcgtgggcatggtggctgacgtggtgttcgaaacgatgcgttccctcggctgggaaacaatgaccacacgtattctgatggagctgttcctgccgttcatcctgtatttgggcgcggaagcggtgcacgtttccggcattctttcggtggtggccgccggcctgatcatccgtttcgaccgcaccggcatcggcccgaacgtggcgcgcacgaacatcgtctcgtccagcgtatggggagtgctgtcgttttcgctgaacggcaccgtattcattctgctgggcatgctgttgccgaccgcgatgaccgccagctgggacgatccacgcgtcagcaattggctgcttttgattgcgattctgaccgtttcggccgtggtgatcgccatgcgtttcctatggatttcgctgatgctgcgattggcgcgcgacaccaccaccggcaagcgacgcaagatgacggcgaagcgctggcgatcggcggccgtcatgacgttcggcgggccgaagggcaccatcacactgtcgctgatgttcacgattccgtacacaatcgcggcgggcgcgaatttcccgatgcgcaacgaactgatcttcatcgccggcggtgtgatcgtgatgacgctgctgctggcgaatttcctgctgccgctgctcgcgccgaatcgcaataaggacacgtccacggaaatgacggaaatcaccatcgaagtgctgcggcggaccgtcgaggagctgacgggacgcgtcacgcccgacaaccgacgtgcggtgctcatggtcatcgactcgtatacgaaacgcatcacgcgactgaagcaacgcaccggcgaaatcgatccgcaggggtatatgaggctgcagatcgacgcgctgaattgggagaaggaatacgtcaagaaccgtctggcgggcgtgcgtgcggccatcaaagcgaatccgaccgagaaccgcgccgcgaacgacctggaggccgaggcctgcgagcgcctgctcgaccagatcatgagctcgctgcgccacatcgagacggagcacaattccggacgcacgatctggcgtctcaagggacgtctccgcgcgttgcagaggcgtacgggcacgctggtgcgccgcgtgaacagccgcatccgccgcaccaccccgctgttctccgacgacgaactgttcgcgcatacgcgcgtggtgcaggtggacgccatcgagtatgtgatcgaccgactgtatgaggagatgggcggcgacacgtacaacaccgagcactgctccggcctactgttggactaccgacgcagcgaatccgcgttgagggcgcgtccgaatatgggcatcagcgccgaagcgcaggaacaggccgaggaggtcaagcgcgaaagctacggcatcgagctgggcgtgatccaggacatgtatgaggccggcgacatcacgcgtgcgcaaagcaagcagctgcgacgcaacgtgtatgtgatgagcgtggatgcggacgcgcagatctgacgttttttcgatttccggcgttcggatcgcgtggcgacggacgattgcgcaatggcggacgatcggctggaatcgcatccagccgaaatcgtgttcgtcgggaactgtgccaaattgcgcctgaacgaaatcgccatcggattctcaggaagttttcagaaaacaccagacatgcgctcagcatcaggtgtttatatatgaattgtcagcagaaacaagccgaccaggaaccttgaagttcccgacaattgaaccctttcttcttctctctcctttctctccccggcggccaatcccgccggggtcttcttttttcgccgcttgcttcgcctccctttcccagcttgtttcacggcttgtttcacgtcccttttcacggatcttttcgcactgcgagcgtacgccacaatcgcacgctatattggaaatcatgagcgacgcaatcgaaaacacaacaggcagcgcagacagcaatgataagaccaagctgatcggccgcgaatcggacgtggtgccgggacgtttcggtgaaccgctgcaaatcacgcatgtgcagtattcgcacggcggcggcaacaccgcgccgaaacgaccgttgttcctgtgcctgcacggctgggggtcgaacgagacggacttggccgacatgatgcgctacgtcgcgccatacaacgattttgcctcgttgcgcgcgccgctgacgttgcagccggctggccgctttgcacccggcgcgtactcgtggctgcatgattgtgtggataccggcgaggatttggaccgtgacgcattcgccgcagcgaaagcaatcgacgattgggtttcggcgaacattcccgacgaccgtgccgtggtgccgatcggtttttcgcagggcggtctgctggcgattcacttgctgcgcgtgcacccggaacgctacgcggcgacgatttcgttgtccggttttcttgcgcccggcactgttgcgggaaccgcgccggcggacgatcgcgtggctgaactcaacattccgacgttcttcggctatggcaagaacgataccgtgattcccatgccggaactgttcgcgaccgccgcgtggctggacgagcacacgttccttacggaaaaaagctatcgtgggctcgaccattccgtaagtatggaggagttcagcgatttgcgcgattggcttgccgcgcacaacatcgcgccgggaatcctgtaaatccggaccagttagaacaatcgcctcagtcggatcagtcggtgatgtcggccttgtagaagttcacgtaggaacggctcggggtcgggccgcgctggccctgatagtgcgatccggtggtggcggagccgtatggatgctcggccggcgagctcagctggaagaagcacatctggccgatcttcatgcccggccacagcttcaccggcagtgtcgacacgttggacaattccagcgtgatatgaccttcaaagccagggtcgatgaagcccgcggtggagtgggtaaggatgccgagacgaccgagcgagcttttgccttcaagacgagccgcgatggatgcatcgagcttcacatactcccatgtggacccgagcgcgaactcgcccgggtgcaggatccacggttcgtccggtttgacttcgaactgttcggtcagctcgccctgattctcagccggatccacgtacgtgtacgcatgattgttaaacaaacggaagaaacggtccaatcgcacgtcaatcgatgccggctgcaccatctccggggtccacggatcgagtgagatatgaccgtcggcctgtgcggcgagaatgtcgcgatcggacagcagcatcgaaattcctccaaacatcaccggaacaatcgtcatatgagcgggcgcgcagccaacgcgcgcccaccaactgtcgtccagtctagcccgtcgacgctataagccagcatcaccgccgatgcatcgcacgtagcacgcacttgcgcagctcggaggcgacgagcacaatcatcgccaggccgaggcattcgacccacgcacccgcggacagcggcacggtaccgaacgcggtgttgaggaacggcacgtagaccaccgcaagctgcagcagcgtggacagtgcgatcgcaccccacagccacttgttggcgaacagccccacgaacaccgactggtcatgcgagcgcgagcacaacgcgttaagcatctgcgcgaagaccaggatggtgaagcccatcgtgcgcgcttccgtcatctgcgcgtcatgtccgatggcatccacggaacggtccgtgaacagacctccggcgaggtgcatgtccatgccgatcagcgtgacggcggccatgatgatgccgatgaagatgatgtcgccccacatctgcccgtcgatcacgcggtcggtgagtttgcgcggcttgcgggccatcacgtcgtcggtggagggatcgacgcccatcgccaaggccggtgccgcgtcggtgagcaggttgatccacagcagctgcgtggcgagcagcggcacggtcacgccttggctgcccggctgcgagatgccgaggaagccggccagcatcacaccgccgaaaaccgtgaagacctcgcccacgttggagctgagcaggtatcgcaggaatttacggatgttgtcgaaaatgccacggccttcgcgcaccgcttcgacgatggtactgaagttgtcgtcggcgaggatcatcttggcgctctgcttggtcacttcggtgccggtgatgcccatcgcgacgccgatatccgcggttttgacggcgggcgcgtcgttcacgccgtcgccggtcatggccacgatattgccttgccgttgcagcgattcgacgatcttcagcttgtgttccggcgcgacgcgcgcgtagacggagatgttgcgggtggcgttgtcgaatgcggcttcgtccggcagctcgtcgagttgggtgccggtaagcacggtgctgccgaggtccgcggcaccggtcgcgtcgatgatgcctaaatcgctggcgatgcgtgccgcggtcagcggatggtcgccggtgatcatgacagtacggatgccggcgcggtgcgcttcggcgacggaatcgcgcacttcggtgcgcggcggatcgatgatgcccaccatgccgacccagatcagatcgttttccagcacgtcgctctgctcggctatatcgaccacatggccggcggcgttgatcgccacacccggcacatcggcaagcgacgcggtgccgagcggacggtatgcctggccaagcgtgcggtacgcttcggcggacagacgttccacggctgcgagaatctgctggcgatcgccttgcgtcatcgggcggacggcaccgttgactgcgattcggctgcagtagccgagcagtacatcgggggcacccttggcgaagacggtgagacgcccggcatcggcgttgtcctgcgcgacgacggccatgcgtttgcggtcggaggtgaatggaatctcgcccacgcgcgtgtagttcgcgtacttacgatcggccttcaccttgcgtgcggcgacgataagcgacacctcagtcggatcgcccacggcctcccataacgtattggcagaggaagcggaatccgcgccgttccgcacggtttcgacggcggtctcgcgaagctcgccgtcgtttgcgatcgcgcccacggccagcgtggtgacggcctcggcctgcgccgcttcggcggctcccgtaattcccgcggcttccgccgcgtcaatcgcaatcattctgccttctggcgcatagccggtgccggtcagctgcacctcaccgctcggcgtgaccacgcgttccaccgtcatctcgttgcgggtgagcgtgccggttttgtcggagcagatcaccgacgcggaaccgagcgtttccacggaatgcagtttcttgacgatcgcatgatgttcggccatgcggcgcacgccgagcgcgagcacgactgtcagaatcgcggcgagcccttccggcacggccgcgacggccagcgaaacggatagcagcagcgaatcgattacgtcgtggatgtcgttgaagccttcggtcagcgcaagcgccaccagcacgaccgccgcgataatgcacaccgcgatgccgagaatcttggaaacgtagttcatttccttctgcagcggactgtcatcatcatccgtggcctgcagaaggtccgcgattttaccgacctgcgtgcgcatgccagtgctcgtcacgattgcgcggccggtgccttgcgtcacggacgtgccgttgaacaccatattggcgcgatcacccaaggccttggcttcggcaagtgtgtcgacgtttttgccgaccggtacgctttcaccggtcaggctcgcttccgccacgcgcaggctggcggcggcgagcagacgtccgtcggcgggaatggagtcgccttcaccgagcacgaccatgtctcccggcaccacgtcgacggtgttgatgcgtgcgattttgccgtcgcgcagcacgttggtttgcggcgcggtcatttgggagagcgcttcgacggcttcttccgctttcgattcctgaatgtagccgagtaccgcgttgacgataaggataagcacaatgacgatggcgtcgaacggcagtatttcgccgccttccgcgcctggcgcagcgttggctttttcgatgaaccatgcgatgagcgagatgccggtggcagcgagcagcaggtagacgagggggtctttgaactgcgccaggaacttcttccattttggcacgggtggtgcggatgcgagctcgttcggcccgtattgcgcgagtcggcgttcagcttcggcttggctcagaccggtgttcggatcgacgccgagcgatgcggccacggcttgcgcgtcggcaagcgacgggtcgatttgtggcggctgctggttttgctgatcctgccgaatctgcgtgcgatcgcccgtagcggaatcgccgtcaaaattggcatgggactggatggactgatctttcttgcgatcatccatggtgatctccttgggagcgccgcggagtagtcagctctcccccgtcttacgtatgcctcgaatcgcggaaatcgaaaatccgcggaatcgcaagcattttgcaaaggcgaggcaacgctgcgcggttgtgggcaccgggcggacgccatcggcgcatcctgttattatcgcacatcctcggcgtgtgaaaaatggacatgtggcggaacgatgcatggcacgcgacgggtgcacgataccatgaagtatgatatattatcggcagttagtaaaattcattactaaacggtcgtgcaacatcgcacggcgcaaccgcaacgatgcagtgacaccaagtaatacagggggatgcaagatggcagatacagccgaactcgcaatcgtacatgcaaccacggcaagtgcaagctggctcaccgatccgacggtgttcgcagcgaaccgcaagccggcacattccagccaccgatatgtcatcggcgagacgcgcgagccgaagcagagcctcgacggcgaatggaaggttcgtatcgaacaagcgcgcaacgtggacgtggaaagcgctccgttcgcggccgtcgatttcgaggatggcgatttcggcgcgatcgaggtgccgggccacttgcagatggccggctatctcaagaacaagtacgtcaacatccaatatccgtgggacggtcacgaggatccgcaggcgccaaatattccggaaaacaaccatgtggcgatctaccgccgtcgattcgcgctcgacgcgcagcttgcgcgcacgctggaaaacgacggcacggtcagcctcaccttccacggtgccgccaccgcgatctacgtatggcttgacggcacgttcgtgggttacggcgaggacggattcacgccgagcgaattcgatgtgacggaagcgctgcgaaacggcaatggcaacgccgccgattcccccgaagccgagcatacgctcaccgtcgcctgctacgaatattcgagcgcctcttggctggaagaccaggatttctggcgactgcacggcctgttccgcaccgtcgagctcgccgcccagccgcatacgcacgtcgaaaccgtgcagcttgaagccgactacaccgcagccgacaccgccggtacggccgacaccgccgaactcaacgcggcactcaccttgcgcaaccccgccgacgcgatgactatcgaaagcacgctgcgcgacggcgacggaaatgtcgtatgggaatcaacgcaggcctgcaacggcgaaatcgcccttaattccggcaaaatgacgaacatcgcaccgtggagcgcggaatcgccgacgctgtacacgctgaccgtacgcgtcgtcggacatgacggcgccatcatcgaaaccgtgacgcagaagatcggcttccgcacgttccgcatcgaaaacggcatcatgacgatcaacggcaagcgcatcgtgttcaagggcgcggaccgccacgaattcgatgcgaagcgcggccgcgcgatcacccgcgaggacatgctttccgacgtggtcttctgcaagcggcacaacatcaacgccatccgcacctcccactaccccaaccaggagtattggtacgacctgtgcgacgagtacggtctgtatctgatcgacgagacgaatatggagacgcacggcacgtgggtggcaaacaatgtcgagcgtcctgaagacggcatccccggcagccgccccgaatgggagggcgcgtgcgtggaccgcatcaacagcatgatgcgccgcgattacaaccatccgagcgtgctgatctggtcgcttggcaacgagtcgagcgcgggcgaggtttttcgtgcgatgtatcgccacgcgcacacgattgatccgaatcgtccggtacattacgagggttccgtgcacatgcgcgaattcgaggatgtgacggacatcgaaagccgtatgtacgcgcatgctgacgaaatcgaacgctatctgaacgacggcagcccggcacatacggacggtccaaagaagccgtacatttcctgcgaatacatgcacgcaatgggcaattcgtgcggcaatatggacgaatacacggcgttggaacgctacccgatgtaccagggcggtttcatttgggatttcatcgaccaggcaatcgagaccaagctgcccgacggcacgacacgcatgtgctacggcggcgatttcggcgatcgtccaagcgattacgaattctccggcgacggcctgctgttcgccgaccgcaccccctcgccgaaagcgcaggaagtcaagcagctgtatgcgaacgtgaaaattgcggtttcggtcgatgaagcgcgtattacgaacgacaatctgttcgtgtctacgggcgattatcgcttcgtgctgcggattttggccgacggcaagccggtatggtcgactacgcgccgtttcgacgtggccgccggcgagagcgcttcattcgaagtcgattggccggttgatgactaccgcagcaacgccgaagagctggttttggaggtatcgcagcagcttggcaacgcttgcgattgggcaccggccggctacgagctggcgttcggccagtgcgtggtggcaggtgcgaagaccactgcagatgccgttgacgcggccggagctccggccgacggcaccgtcacccttggccgctggaacgccggcgtgcgcggacagggtcgtgaagcactgttctcccgcacacaagggggtatggtttcatatacgttcggcgagcgcgaattcgtgctgcgccgcccgtcgatcaccacgttccgtccgctgacggacaacgatcgcggtgctggacacgctttcgaacgtgccgcgtgggcggtcgcaggaaagtatgcgcgttgcgtcgactgcgcgatcgcaaatcgtggagaaaatgccgtggaagccacgtatacgtacgaattggcgattccgcagcgcacgaaagtgacggtccgttacgttgccgacacggccggcctcgtttcgctcgacgtcgagtatccaggcgagaagaacggcgatctgccaacgattccggcgttcggtatcgaatgggcgctgccggtggaatatgcgaacctgcgattctacggcgccggtccggaagagacgtacgccgaccgcaggcacgcgaagctgggtgtatggagcacgacggctggcgatgattgcgcgccgtacctgctgccgcaggaaaccggcaatcatgaggatgtgcgttgggcggagatcacggacgattccggccacggtgtgcgcgtgaagcgcggtgccggcgcaaagccgttcgcgatgagcctactgccgtattcgagcacgatgctggaagaggcgctgcatcaggatgagctgccgaagccgcgtcacatgttcctgcgtctgctggccgcgcaaatgggcgtcggcggcgacgattcgtggatgtcgccggtgcatgagcagtaccagctgcccgccgaccagccgctcagcctcaacgttcagctcaagctgttctaagctaagccagcttcagcctcaagcataaccgccgattcgcggcataattccggccgacttgccaataggcaggccggccgattctgttgatggctgaaaacaggcagggtgcctaaaatgaaagcacgtctttgaagcaaacgacgcctcaaagcatgtttttctgaaggagggcatcatgagctatccaaatatgaatcccggcaatcccaatgaccccagtcaaccaccgcagccgggatacggcgcctatgcaccgagccagcaagcacagcaatcgcaacagcaggacggtccacaaagcggcggaccagatgccgagcagacccctcgctattccggcaatccatatggcaacccctacggcaatccgtatggatatccgtacggtaatccgtatggttacgacccgaatagccatagcaacgacagtggcgagtgggagccggtaagcccgttcaagttggtggaatcgtggctgccgcaacgcgcgaagaatgccattcgcggtgtgtatggcgtgctcggcgtgatggcgattgtgctcggcattgcgctactcatctggccgggggtgacgctgaagatcgccgcggttgcgttgggcgcgtatttcgtgatttccggggtgatccgtatcgtcaccgcaattgtggagctcggtctgccgggaggctggcgcgtgcttgacattctggtcggcctgttgctgacagtcggtggcgtggtcatgctgaagaatgcgaccctgtccggcgccatgctggcagtgctcgtcactatggtggtgggcctcggctggatgatggaaggcgtgatggcgctggttgagtcgtggcatatgccaagttccgcatgggctgtgatttacgcgctgatttcgattgtggccggctgcatcatgctgttcagcccgctggcctccaccggttggctgattctgtttggcggatgcgcgttggttgcacttggcattgtggcgatcgtccgcgcgttcacgtttggcaaggtcggcaagtccggcaagaagcgctaactacgcgtagttctcccgtataggcgataaacccatacgggagaacgcgacgtgccgtacgattgacatgattttatagtcgcgctatgctaagtgaaacgtttcgacgaaacgattcgataaatagcggatagaacggcacaagagggaggcgagacgcatggcaggcatcaaagacgtggcccgcgaagcgggagtttccgccagcaccgtctcctatgtactatccggcaagcgttcaatctctgcgaaaaccaccgacaaagtcatggccgccgtagagaagctcggttacactccggacgccagcgcccgtaagatgcgcggcatgcgcaaccagatcatcgcgttgagcgccccgattcgaggcgacatcaaccaggccaggtacaacgcctacttcctgcgcaccgcatgggccgcaaggaatgcagggtatgacgtgatgttgctgaccggtccggatgcagtgaaggatatccgccgcgtgacgcaaagcaatcttgcggatggcatcgtgctgctcgacgtagagcaggatgacgagcgcgccgctcaatccggcactttttccaagccgtgcgtggctatcggctatccgtcgtcgcacgccggctgcgcctgcgtggacatcgatttcgcgctgatgggccgcaaggccgtcgacttcctgtacgagaagggacaccgcaccatcgtgttcctgcgcaacaacgaatccgactacaaccgccattccggttacgtcgtcatcttccgcgaaagcctgctggcgcacgcgaaggagctcggcatgacggtcatcgaatccgaacattacgaagcggacagcttcgacgcgcagcacttcgtcagcaccgtcttcgcgcaccccgaccgcccgaccgccatcatcaaccaagcgaacgcaagcgtcctcagccaggtgctgatggcgttgcacaacgcgggcatgtcgattccgcaggacgtttcggtcctgtcgtgcggcacgtatttcgaaggcgagccgacgcgcttccccatcaccgaaatgccggtcatgccggaggagctgtgcgccgaagccatgaacctgttggtctccgccatcgaggagcacaccgacatcaaaggttccgtggaactcatcgaacccgcgctgaagcgacgcggatccgttgcggaagcggggtccggcggaacaatatagattttcctgcgattaccggaaggcagagcggccggacggaatcgcaaggcaacataatttcatacggataatcgaaacgtttcaatgacgatataacggtctccgaagaaaccgaacaaacgaacaagccgggcgaaatccggcgaatccaaacggaccgcggaatcgcacgcacgtcatcgaaacgtttcaatacaaccagatgtgagccgtgccgcagggcgcgcctcaagaaggaaacaaggagaatagcaatgaacatcaaacgaggactggccacgctggccatcgcagcactgtcgctgacctccctcgccgcatgtggtagcgataccgcacaggacgaggaaaagccggacagcctgtcgttctggtattacgaagaggacgacgcaggccagactcaggcttggcgtcgcgcggccaaggccttcgaaaaagagaccggcgtcaagatcaacttcgagcgcaagtccttcacccagatcgcgcagaacggcagccaattcctgaactccgacgaagccccggacctcatggaatccaaccgcggcaacggctccgccggcgtgctctccaccatgggcctgctcaccgacctcggcgactatgtcaagcagtacggctgggacaagaaggtgaccggcgcaaacgcagcagtcgccaagtacgacgagaacggcatcatggacggcgatacctggtacggtatgaccagctacgctgaattccagcgcgtctactacaacaaggacctgttcgccaagtacaacatcaagattccgaccacctacgacgagttcgtggacgcctgccagaagttcgtggacgccggcgtgaccccgattgcagccgacgcgcaggaatacggcgtgatgtggctgtggtggcagctcgtttccaagaatgccgactccaagttcatcgacaactggcagctgtacaggggtgacgtcgactggaattccaaagtgctgaccaactccgtcaagaccatcaacgagtggcttgacaagggcttcatctcccgcaacgccactggcatgaaggccgaggacaccacgcaggccttcatcaaggacgaatatccgatctaccagactggtacttggaaccagggccgtttcgtcaagcagatcaagtcgttcgattgggacgcggccgtcatgccggaatccaactacgcagtcggctgcgcaggcaacctgctggtgattcctgagaagtcgcaccacaaggatctgtccgccaagttcatcgactacgtcctctccgatgatgtgcagaacttcctcggcaacgcaggcggcattccggtagcggcagacaccagcaagatcaccgacgcgaagagcaaggccatgatcgaggaatacgattcctacgccaaggacggcaagctcagctactacccggattacgcggcctccaacctcaccgacgcggttccagcggagttccaggagctggtcaacggcaccaagaagccggcagacgtgctcaagaacatccacgagaagtacgacaccggcatcgaggacatgggcgtcaagaacaactaaaaacaaccgatccttcctttccattccaactccaataatggtgcggcccgtcttcgggcggaccgcaccaaccctttcctcccccatacattccgcacgtcgcatcgcgccaaatcgtgcgtcatcacagaacaatccatcggaaatccctcggatcatcaatatttcaaaggacttgcaatgtctcaaaagaccaagcacgaagcctccatgtcgagacttcccggcaaccgctccgcgaaattcgttccatacctcatccccggcctcatcggtctgttcgcggtagttgttgttccgttcatctggaacatctacctgagcttcacccgctggcgtggcgtcggtcccgtcaagtgggtcggcctgaaaaactggaaacgcctgttctccgattcgacgttctggatttccttcgctaactcgttctggatcatcgtggctatcgtggtcatccctaccatcctcggcctgttcatctcgtctctgctcaccgacgtgatccaaaagaagttcggcggcaaaaccgcttccttcctgcgcgcgctgttctatttgccgcagctgcttccggtggccgtcgccgcaatcatcatgggctggatcttccgcccggaggacggtgccgtcaacgcactgctcgccaagatcggcttgggtgcattgcagcacaactggctgggcagccctgacagcgcactgccgatcctcatgttcatcctggtgtggatccagctcggctacccgatcgtcatcttcatgtcgggcctgcagcgcgtcgatccggaactctacgaggccgcaggtcttgacggcgccaactggtggcagaagttccgcgtggtcaccctgccgtccatcatccctgaactgctggtggtcatcctcaccgcaaccatcggcgcactgaagaccttcgctccggtctacctgctcaccaagggcggtccgggcacctccaccacggttccgtcgtactactcctacaaccagttcttccaggtgcagcaggtgggctacggtgccgcaatctccacagcgctgactgtggtaatcatcgtcttctccatcgtgttcaccctcgtgcagaagcacgtcgagaaggaactcgtctgagagaaaacccgaaaaacaatcgcaagaacatactaaaaatccgaaaagcaaaggtgccatcatgacttattccatgtccacggccgccgcgcgcaaggcctcgaagaaaacgcagcacgtgcgttccgcaggtgactggatcaccctgatcctgctcgtcgccggagctctgctcgtcctgttcccgctgctcgtcctgaccgtcaacgcgttcaagacctccgccgattacaacgccaccggcccgctctccctgccgaagcacttcaccatggaaggcatcatctccttctggactaccaccaacttcccgctgaagttctggaacagcttcatcatctccctagtggtggctgtcgcggcggtcgtgctgtcggtgctcaactccttcgcgctcggcatcggcaaggtcaagggcaacacctggatcgtgctcggcatcatgctcgccaacatgatgccgcaggaagcgctgctctacccgctgtacaccatgttcaagcaggtcggtctgtacaacaccaaactcgcgatcatcatcatcttcaccatcatccaaagcgcctacggcacctatctgctgtcctccgtatacggcacgttcccgcaggccatccttgaggccgcggccatcgacggcgcctctcgctggcaaatcctgcgcaaggtggtgctgccaatttcttggccgaccatcagcgtgctgttcgtgttcttcttcgtgtggacgtggaacgaatacatgattccgatggcgttcctcatgagcgatgacgtacagaccattccgctggcactcgccaccctgcagggccagcgcaccatggaagcgaccacgctggcatcggcttcgctgctgagcatcatcccgaccatcatcttcttcatcatcttccagcgcaagctgtcgcagggtatcaccgccggtgcagtgaagtaacgcgacccaacaacgctgggatgttgtgaaataacgcaaaaacagatacaaccggccgcggcggctttcagcaccgtagccggcattatcgacgcgcccactgcaagggggatctacgatagtcggtagtggtaggcggcgcacccatttccgcgtttcccaagctgtttaacaaaggagagaacaatgaatactatggcgacttccggtttcggcaacggtgccctcgattcgctagcaatcgcgacggaccacggccgtacacgttgcgtcaacgccgaaaacccgaccggcggcaagggcactgcagccaccgctgccagcgcgctcggcccgtcacgtaagggcagcccttgcatccagacgatcaaggcgggcgattcggtcacgctgatggacgtcgatggcccgggcgtgattcgccacatttggatgacggtcaccgaccgcacttccccgaccggtccgaacgtactgcgcaatctcatcctcgaattctattgggatggcgaggagacgccgtccgtgcagtgcccgatcggcgatttcttctgctgcggtcacgcacaggcctgccgtatcaattccatcccgatcatggtggtgccaaatcgaggtttcaactgctatttcgccatgccgttcgagcacgcgcgcattgtgctgcgcaacgatcacaacgaggacgtgccggccttcttctaccaaatcgactacacggaatacgacgcgctgccagccgatgcgatgcgcttccatgcgcagtggcgccgcgaacgcgtcaccgaaattgcccgtgactacacgattctcgacaatgtgcacggccatggcgcgtacatcggcacctaccttgcgctgaccgcgctggaaagccgctggtggggcgaaggcgaagtcaaaatgtacatcgacggcgatgaacagtacccgacgtggtgcagcaccggagcggaagactacttcggcggcgcgtggagtttcgccgacttcgacgagcacggccgcatgcgcgagaacacgttcaccggaccgtacctgggattcccgttctattcgcaacgcctcgccgcgcaccgcgaaagcgactactgggatgtggccacacccgtcatgcgcggcctgtaccgctggcacattccggatccgatttatttcgattctgacctgcgcgtcacctggcagcagatcggcaccgaggaagccggcaatttcgagcggcaggatgacgtcgcgtcggtggcatactggtaccagcttgaaccgcacacgccgttcgatccaatcggtgaccgtcacttccgtcagccccgctgatttacgattattccgctgatttacgccgatatcgccgtatcgtgcgttgacatgggaatggatatgttccgtctcgtgtcagcgtacgatacggcgattgtgttgttatgcgggcacagtaatcacattttcttcaagataacccgatgattttacaatagaaatgacgattgcggcatgccagacgcataccgacgtgcgtatagtaaaggcacaacagaaaaacaacagaagaacgaagaacaagaaaaacaacacaatagcgacgcaccgcacgatgtagagaagaaaaaaagaagcaagaaaccaggcggtcgtccgaaaggaaacatcatgaagaacaacgacactttcaaccagatcctcaactccaacctcgcttccatcgatccgggcttcggccagttcgcacttgccaaggcttccgctgatctgatgaagaaggtcctcaacaagtaagaccttcaagcaggaaggcaagccgaaccgcgtcaggccatctctttgaaacagaccgcgtgaggcaaggcaccgccgcagcgaacgctgcggcaccgattctcttctttccgattttttaaatcgcatagcgggaggccgcgattccaaccgaatcgcggcctcccgctttttcatacgcgcacatgcacccctgtcttgccggcaatgtccattatttgtgccacacaatcacgccaatacatcgctttccgttaacttcgcacgaacttaacagcaacttaccagcgaacttaacagatgcgaagttgctgttaagttatgttaagttgtctggcaagttcggtggcgtatctaccgcacgccacctgcgcagcgcaaccgctacagttcctccatcgcaagattgcgggctgcggcgcgttcgcgggggccgcgcgtcacgtagaaaccaatcgccacaattacgaacatcaccgtgcagcaggtccacagcacgtgactgccgaacgcgttcaaaatccagcctccgacaagcggcgaaaacgcgttggatagcgaccacaccaggttgtacaagccctgatacgtgccgcgtacatccttcggcgcgatattcgccaccgtcgtagcggcaatcgggaatgtgccaagctcgccgagcgtccacagcacggtcgcaatcgcgaacgtcacccacgaatcggcgccgatttggaacgcatagccaaccgcagtaatggacatgcccagcaccagcacacgggtgttgctcatccgctggaacagcgcgatcgcaggaatctgcagcaaacacagaatgcctccgttgatggtcagcaggctggaatattcgtccgtaccaagcccaatctgcgtcatcgaaatcggaagtccgctgacaatctggtaatacgccagcgtgtacaggaacatcagcaccaccatcgacatgagcgctttgtcggtgcaggcacgacgatagctgcgccaaatggagaatttcgattgctgcgattgagccgtttgcgcagtgccagaacgttccacgaagcgtttcacagaccgtccgacaccgtgcacgcccagcccggcctctttgaagaatgccatcatcagcaacgtagcgaataccaacacagccgcttccgcatagaacatcagcgaataggagattttgacaagctggttggcgatgatcgggccgatagcgaagccgaaattcgcagcccatgtttgcagcgaatacgcacgcttctgcttgcgaaacggcaccacgtcggaaacgtaagccgcgaccgcaggcgtcggcatagatgaaatcgcaccgtatatcagcaacgtaatcgccataatccaaggattgccgatacaagccaacaaaaccagcatcaccgcggaaccgagattgccgataacaatcatcgcggggcgcccgaatcggtcagacagcgcaccaccgtacaggcagccgaaaataccgccgaaaccgtacatggagacgatagtgccagccacgcccgcgctcacatgcatgtcggaaacgaggtacatggagaggaacgacgtgacgaagcggcccatccacagaataagcagcgtgacccacagaccccagaacatgaggggcaatccgaaaatctctttgttcttctccattcttgccatcatatcgagcaatatcgagcagacgcgaagccgccgccttttcccggggtgctgggacaatggacaactatggcaatgaaaaaaggaccgaccaaggggtcgggcggaaagcatcgtaacgcgctgaagggcaaggggccgactcccaaggccgaagatcgcgtatatcacaaggcttacaaggcgaagaaggcggcggatcgccgcaagatggccgatccgcgactggcggcacgtcgtcgcgtggcgaagttcacttcggaatccgacgatctggtcatcggccgtaacgcggtgcttgaggcgctgcgttgtggcgtgccggcaaccacgctgtatgtggcggcacgtatcgagcatgacgatcgcacgcgcgaaatcgtgcgtctcgccggcatccacggactgcatctgctggaagccgacaggctcgaaatggaccgtatcgcacgctcgtcgaaccatcagggcgtggtgctgaaggcgcaaccgttccagtattcctcgctggcagagctcgtggaccgcgccgataagaaggcgcgtgccatggaagcagccgattcggaaagcgcgcgcatcgcggcacgtccgctgttcatcgcactggacggcgtcaccgatccgcagaacctcggcgcggtcatccgttccgcggccgcattcggcgcgaacggcgtgattctgccggaacgtcgttccgcttcggtcaccgccgccgcatggaaggtgtcggcgggcgccgccgcgcatatgccagtggctcgcgtggtgaatctgacgaaggcgatcgaaagcctgaaggaacgcggctactacagcgtcggtcttgacggcggcggcgatgcgctcgtcggcgaaaccggtttcgaaaccgatccgctggtggttgtgctcggctcggaaggcaacggcctgagccgtctggtacgagaggcttgcgattccatcgccggcattccgatgtcgaatatggtcgagtcgctgaacgcgtccgtcgcggccggcatcacgctgtacgccgtggcgcgcgcacgtcgtgaagcggctgccgcagccaagtaatcgttatatatttgcgatacatacaaagaagctcaagcttttccagcttgagcttcttttgttttcctgagcttttcttgtgttagaggctccagcaattacggaccatgctaacgtgcagaatcagtggctccacaccgccgcgtcgggatcgtcgtcggggttgtagccgtcgtcatcgggatcgttgtacgtgtattcgtcgtcgatcacgccggaatcggcttcgtcgttcaacacgtccaaatccttctgatcgagcttgtactgcggcagcacgttctccacatagctcttcacggcttcggtcatggacacgtcgtggccggccttctccgcaaggaaccaacgatggtcgagtacctcatggaagaactgcgccggctcaatctgggagcggtattcgtgcggaatcatgcgcacggtcggctcgaacacctcgcgcatccagtcggtggccacgatttcgagatcctcgccatcacgccacgtggaggtgcggtaggcgtccagatcgttgagcagacggcgggcctggttctcctgcacgtcaagaccggtcagtcgcagcagcttgcggttggcgtagccggcgtccaccacgcgcggacgcaccagcacgcgcttgccgtcctcggcggtcttcatttccagctcgtccacgtcgaagcccagttcgttgagcttgttgacgcgcttttcgatcttccacatctcgtccgggctgaacttgtcggtgtcggtcagcgcgctccacagcgaatggtagcggtccaccaggcggtttccgatttcgatttcgtccacgttgctcggcagcaatgcgccggaagacagatccatcagttcgccgatgatgttcgtacgggccaaatccacatcgtattcacgctggccttcggtgaggttcacctgcagatcgccggtttcggcgtccaccaggaacgcggagaaagcgtcggcgtcacacaggaacagcacgttagacagggacacatcgccccaatagaagccggccaggtgcagacgcaccatcagcacggcaagcgcgtcgatgagtcgttcggcggtgtcgggacgcaggttgcgggcgaacagcgcgcggtacggcagcgagaatttcagatgcttggtgaccaggatggcttccagcggctcaccttgcgcattatggcggccggtgaccacggcgatcggctgcacggtaggcagttccagcttctgcagtcggcgcagcagctcgtattcgcgttccgccacgttgcgtgtgatttccttcatggcgtagacttcgtcgcccacgtgcacgaaacgcaccacgtgcctggagatgcctcgcggcaggttgaccagcaggtcctcaggccatgttgccagcggcttctcccacggcagcgtgaacatcttcggattcgagctcgccgcggtgatcttcaacgcctgcggctccgggctctgcgctgcggggtcctcggccttcacggaagtggccttaagcacacggggatccatctgtggcaattcatgtgattccatagctcttcaatttacccgctgacctacccacggcaggcggcaaagggactacgagtgtcacgatgagaacagcgggaaaagaaaagccccgcaccaacgcggggcttttccaacgagacaataagagaggaaagagaatgtctcgtttaatggttgacggacgtttgcacatccgccaagtattggttcaaccacccgccaagcgttccataaggaacgcccgacggttggttactcgttatcgtctcagttcagacgcagctcagtggacggagcgaacaggtgcatcttggacgggtcgatcttgatcttgacggtatcgccgaccttcggaagagcacgcgggttcacgcgaatcgtggtgagcttgttctgatcggacatcatggtggacgcctcagcagcggagccatcggtgatgatgttgccgtagatgtagccgtcggagcccagatcctcaacgttcatgaccttgagggagaaggcgttggcctcatccggggcagccagggaggcgtcttccggacggaagccgaccacaatctggccgttgtcttcggcggtgagcttgttgacggcctcagtcggcagatccacggtgtcctcgccgatctttgccttgccgttgaccaccgggtgggtgttgatgttcatcgacggggagccgatgaagccagcgacgaagacgttggccggacgatcgtacagctcagtcggagcgccgacctgctgcagaatgccgagcttgatgacggcgatacgatcacccatggtcagagcttcggtctgatcgtgggtcacgtacagggtggtgacacccagctgacgctgcagagcagcgatctgggtacgggtctgcacacggagcttggcgtcgaggttggacagcggctcatccatgaggaagaccttcggctcacggacgattgcacggcccatagccacgcgctgacgctgaccaccagacagagccttcggcttacgatcgaggtactcggtcaggtcgaggatctcagcggccttctcgacgcgcttgcggatctcttccttcggggtgccggcgatcttcagggcgaagcccatgttgtcggcgacggtcatgtgcggatacagagcgtagttctggaacaccattgcgatgtcgcggtccttcggctgcatcgtggtgacgtccttgccgccgatgaggatgcgtcccttgttgacctcttcgaggcctgcgagcatacgcagggtcgtagacttaccgcaaccagacgggccgaccagcaccaggaattcgccatccttgatgtcgaggttcagatcatccacagacggcttgtcattgcccgggtagatacgagtaacatggtcgaatacgacttctgccatgatttgtcatcctttcagaggcaggtacgtgcctcacgatccgttgtaaagggatttttgttcggtgcccatcctcgcggcttactactttgacaaagccacaattcaaagcgtttacttattggttggtttagcgaagatctcttcgttgagccatgacctactatacacacccaaaccgaatcgtcaatgcgtgtcgcgggttttcaccgctcaaaacagtctattagggggttatcatcccctcaaatcgatggtttttcatcacaatatcctcattccgcgagagaatggacggtagtctgaacggtgagacgtggaggttcatcgtgcgcaatatccgaatcggagtcgtcgaggacgaccctgcaagctgccaattggtactcgattacctcaatcgctaccaaagcgagaccggcgagcaattcaccgtctccgtattcgacgacggcgcgcgcatcgtggagaaatatgcccccgtttacgacattctgctgctcgatattgaaatgaaggagatagacggcatggccgccgcccgccgcatccgcgaacgcgacgacaacgtcgtgatcatcttcatcaccgcggccccgcaatacgccatcagcggctacgaagtgcgcgccctgtcctacctgctcaaaccgctgccatggttcgcgttctcgcaggagctcaagaaatcgatcgacatggtgcgccgcaacggcgacgattccatgctcatcgaaaccggcaaggggcagatgaggatgaatctcacggacatcctttatctcgagtcgatccggcacaccatcgtcatccacacgcttgacggcaaatactctatcaacggcacactcaaagacatggaagccaagctcgccgaccggcacttcttccgctcgaactcctgctatctggtcaatctcaagcatgtgacgggcgttgccgaccaggattgcatcatgtccgacgacgagcggctgcgcgtgagcagaccacggaagaaagcgttcctcgccgccttggccgactacatgggcggcggccgatgatcaccaacgcgctgcccgacatcccccgttcgtacaccgccatctgcgaatgggcggcatgcgtggtgtatatcgcggtactgttccgccgcgtgccgccgcgccgctccgtcgttgtgagcgcaatcggactggcggcgctcatcgccgtgcagtatttcgacggcagcatgccgatctggttttggatcgtcggcatgctgctcgccttcggctgcatgtacctgacgattctgttcggcgccggcaccggcaaacgcgaaggactgtacatcacggcgcgcgcgttcgtactggccgaactggtggcgtcgctgcattggcagatcgtcacgttcatcggcatgcgcaacggccgattcgcggattacgattggcatgccgtcttactgctcgttgccacctacgcattgtgtttcggcctggcctggctggtagaacgcggcaatttcagccagaccgcgcccacgttgccgacggcttccgcggcgaccgcgacggtggccatcacgatcgtcaccttcgccatgagcaacctgagcttcatttcgaccaatacgccattctccggttcgatgggccaggaaatcttctacatccgcacactggtggatttctgcggattcgcgattctatacgcgcaacaggagcaggctcggcgcattgaagcgagcgcggaaatcgcgtcaatcaacgcgcagctggaaagccaacatcaggagtacctgcagtcgaaggagaacatcgaatcgcttggtcggctcgcgcacgatctgaagcatcagatcgcggcattgcgtgccgaagtcgatccggagcatgcggcggcaggattcgagcagttggagaagtcggtgcagcgctacagcgcccagcagcataccggcaatcccgtgcttgacgtcatcctcaccacaaaagagcgcacttgcgccgatcgcggcatcagtttcaccgccgtagcggatgggtcgctcttatccaacatgtcgtcgatggatatcgcttcgctgttcggcaatgcgatcgacaatgcgatcgaagccacgtcgaagctggccgatccggaacagcggctcatcaaactggcattgttcgagcagaattccttcaccgtggtccgcatcgagaattattacgattcgcggctgaagaaagatgccgagggcaatctgcgcaccacgaagcgcgatgaccagcatcggcatggcttcggcgtgaagtcgattcggcacatcgcgcaacagtacggcggcgaggtgacgatccgcaccaacgaccactggttcgtactcaccgtgctgcttccccgtcagaccggcctgatggccatgtgaggattgcgagccggcaatgcgaaggctaacgatctgcagctttcgcccgcggtagatgccaagcggcaagcggcttggccagacgggaggcggtgaacgcgctgacggccaccgcaaggccgattggcacgaacaggttaatcggagcgtcagccaactccatcaccaggcaaatcgccatcaacggcgcctgctgcgaggcggcaagcagcgcgcatgcacccagcagcgcatacatgccgatcgaattcgtgtggaacacctgcatccaaagaatgcccagaatcgcgcctccggaagcgcccaatgcgatgcccggctgcaacacgccaccggaagcgccggaacgaatcgtcatcaacgtgacgatcgccttggccacgaaagacagcagcaacaccggaataacggccagatcggccttcgaggagaagctcagctgcgcggcggcgcggccattgcccatcacctgcggcacggcgatcgccacaacgcccgtcagcaggccggcaagcggcatcatccacagaatgcccgctccggacggcttgtttttctccgcccactgggagccgcggcggaacagcgcgccggcgacgccaagcatcaagccggcaatcagcgcgaacaccatgtagtcgggggtaaacaggccattcgccttgccgatcaaatagaacgtgtgcgtgcccttgaccaggctcgccacccatgaggcgagcgccgagcaggcgaacgcgagcgtgaccgtctcgagcgtcacgtcggcgagcaggatctccaccgcaaagaacgtgccggcaagcggcgcgttgtagactcccgcgagaccggccgcggcggtaatggccaccagcatacgcgtgtccttcgcgccgagacgcacccagcgggcgaatcgctggccgaacatcgcgccaagctcgcgcggagccacttcgcggccgatcgacatgccggtaccgacgataaaaatctgcagcagcacatgtacgatggtctgccagaccggcatcagcgcaccaccgacggctttcttgacggatggcactgttgtggtacgcgtgcgcagcagccaccagatcacggccgcgatggaggcgccgaccgtcacggaaatcgcacgacggatggcaggcacgttgaagggaccggattcatgcgcattctcgatgtatccaagcgcgaaacgctcgacttggtacagcataagtgtcagcaggcccgcggccgcgccaatggcgatgccgacgatggccaccgcagcgatcagccccggaatacgtccgatagtcggctgctgttccgtctcgtcctgcgattgctccgacaccattgcttctctcacgttgcgtgtacctcgtcttcagtccgtctcatcggttcgtattaccgcatcaccatcgttccacccacggcggatttatgcgccaatatcccccaccagaacatgaattccaatgtcagtcacacaacttgcgtctgcatagtgaacggccgatcaggctcgtcgtcctcggcaacaaggccggccacatccgccaaacaccataaggcgtacagcggcagattcatcggcggcaaatatattggaatatatagcattcaagacacaagatgcgcaaaatagacaatttcaaatcgccgtttttgcacaaaacagataatttccgccacagccaaagacaaggaaatcaaacctccgccacaccagggaaagcgcaaatccgcaatgtgaaacgcagaagagttacgtgcatggctcgcatgttgaaaacatgagcaaccatgagcaccagagaaggaatccacccgtaacacaaccgccgcagtccggaaatattggcgtcatgttcctgttttgccgttttcataagcgtgatatcgatggaatcgcaatattcgttcggctcattcgaagcatcaacgcaatacggaaaagagaagccatggccagcatcagcacaaccgcgcaagcgatcccgcaaacgccgccgcaaaccccatcacacccttcgatgcctatttccagcaccgtcaaagccgtaccccgctccggcatccgcgacgtgttcgaccgcgcactcgccggcgatgcggatgagctgcgcgaaggcctgcgtcggctgcgctcattcgcggaacagatatgaaaagcccgtccagggaaaagggaagacctggacgggcacaaggaagggaagagagaaatcagtgcagacttacttggcggcctccttcttgtcgtcgctcttcggcatgacccagaacttgagcagcggatagctgacgatcacggcaagcaaggtgttgaccacggatgcgatcgtgcctgcgatgccggcgttcatgccccatccctggcacagaccggtcacgtagcccggcagcacaaggttcaccaccacgatgatcacggcgaggatcacatacttccaagcggcgtccttgaagctggagtcggacttgaagacccacttcatctgcacgaagaagttcaccacctgcgcaagcacctcggcaagcaggaaggtgaggaatccacccagaccgttgcccttggtgtcatagttgaagatcaggaagtggaacggctgcgtgagccccaagctggagatgaagatggcggtgccgatccacgtcaccacgaaacgggtgatggtggagatgttcgacagcacattgaacaggatgaactcccagatattcggatgatccttgatccactggcgaatcggtccgaccttcttctcgccggcagcggtttcggccggcttcgcagcattgttgtcagtcatggttcagctcctttgcggtgcgcttgttggcggattggttgcggaagaagccggcgatcacgccgcccaatccgcggaaagtatgcccgttggcgatgttcacgatggcgtcgaccatcgccgagtcgaccatgccttgggtcatcttgctcatggcgcgaggcggcatgttcaggatgaacagggtgttcagatccggcgagccagtcttctggcggatcttcgcttcgcgcttggtcagtgtcttggcgacggtacgcgccacgaagcccttggaatccacccacgacatgatcggatcgttgacgccgaacgtcgtcggcttgccgggggcaagcacctcatggccgaacagcacggccatttcggcgtcggtcacgtccttgacctgtccggtcagatagtggccaagcgcaggatcggcggcgcaatcggcggtcgtgcaatcgccggccacggtgtgaggaatcgcaagcggcaaatgctccgcattgtcgccgaccagcagcgtccattcgccgctttccgtcttccatgcattggcggcaacatcgaaatgacggaacgtgtagcggtcgaaatcgatatgcacactcttgctttcatgcgcggccaactctaccttgacgaagcccttcagctcacggtcgggatggagcacgccaccctgcggcgcgcgcacatacaactgggccacggtggagccggcgacatcggaatcattggtgacgacgaaatccacaccggtcgcggtggcggtgatcgcgctgtacgtgaacgtggagtagctcagaccgtagccgaacgggaagcgtacgggcacgcccacggtctcgtaatagcggtagccgacgaacgggccctcgcggtagatcgcgtcacgcccgatggccggataccagccggagcttgggcaatcctcgtattgcatcggccaggtttcggccaaatgtccggatgggttgacttcgccggtcagcgcgcgcacggtggcggacgcgccggcctggccggacaatcctacgtacagcatggccgcaacatcgttgaaccacggcaattccaccggggaaccggcgacgagcacgatcaccaccggcttgccggtcttcgccaacgccgttacgagatcgttctgcgcctgcggaatcgccatggtggatcggtcaaggccttcggattcgctgcgttcgtcgaggccaacgacggccagcaccacatccacggcgtccttcttggcgagcgcgacggcgtcgttcagcagcacctcatccgacttgccttggcggtcgtagccctgctcgtagccggccaataccagtccttcggcgttcttgacctcgtcgaggatgttctcctccttggtggcgttcaccttggatgagccggaaccctgatagcgtgcggtcgcggccatatctccgatgacggccacgcgagtgcccggcttgagcggcagcgtggcggcgtcgttcttcagcagcacgctggaatgttccgcgaccgttctggcgatatcatggtgcgccttcgcgatgtcgtccgacagcagatcgtcgcggccgacgccgacgagcttggtcgccgccgcgattttggcgacttccgcggcacgcttgttgatgtccgcctcggcgagcgcgcccgctttgaccgcgccttccagctcgcgcacggaggtgaaacctggcgacggcatttccagcgagccgccggctttgacggctgcgacggcggagttggagccgccccaatcggagacgaccatgccgtcgaagccccattcgtcgcgcaggatctcctgcagcagatgcttgttttcgtgggcgtagacgccgttgacctcgttgtaggaggtcatgatgctcatcggcttggcctcgcgcacggcgatttcaaaaccggtcagatacaattcgcgcatggtacgttcgtccaccacggagttgctggcctggcggcgcagctcctggctgttgaccgcgaaatgcttcgggcatgcggagacgccgttgctctggatgccgcgaataaggccggcggccatacggccggcgacgatcggatcttccgaatagtactcgaagttgcgtccgcacagcgggttgcgtttgatgttcatgcccggtccaagcaacacgttcacgtcgagatcgtgagcttccttgccgagcgcctcgcccatctcttcggcgagcgccggatcccaggtgttggccacggtgcaggcggtcgggaagcaggtggccggcttggatgcgccgatgccgaggtggtcgccttcgccaagctgcctgcgcacgccgtgtgggccgtcgctcatgacgaagccgggaatgtcggcgcgatcgttgccgcgcgaatcccattcggatccgccggacagcatcgccgccttttcaacgatcgaaagatcttcaagttccatgggttctccctcgcactaggtgttgccaaaacctgctttgccgagcctgccctgtccgctccgcccgactgcgctgttttcttgcgatttcccgctgccgtaccgcgctgcatcgcaccgtgccgcacgcgggatttcgccgctagtttgattgaaccagcttttgcgatgccatcaccgccgtattacacaacctgtcgttttgctcgcacaatcggcatatgggcgcggtgaagagggtatgcggtggcgcagaacgcgcataaaatcgcatcgttccattttgcaatcgatggcaagcgtttcgatatgcgtatatcgttgcaatttcaagcgactcgccgatattgatacctttttgcgcaagcgctatcatacttaacgaaagtaagttttgctgacttttcttcaatgcggaacatgctttgatcactcaacgcggagagcgatgtttcgcagcgcacagaaaggataatgagatgcgcgaccagcaaagcagcgacacgagcatcgccctggacgccaatacggacgtccagcaggaggccgataaaccggcagtcaagtggaggtacctcttcggcttcctcgcctggaccgtgcttaacgccatcgtcatcgcactgtgcgctggcgcgtcggtcttgaccatcaagcgcatcaagtaattcaaacgggaccgtaccgtcgcatatgatgacacggtcccaatccagttctcccgatttttcccacactcaaaggagccccacatggtagacagcacactgttctcgctggccacgctcaacgcccatccggcaatgaatccggattcggtgatccagggcgatcattggcgcatcggcctcatcacggacgcgctcgtccgtttcgaatggtccgacagcggccgtttcgtggatgacgccacgcagatggcgatggtccgtgatttcggcgaaaagcctgaattcaccgtcaccgaacgtaatggctggctggaaatcgacaccccgtcgctgcatatctcctacaaccagcgcaagttctctccggaaggcctgtacgcaaccgtcaagcacgtcaacgccatcgaaaacacttggcattacggcgacgtgcagcgcaggaacctcggcggcacctaccgtacgctcgacgaggcgaacggccgcatccccgtcgatccgggcgtcaacagcaccgacggttgggcgatcatcgacgattccaagtcgaacgtcatccgcgaaaccgccgaagtgaacggcaaccacaacgatttcggcacgtgggcgaccccgaaggaagagccgaccaccgacctgtacctgttcggctacggccaccgctaccgtgaggccgtgcacgccctgtaccgcctgaccggcccgaccccgctgctgccgcgcttcgtgctgggcaactggtggagccgctaccaccgctataccgaaaccgaataccgtcagctcgtcgaacgtttcgaaaaggaaggcatcccgttcaccacggccgtcatcgatatggactggcacctggttgacgacgtcgacccgaagtacggctccggctggaccggctacacgtggaacaaggacttcttcccggatccgaagcgcttcctcaactggctgcacgagcatggcatgaaggccacgctcaacgtccacccgagggacggcgtgcgcgcgttcgaagagctgtatccgcaggtcgccaaggccatgaacatcgatccggaaagcggcgaggccgtgcagttcgacctgaccgatccgaagttcatggaggtctacttcgaccagctccaccacccgatggaggaagatggcgtcgacttctggtggattgactggcagcagggcggcctgacgcggcagccgggactcgacccgctgtggggcctgaaccacctgcattacctcgattccgcccgcaacgacggcagcgactacagcgaacgcaacccgcgcccgctcaccttctcgcgttacgccggcccgggctcacaccgctacccgatcggcttctccggcgacaccgtcgtgacgtgggagtcgctgaagttccagccggaattcaccgcctgcgcttccaacatcggctacggctggtggagccacgacatcggcggccacatgttcggctaccgtgacgaggaactggaggtccgctggtaccagctgggcgcgttcagcccgatcaaccgtctgcattccaccgattcgccgttcaacggcaaggagccgtggaacttccacggcgatgcggaacgtgcgatgacgtccgcgctgcgcctgcgccatgcgatgatcccgtacctgtacacgatgaaccgtcgcgccgcgttcgacaacgagccgctcgtgcagccgctgtactgggactatccggaaatcgaagccgcatacaagctcaccgacgaattccgtttcggcaccgagctgctggtcgcgccgatcgtcgatccagccgagcgttccgtgcagcgtgcgaaggccgacgtgtggctgccgcagggcgaatggttcgatttcttcgacggtcgccattacacgtctcgtccggccgaaggccgccgtctggaggcttggcgcgatctcgaccgcatgccggtgttcgctaagcccggcgcgatcgtgccgctgcagatgcccgccgagggtgaggcgctcaactccgtggccaacccgcgcgcactgcaggtagtggtgttcccgggtgccgaaaacagcttcacgctgtgggaggatgacggtgccgcacagagcaaggatcgttgggcatccaccgaaatggcgctgcgttttgagggcgattccgcacagttctcgatcgcccctgcggaaggtgcgacggacgtcattccggcttcccgcgattggacggtcacgttccgtggcatcgctccggaagcgatgcacgccgtccgcgcgaccgtcgacggctctgccgccgctccggaagtcgcgtacgatgcggaaacgctgagcctgaccgtcacgctgcgtgacgtgccgacgagctccgcaatcgccatcgattccgccgacggtcttgccgttgcggacgatccggttgaagccgacgcgttcgccgtgctgaaggatgcgcagatgctgtacatgaccaaggagcacgcataccgcgcgatccgcgagctgggcaaggatgcgctgccggcactgagcacgctggaggatctgcacggcgttggcgcgcagaccaaacaccagtcccacatgccgcagccggtcatccaggccctggccgaagtgctgacccgcaactgacctcatcgcaataattcaaaataaaacgcgtgcgcgtccggatggtttccgcccggacgcacacgcgttttgttttatgtacgaaattacgcaacgcgctactgttcggtggcacatcgccgtttacgactttggctgctcttatcattccagccatcgcaatcggactaacagtggccagtctgcaatggcttcccaaaggattgtatctattgctgatactgggcttcggcatagtggtacaactgcaaataccactgttcgaacatgcactaaaaccctatgtaaataaggtggccgcatagcagcaagcaagtttccaagcttttgagcaaatacaataaagctcaatctttcgggcggtagcagtgctaccgcccatttacgttttcattcgcatttcgtatgaaccgcatgacacttttctctttaaggcatcgaggtggtgacgttttcttggacttcccgaccgggaggagaacccccttatggcgaagtacagcaaggagcagcgcgacagagccatggacctgtacatcagatacgagcgctgcgccgcggacgtggattggctacaatgtattagaccctccgatgagggacgaatgacgtgggattggaggccgacgatggccgacccgaaacatccccgccaccacggcgaggcgttcaaacggcagatcgcgcagtcgtgcgagagcggcaagccatcccgggagatcagggccgggcacgacatcgcgcgatcgaccccgcggcgccgggtccaaggcatccgcgacagcggctccacccgggccgcggacaaccgcacgcccgggcggaacgagccgatcgagccggggaggcgcgaccggcggttggagatggaggtggacgtttcagaacaagcggcgccggtattcgcacgaaggcaggcgtgatacgggccaacgccgcccgctgcccgatatcggcgcgatgcgggataccgggcgttccccgccccacctgttactggatgaccgggcgtcccgggacggagcgtgcggatccgatcgccggcgacgtgcgcgcggtccggcgcgacggccgcgaacgctacggcgccaggaagatcaaggccgccctggaaaggaagggcgtcaccgcgtccaggagacgcatcggcaacatcatgcgcgaacagggcatgcgggcgcgtacgcgcgcggacggtccgaaccgcacaggacgcgggccgacgaggccaggctcgcgaacctgctggaccgcgggttcgacggctacgccccgcacacgcatccggcgggcgatcttacctatgtccgcgtcggcggagactgggcgtacgtgtgtctgctggtcgacctggcggacaggggcatcgtcggccattccgccgggcggaccccaggacgcaagcctggtgctgggcgcgttcgccaccctcggcttcccgctgacggacgtccaggaaacaggggtttgccggccggaagggtccgcaggcccctcttcccgtattctgacgttaggagacaacagcatgcaggcggatcgtgtgagagagacggaacgaatcaacgacgcgttcctcgaggaggtcgtgccattcgcggtgcacggcgccacaatcgtcgacgcgcgtggaatgacgaaaaacggttggctcgtttccgacggacggtcgatagtcgaaacgggatgcgccgaaacggacttcgaaacggcctgccggctggtccacgtcgagcaagatcatattgttaacgctaacggaatggtgatgacgcccggatacgtcgacatccactcgcacggcgcatggggaagctcgttcgatgacggcgagaaggggatcacgaccgcccgagccggacacatggcgcacggaacgacgagacaggtcctgagcctcatcaccaatcccatcgacgtcatctgcggtaacttgaagacggtccacgacatgatgccggaccgcccggatattctgggcgcgcacctcgaaggaccgttcctcgccatgccccggaaaggcgcccatgatcccaattgcctagtcgatcccactccggatctcgtatccagaatgctggacgccgccgatgggtgtctcagacagatcaccatcgcgccggaacttccgcatggaatcgacgcaatccgccgtttcttcctggccggagtggttccggcggtcggccactgcgatgccgactaccagactgccagaaaaggattcgacgccggagccggaatcatgacccatatgttcaatgccatgaacgggctgcaccaccgcgaccccggcccgattccggcggcagtggaggatccgagggtcaccatcgagcttatcaacgacggattccacgtgcaggatcccatggtcaagctcggattcgggcttgcgccccatagaatcgccttcgtcaccgacgccatggccgcgaccgactgtccggacgggcattacctcctcggggctctggatgtagatgtgcgggacggtcatgccagactcgcctccaatggagccatcgccggttctacactgctattggaaaaggccgtgtctcgcgcggtgctggagctcggcatcagtccggtcgacgcggtggaagcggcgacgctgacccctgcgcgggcatttggcttcgaccgtcgaaatgacgtgacaggcttcccgatcggtctgctcgctccgggattcgcggccgacgtgctgctccttgatcaggaaacctggacggtgcgacgcgtctggtgcaacgggcatccggtgagataattgatttcaaggttcaatgacgaacgaaaggaacaatgacaatgaaccaacgtagagaacatcgttggcctcggccgttggagggccggcgggcccgtatctggtacggcggcgactacaatcccgaccagtggcccgaggaggtctgggacgaggacgtgcgcctcatggtcaaggcgggagtgaacctcgtatccgtgggcatcttctcctgggcgaaaatcgaaccccgcgaagacgtgtacgatttcggctggctcgaccgaatcatcgacaatctcggcaaggccggcatcgccgtagatctcgcttccgcgaccgcatccccgccgatgtggctgacccaggcgcatcccgaggtgctgtggaaggactaccgcggtgacgtgtgccagccgggcgcgcgccagcactggcgtcccaccagtcctgtgttctgtgagtacgcattgaagctctgccgggcgatggcggagcattacaaggacaatccctatgtggtcgcttggcacgttggtaacgagtacggatgccacaaccgcttcgactattccgaggacgccgaacgcgcgttccaagactggtgcgaggaacggtacggcacgatcgaagcggtgaacgacgcatggggtactgcgttctgggcccagcatctgaacgatttcagcgaaatcgttccgcctcgattcatcggcgacggcaatttcatgaaccccggcaagctgctcgacttcaaacgcttcagctccgacgcgctgaagtcattctatgtggccgaacgtgacgcattggccgaaatcacaccagaaaagccgttgaccacgaatttcatggtctccgccggcggttccgtactggattacgacgattggggcggcgaggtcgatttcgtgtcaaacgaccattacttcattccgggcgaggcgcatctggacgagctcgcgttctcggcttcgttggtggacggcatctcccgcaaggatccgtggttcctgatggagcattccacctcggccgtgaactggagaccgatcaactatcgcaaggaacccggccagctggtgcgcgattccttggcgcacgtggccatgggagccgatgccgtgtgctacttccagtggcgccaatccaggtccggcgcggagaagttccattccgcgatgctgccgcatgcgggggaggattcccagacgttccgggacgtgtgcgaactgggccgtgatctgggcacgcttgcggatgagggactgctcggcaccaagctggcgaaatccagcgtggccatcgtgttcgattacgagtccgaatgggcgagcgagcacaccgcgaccccgacgcagaacgtccatcatatcgacgagccgctcgcatggttccgcgctctggcggacgtcggcgtgaccgcggacgtcgttccaatccgttcgaactgggacgagtacgatgtcgcgatactgccgagcgtgtacatcctctccgaggagaacacccgtagggtgagggactacgtcgcgaacggcggcaagctcatcgccacgtactatacaggcatcagcgacgaacgggaccatgtgtggctcggcggttacccaggttccatccgggacgtcgtcggtgtgaggatcgaggagttcgcccctatgggatccgattggcccggagttccggaccacctcgatctcgacaacggagccgtcgcacacgacatcgtcgacgtgatcggctcaatcgggaaggacgcgaaggtgctcgcctcgttcaaggatgacccatggaccggcatggacggacgcccggccatcgtgtccaatccatatggcgaagggcgtagcgtctacgtcggagcccggctgggacgtgatggcatcgccagaagcctgccgatgatcctcgagacccttggtgtggaagtcaaagactcctcggatccggacttgcttcgcatcgagcgcgtcgatgagtcgacgggggctcggttcacgtttctgttcaaccggaccaaagaacctgtcagcatgctggtggagggacgcccggtcgtcatgtcactggccgactgtgctggcgcgacggttaccatcaatcccaatggcgtactcgtcgtcaaacaataatggctcattaatgaggcgatatgccatgtgaacgttcacatggcatatcgcctttcttacgacagatggcatcgtcgtttttgatgatatgttcacaatatgttgtgttatatcgtatgacaacacttaagttaagtcaggcatgtcttttgccctaccagcttctctgcgtgtggcattctcctcacctctacagacgtggagaatgccacaaaaggataatatccagtagaccgctaacgataaatatggccgagctgttcttcgttgtcgaataacggttgtgattgttgcttaatgttcggctgtgggattggcggttcgtgctctatggcttttttcttgcgtggctttggttgtttgtcatcatcataacgatcatcactccccagcacgttcgcttctcgtcaatgtatttgtatgcgattgcatggaatttagatgggattccatcgatagtgatagtgcgagaccttttttttggcggttgcctttgccttgatttggccaatgttgccgactgggacgatccaccacgtattatgcatttcggatttcgatttgatgaggcgtgtcattctttcaagattttttaggcgaggattccccgcctaaaaaatcttgaaatcgcaggagatctgcatgtaggtgccaggaaaacgctcatcctcgcgcagatgctatgcgaacagctgattcccacgttcataggactcgtcatggcatattcggcactgttcattctcatcggcacgatgaatccaaccccgtccgactcacttgccattttcctcctggagctgcatgacggtctgccgttgccgtgcgccacggccatgggaacggcgatcgcagtcatactgattcgtgaaaaagacctgttccgcttgttcaagaccagatgaatcggacatataccggtggaacgaatcgccattggaggatcaagttcgtgtgatgtcgtagaccataagtcatcagttaagcgttgtgtgacaattccatacaacgctttcttcatcgccgtacaccctttatggcgaagtcgaaggatagccacgggaagacgaggacacgtgaaccggtccgcataagcaaagcccagaggcaaagcatccgcccatctgtcccatcgaaaccggctagtttgattctgtcgtgtccgccgacgaatcatcggcgcaatgcgcatcgaaacatatcccgtcaggaccttctgctgtgagggacacgaaggtctgacgggatatgccggatccgttaaggttggatccgacggagcaatcgctggcgttcattccggtcgcttcatccgggatacgcctggcgtcctccatcttgcgatgcaccattcgatgcgttttggctccaatcaggaacgaatcgagatctgccctacagacaatttccgtggattgactccacctaatgtgacgacgcacgcgttcgacttcgaaccgatgggaaacgtgcgatgcggacatcgcgcactttcccgatctcgtccggaacccgaaggcgcacagccttcttaagtgaaaatcgctcctgaaatggagccaaaggagttcccctttaaactgccttgaccattatctctcttgattgtttgtaaaactcgtattgtggaagtggcgaaggccatgcttccttgcccgtctccattgcgggagaagatataagatcccgataaggtccttttatagacaaaaaccggttctttcgtcaatcccgaagcgcatccattggaatgccgttgtaggccaagtcaaaacgccggggttgaaaagaaaaaggtgccgcaccattattcccacggaatctggtgcggcaccttttcttttgaaaggaaacaaagaagtctttgcgccttacttgttgatgaccttcttgaacaggtcggaggatgccttggcgagggcgaactggccgaagcccggatccatggaggcgaggttggagttgaggatctggttgaaagtgtcgttctgcatgttcattccttttccgcggcgctttgtcttccgttcgccgctattcttttttctcttgtttcgttatgccttgattgtaggcatgtcatccccgtcgccgcatgtcattccgattgattcttttgtatattcatcggtttgccagaagatttttgaaataacttaccgcaccattaccatcacataaaccaagaaggccccgacatggtcggggccttcttggtgaaaaagggaaggagtggcaagtattagtctttattcggtcagggttttggcctcctcatcgatggcttcgacggtctcggcggtctgagcttcgtcatcgacgatttcgccggaggcaagcttggcttcgagctctttgacaatcttagcatgcatcttctcgtcgatcttgaccttgaacatgaacaccagcaggctgagcacgatcagaataagcggcacatagaaggcgcagatttcgaaggtgtggatgttggagggggtcatatcggccgcggtggcgttgccggtcatgccagcagcgacggcgatgaagccggtgatgccgttggacagcgcgccgccaatcttatcaagcatcggacgtacggacagggtgacggcctcgttgcgcttgccgttcttcagctggccgtattcgatggagtcggtcagggagaggatggcggtcatctggatgagggtgcccgggatgtagaagagcacgagggcgatgaacaccacggtcatgttggtggagaagagacccagcaggatgtaggccacgatcatggaggtcatgccgacgatgtacaggactcggcgtgggatgcgcttgttcaggatcgggtacagcggagccatgatgaggcctgacaccaaggcgatgacgccggtcatggagtaggcggcctggttgtcgagcacgaacttgaacaggaagaggagtacgccggtggtggccacgttggcgatggcgtacagcaggtaggacagggcgacccacaggagctggtcgttctggaacagggccttgaatgcctcgagcgggttgccgttcttctgggccttggcgcgcagtgcgttggtgctttccttggtgccgaacgcgacggtccatgcggtcaggatgccgaggagtccgacgatgatgccgaaggaggtccagccggcctgtccttcgcccttggcaccggtgagcgtccaagtgaagtagctgacgatcgggatgaccacgacggtgatgccgttgtagccgatggagccggtgaaggagccgagggcggtgtaggtggagcgctcgtgggagtcggaggacagcgccgggatcatgccccagtaggagatgtcacgcagggagtagaacacgtcgagcacgacgaaggtgatgacgaacagcacgatgaacagcgtggtgttgacgttcaccaggccgaacatgccgctgaagatcacggcgagcaggacggcggagatcaggccgccgaagaactgccatgggcggaagcgtccccacttggtgttggtgttgtcgatgaggttgcccagcagcgggtcgatgaagatctcggcgatacggatgatcaccacgaggctggtgatgacaccgataagcttggccgcaagcgccttgtcaacgcccgagaacaggcagccggtgacatagacgatgaaatatgtgctcatcgcgttgtagaaggcggcctgaccgaggttgccgcaggcgtaggcgatacgctggccgagcttgcccttcttgcggacgccaccgtccgcggttgtcgtttcgttgctcattttttcttctccttaagattccggagttgaagatcacccattgatcttgcatgtcgagtatacgctctttacaagaaaaagtaaaaaccattagcaaaatatagggtttggcggcgtgttgaattaggtaaaccgtgtaccagcactgtcatatcggtatcaatcagatgcctgatacgttacaacatataccgctgatacgaaggaattaagacgtcaagtaaaaccgatttgctttttttgtaaacaacatttattatctggtaaaggaagttcatcttctctccatcattcacaaagatgtaatgaacgaaagcaggaaaacatggcaaacgaaacccgcatcgaacacgcatccgagacctggctcgccgattcgaccgtattcgaggtcaaccgcgtcccggcgcattccgaccacaaatgctacgcgcacgatccgcagaccaacgaatggtccgatctgaggcagagcctcgacggcgaatggagggtcgaggtcgttcaggcatccgacatcgaattcaacgaggagcccttcgtaagggagaacttcgacgattccgccttcgaacgcatccaggttcccggacacctgcagatggcgggattgatgaacaacaagtacgtgaacattcaatacccgtgggatggccacgagaatccggcggaaccgaatattccggagaacaaccatgtcgccctctaccgtaagaccttcacgatggcgaaccgtctggccgacaccaagaacgccggcggaaccgtctccatcgtgttccacggcatggccaccgcaatctacgtgtgggtcaacggcatgttcgtcggctatggcgaggacggcttcacccccaacgaattcgacatcaccgagatgctgcacgacggcgagaacgtcgttgccgtcgcatgctacgaatactccagcgcctcatggctcgaggaccaggacttctggcgtctgcacggactgttccgctcggtcgagctggccgcgcagccgcatgtgcatatcgagaacatgcagatcgaatccgattgggatccggagtccggcagcgcctctttggacgcggcgctcaccgtgcgcaacgcagccgacgcggccacgatctcggcgacgttgaaggattccgatggtaacgtcgtctgggagaccgcgaactgcgctgaccccgatacctccatctccaccggattgttgaacggcatccgcccgtggagcgcggaggatccggtcctctacgagttcgaggtcacggtcatcgaccatgccggcaacatcgccgaggtcgccgtccagaaggtcggattccgccgcttccgcatcgaggacggcatcatgacgattaatggcaagcgcatcgtattcaagggcgccgaccgccacgagttcgatcccaagcgcggacgcgcgatcaccgagcaggacatgatcgacgatgtggtcttctgcaagaggcacaacctcaacgccatcaggacctcccactatccgaaccaggagcgctggtacgagctgtgcgacgagtacggcatctacctgatcgacgagaccaacctcgaaacccatggcagctggtgcctgcccggtgacgtcctcaccgaggagaccgccgtcccgggaagcaaggcgcattgggagggcgcgtgcgtcgaccgtgtcaacagcatggtgcgccgcgactacaaccatccgagcgtcctgatctggtctctcggcaacgaatcctacacgggcgacgtgttccgcgccatgtacaagcgcgtgcacgacatcgacccgaaccgtcccgtgcactatgagggcgtgacccacaaccgcgactacaacgacgtgaccgacatcgagacccgcatgtatgcgcacgccgacgccatcgaggaatacctgaagaatgatccgcagaagccttacatctcctgcgagtacatgcacgccatgggcaattcgtgcggcaacatggacgaatacaccgcgctcgaacgctatccgaagtaccagggcggcttcatctgggacttcatcgaccaggcgatctacgccacccagcccgatggaaccacgagccttcgctatggcggcgacttcggcgacaggccgagcgactacgagttctccggcaacggcctggtgtttgcggaccgtaagcccacgccgaaggcccaggaggtcaagcagctgtattccaacgtgcatatcgatgtcgccgaggattccgtgaccatcaagaacgataatctgttcacctccactggcgaatacacgttcgtgttgcgtgtccttgcggatggcgaaccggtatggcagtccgaacgccgtttcgacgtgccggccggttcgacggagaagctcgatgtcgactggccgttggatctgtaccgcgacggcgcgtccgaactggtgctggaggtatcccagcgtctcgccaaggcgaccaattgggcggtagccggctatgagctggcattcggccagaccgtcgtcgccggctccaagaaggcctctgctccggtgaagccggtcgacggcatcgtcaccgttggccgttggaacgtcggcgtgcagggatccggccgcgaggtactgctttcccgcacccaaggcggactggtctcctacacgttcaacaatcgagaattcgtgctgcgccgtccggcggtcaccacgttccgcgcgctgaccgacaacgatcgcggcgcaggccacggcttcgaacgcgcccagtggctgggagcaggccgttacgcccgctgcatcggcaacgagatcgaacagatcgacgagaacaccgtcaaggcctcctacacgtacgagctcgccaccccgcagcgcaccaaggtgaccgtcagctacaccgccgacaccaccggacgagtgaatctgcacgtcgaatacccgggcgagccgggcgacctgcccaccatccccgcgttcggcatcgaatggacccttccggtccagtactcgaacctgcgtttcttcggcgctggtccggaggagacctaccaggatcgcaagcatgccaagctcggtgtgtggagcaccgacgcgttcaaggaccacgccccgtatctcatgccgcaggaaaccggcaaccatgaggacgtgcgttgggccgagatcacggacgagaagggccatggccttcgcataagccgcgccgaaggcgccgaaccgttcgcgatgagcctgcagccgtactccagcttcatgcttgaggaagcccagcatcaggacgagctccccgccccgaagcacatgttcctgcgtgtgcttgccgagcagatgggtgtcggaggagatgactcctggatgtccccggtccacccccagtaccatatcccggcggaccagccgatcagcctcgacgtcgatctcgacctgatctgaccggcgcgccccggcggaaaccgggacttggctttcctttcgccatacgcggaaacgtatggcgaaaggacggtgccgtcgtcaagggtggaccttgacatcaaaccggagacggcgccttgaaagggtacggcacgtcttccatgttttccccgtgccgtgccctcgtttccatatcgggaacagggcttgacagactttccttcgaaaacacctcacagatgtaaaagggttcggtcctcgttggcacgtattaagcgtgtcaacgaggaccgaaccctttcttcttaaaccctacctagctttcggggtgaaactgtcccgggcgaccagcttggttgaaatcctcatatgctggttgacggagcgccccatggaaatggcctccgacagcatgaataccgcggccttggccaattcgtccttgttgatgtcatacgacgaaagcgtcggcgaagtgtaattcgcgatctcctggttgttgatgctcaccagtcgcatgtcgcgtggaaccagaatgccggacgccgcgaacgcctgcaagacgcctacggcgatggggtccgccgccacaatcagagcatccgggagcctgtcgccacattcggccacgaacctctctcccaaggcacggccgttctccacggtgaaaggcccctcatcgaacaccaggccgtcgacgtcaagaccgagacggacggtccagttgcggaacgcgaacgcacgcggatcctcgggatactcatggtcgcccatgatgttgccgaaccctccgatgaacccgattcgcttgttgccggcgtccatcaattcgtccaaggcgtccagaatggtctgctccagatccggctgcaccgaatcgaacaggctcggcgcgggattgatgtcgatgaacactccatgcggaaggaccgcgtgcagacgcttcaacatgttccttttgaacggcgccggacctattgagatgaatccggcgtatttggacgcgtccttcatcagggatttgacatcgttgtattccgtcactctcatgcgctcgtccttggcatggcgacgtaatgaaacttcaagctcgtcaaaataggcgtcctgaagccccttgtcgtggatggagttgttcagcaacgcgatgtcttgcggaatggtgacacgttggtagcgggggacgttctcgtaccccatctcaatgctggtgctcagaatcttctgacgggtggcctccttcaccgagaacgaggggtcgtcattgagtattctcgatacggtcgcctgggagaagcccgccttttccgcgatctccctgatcgtggccatggaaacctacctccttggaaattcagcaactaaacgtgtttagtaacgagtttatcatgtttgaaagcgtaattgccatcaatgtcggaaatttcgttttcaatgaaaatggattggctacaatgtattggacagtccgatgaggccattcgtggattcaagctcaatatgctgctgtacgaattgctatcgctgctgtattcgaggttcgtttccggggtacggcggccggaattggtcagatccggaagaaacatcaccatgcagatcatcggatacatgacatcgcaccgcaaacagcatctcgaagcgaccgacgtcgcacgggaatttggatacggcagggaacatttctgccgcctattccgcaaggcgaccggcaaaacgttcaaagaatttctgaccgacctgcgattggacgacgcctgcagaaaactgtcaggttcctctgcgtcgatagccagcatcgcaagggaatgcggtttccccgatacgcgcgcgctgcagacggccgtgcaacgcaaatacggcatacgcgcgcaggaatatcgcgaacgatacgaaaatcgaaactaacgttcaacgagagaaggaggaaatatgactgggcctgcaccaaccatccgtcgtatgaaaattgaggattatccgctggtatacgggttgtggacgcgatgcaccggtttcaccatgagggacatcgacgattccgaggatgcgataaaaacgttcctcaaacgcaatcccgacacctgtttcgtagccgaagacgatggcggaaggattattggagcgattcttgccggtcacgatagcagacggtcgcgcatctaccacacggcggtcgatcccgacgcgcgcggtatgggcattggctcgcttttggtgggccgagtggttgaaacgcttcgtgcgatcggcctgccaaaagtcgccgtcggtgtgcccgcagacaacgatgccggcaacgatttctgggagcatcaggggtttgctgtccgtgacgatttggtctatcgggaactacctctctaatacgacccgtccgacaacgaaccgtccaatacgctcgcactttgtctctataagcccggttccgcacttgcagtccgcaacaaatatgttctgtatatcaaacgtgttcaaagaccatgcagtggaatatcagacggaggaagacccgttcggaacgcttaagagagacgagctgctgtgacgaatggcgatacggcgatgtggtcatcgctgaccttgtcatcgttttctctgaaacatccggcatcctcatctcacacttttatgagcgagtttttgcccttccgtaacatttcatgagggagagccgcccttccatggccacctgtgcaccctatgcaccccttaaaaacggcgccattccgccatgaaatcacccccttcatccgagcatggcattgcgcaccccgtcaaaacatggccgtcatccctggtttcccgatttccacactttttgaaaacccgttttacccgatttccgcacttttccggataccgagcggcactgttccgaccgcgcgactgcatcaaacgccgattccgacgattctacagattaacggtaaaacgtcgcgcggcgacccggccggcttgcggaatggaggtcaggctcgttccgcggcatccttgccggcgagcaggtccttgacccatttctcttcggagagtccgcgctcgaactccttaagacgtccgagcatgtcgtcgagctgtttgttcaaccattcctcgtcaaaatctgcaggcacgagctggaagctcttgcccgcatccggccagatccaatggatatgccaccaattcttaccattcgaccatgtctcaaggcatgggatgcttcggcttattctgtcgtagatttccatccgtttcccgtcaaggccacaggagtcgaagcacagttggcaacgtatttcaggcccgtcatccccgtcttggactttgatctcataaaaatagttgcagcaggttttccaactgctgttcggcccgtcaccatcgggcagaatcagcgacatgagtttggtcctgaatctcgttatgcgcttgccacaatccccctcgtcgaacacaatctcatcgtccttggccttccgcctggcccattctttgcaatgttcgtttatcctggggatcaggtcgtttttgcagttaataatcagatccagcgccctcttgtgtttcttgtagattttcatgcagatacgttcgagttcctcgtctcccaaaatgtccctcctcacggcgtccatgtattccgaaatgaactgagcctgcgccggagccggcccatgagcctcgaccgcctggccgatgatgccgagcacgtccccataccccatggcgagccaatcctcggcatcggaggctttcgacgcgttcctcgcatccggggtgaggaatatgaaccgacgccggtaagccggataagccttctcaacctctccgcagtatctggcaagttggtcgtcatgctcgccggagaagatcttgttctcaatgcaaaggacatagcccgcgtcatagttcaccgcaagaatgtcaatacagtgccattcacgacggatcgagaagccgtcgcagtccataagcagatcgtcgaagaccccgtcgcctcccatccctcgcgcagcgtaatccacgaagccgcggatcacgccgtcgtctaacccatggttctcggcggggtccatgagccaggcgaggacgttgctgtgccggatctcggcgcgtgcaatcccgaggacgtcgaacgcgttgaacccgcgcgtccatttggacagccgatccaggcatccggagtcggcaaggaattcttctagcgccttcctgtcctccttggtggaatcatcttccaaagccatcgccaccctttccggaaaacaatcacagcctgcattccttcatcgggcaggaccgcccaccccgcatccatcttatattcgttcggatggccacccattcatgcgtttcagcgtccagcgttcgaggattttttcgtaccacggcccgtacccgtcgcccgcaacccgtccaaggaaccctatgtgcatgatgtcacgacgtctgacgactccccctgatctccgcgacgcataccacgacgttgtcgggattgaagacgatggcagtgtcgcagcggaccgcgcgccacagacggatgctggcagccggctggcccgcatcgaacgaattcgcacaatcggagacgaacccatttcatacgagcagacctacatcaatcaacggggctatccgtcattcctggagctggattcgaccggcttcatctaccagttgctgcgaacggcctgcagcgccgacatccataccgtcgaggaaaccatcgaagtagtgccgggccatgggccgttgcatccgtcatctaagactgcagaccggagcgccgctgctacgcgtgttctcccgagcgctcgactcggacggtcactcagtggtgctgtcgcagaatacctatccggccaacaaggtgcgtctcacaacatcaaagacgatttgaggaacaacctcatccagcggtctcaatcagctccgtcagccgccagtccagccatgaacagccatttcccaagacggaatgcatcttctggcatgaattcggcaaggaaacgtaagcgtcagacagacgttggcggacgacctataaaagcatggtcatccgccaacgttattcaagaaggaaggtcaggcttgattcacgagaaatcagcccttcgccgccttacgagcagccttcctggccacacgcgcttccttacgggccgcaacgcgcttaatcgtgcccggcatccaacgccacacggagaagaaggcaagcatcgccagaatcacgctacataccgtgttgaacacaatctgtatggtcttcattccattgctgaacttgaagccagcaccaggcaatgcgccgttcatgcagttcgtattcgcgaccgtgtacagcaagtggtgcatggcctgacgtgcgtagtggtaggtcgccgcatcattgaaatcgagtttctctccggtcggatcatcgctcacgttcagcagtttgatgtcggctcccgcctccagcatctggtatgggctcatgaatttgccggtgttggcgttgtcggtgatgatcagaccattgaatccccattcgtcgcgtagcagttgctggatcagtgcatggctgccgccggtccaagtggcgccgatacggttgaacgatgtcatcacacctttggcgatcggagtcttgacgaccttgttctcataggttccatcggacttcttcaccacagtcttcatgtccatatcaccaaggtgcatgcacatgtcgaatggcttcagataaatctcgcggatggcctgttcgttggaccaggttgccacggagaagttgccaggcctgtcaccacggtggttctcctggtcgttaagggcgaagtgcttgatgtagctgtacacgcccttggtggccgcgcctttgacctcgagggaagccatggacccggacatgtagccatcctcggaatagtattcgccgttacgtccggagaatggggtcctgtggatgttcatagctggagcgtaccagccattcgcgccgcccagcagagcctcgttgcccatcatctcgccgaggtcctccgccagttgggcgttccaggtctgggtgagcatcatgatgcttgggaaggtcttgccggtgcctccgtacatccaaccggtggccgaatcagcatcggtttggaacggcttgtccacggatttgatgtagtccacgccgtagccggagaagtagatgagctggttgtaatcgtcctcggtgagctcgtcaaggatcttgtcccattgcgcgtcgtcataagccaatccgcgcatgtcggagaccttcaacccgttcttcttgccgaatgtcggcgtatccatgatggagtccttgtcgacggtggtgccggagtcgtttccttcaagatgtttgatgagtttggtggaagcggtcttcttccacgtgcaggacgcgttattaccgtcggagtccttgcaattaatctcattgccccaggtattgatctcaccggaggattcgccgtaatgcttcgggaaggtaccagtccaatcggaacgggacagataggccacttccggatcggaagccgcatcgaacaggttggagatggccttgccggtggtggagtcggaggcgaatgtagtggtgtccgcatcagtgttctccggtgtccagctggccaccatggtcttgtcaccttccgaagtcatgccgtcggccacggtcttgcctttgtcggcaaggatattgttgaccgcttggttggcgtcggtggccgcggtgaagcgatactgtccagcgtcaaggatgtaggtcttcgcgcccttgtagtcgtatgccttgagctgatccttgccgaaggtgattcgcacggtttcgctggtccccggcttgagttcggaggtcttgccatatccgaccaagttcacggatgccttctcgacggcgttccgcttgtcgtaatcggtgtatggcgactgcgcgtacagttccacaacgtccttgcctgctgtatcgccggtattcgtcacggtcacggtagcgacgaaatcattgccatgccgcgcaacggagaaatctgaccatttgaaatcggtgtagcttaatccgtacccgaacgggtacacgacttccttggcgtaatcgtaatcgcccgcgttgccctgaccgaggaccttgtcctcgtaacgggtctcgtaatacttgtagccgacgtagataccttccgcgtaatccacataattgtatttggtggctttgccgttctcgtcgtaatactggtagctgccgaagttctgcgcggccggtgaggccagcgcatccgcggcgaatgtgtcgacggtcctgccggagggattcacttccccggagaacaccttggcaagggcgttggtgacgttctgcgaatacacgacggccttgatgttcgggtactgcttgagccagtcgagttccatggcagcactggatttgacgagaagaatcacgtccttgtagttgtcattaaggtatttgatgatttcggtttcggtggagtcaagctcgatgtagctcttctccttgtcttcctgcttgtcggcgtggttgtacatggaacgcggcattgtcagtcaatccgatatgaataaactgcaagtttaacggaataaattgtttttaaaacggaatcagaaaaccagatgcgagacttttggatcaacgaagcccagaccatatagccgggagggccgattaagacaaaaacctagagggataaagagttttaaataaaggggcctcctgggggccggaaggcccggccgggagacaggtcccggaggagaggataaaaaaggggcctcccgggagccaaaggctcgaccgggaggcccaacatgtgaagcggcggcgtgctactctcccacaccctctcgagtgcagtaccatcgccgcgcctggccttagctaccgggttcggaatgggaccgggcgtctcaccagggctatgaccaccgcaaaaccgcaatcacggaacgacaaccaaaacatggcggccattccggccattatgttatgaaccgtggcggtctgggaaccggctagcggacgcgaggcaaagcctaccgttgtatcgttcagtgaccatcccaacgcatattgccgtccaggacgatccagcacaggaaagacgcggaaccaatcccgcaaaaggatcggaatgttatgtcgccgtcgcccgttagtaccggtcggctccacccctcacggggcttccacctccggcctatcaaacacgtgttcaacatgcgggctacaacagttcaagaccgtacggaatcctaatcttggagcaggcttcccgcttagatgctttcagcggttatccctcccgaacgtagccaaccggccgtgccgctggcgcgacaaccggcataccagaggttcgtccacccaggtcctctcgtactatgggcaggcctcctcaggattccaacgagcgcagaggatagagaccaaactgtctcacgacgttctgaacccagctcgcgtgccgctttaatcggcgaacagccgaacccttgggacctgctccagccccaggatgcgacgagccgacatcgaggtgccaaaccatcccgtcgatatggactcttgggaatgatcagcctgttatccccggggtaccttttatccgttgagcgatgccgcgcccgtgcgccggcaccggatcactatctccgactttcgtccctgctcggaccgtcgtcctcgcagtcaagcccgcttgtgcgattacactcgacacccgattgccaaccgggctgagcggacctttgagcgcctccgttactctttgggaggcaaccgccccagttgaactacccgccaggcactgtccctgacaaggatgacttgtcgaggttagacgtcaaacgagaacagagcggtatttcaccttgcggctccacgaatgctggcgcacccgcttcgaagcctcccgcctatgctacacaatccgcgcctaacgccaataccaaggtatagtaaaggtcccggggtcttttcgtccttctgcgcttaacgagcatctttactcgtactgcaatttcgccgagctcctggtcgagacagtggggaagtcgttacgccattcgtgcaggtcggaacttacccgacaaggaatttcgctaccttaggatggttatagttaccaccgccgtttaccggggcttgaattcaccgcttcgtccccgaagggattgacggatcctcttaaccttccggcaccgggcaggcgtcagtgcatatacagcggctttcgccttcgcatgcacctgtgtttttggtaaacagtcgctaccccctggtctgtgccacccaccaaagctccggacgcaaggtccttcaccccagtgggtctcccttataccgaaggcacgggagtgatttgccgagttccttgaccaggattcgctcgatcgccttggtattctctacctgaccaccagtgtcggtttggggtacgggcggccatagccctcacgccgaggcttttctcgacggcctggacaaccggatatcgaaccataacggctcccatcatcacacctcgccatgcatgccatgcggatttgcctacatgactggctgcgtgcttgaccacggaaaaccacctccgcggccggctcccattccgtgtcacccctgcgctgacctactgcggctacgctcccaacaccacgcggcgataccaacccgaaggaaggaaccaccacgaggcggaggttagtactcaccgtctcggttttgccggtccatggtcggtacgggaatatccacccgttcatccattcgactacgcctgtcggcctcgccttaggacccgactcacccggggacgacgaacgtggccccggaacccttggtcatccagcggacgggatcctcacccgtctctcgctactcatgtctgcattctcactcccacgaagtccacggccggtttccaccgccgcttcgcccctcgcaggacgctctcctacccagcaaccatgaagattgctgccgcgtcttcggtggtgtgcttgagccccgctacattgtcggcgcggaaccactagaccagtgagctgttacgcactctttcaaggatggctgcttctgagccaacctcctggctgtctatgcgactccacatcctttcccacttagcacacgcttcgggaccttagacgacggtctgggctgtctccctctcgacgacggagcttatcccccgccgactcactgccggaatacacgtcaacggtattcggagttcggctgctgttggtacccaacaagggcccgcaagcatccggtagctctacccccgcgacgcaatcgaccgacgctgcacctaaatgcatttcggagagaaccagctatcacggaatttgattggcctttcacccctagccccaggtcatccccccggttttcaacccaggtgggttcggtcctccacgcggtcttacccgcgcttcaacctgcccagggctagatcatcccgcttcgggtccaggacaagcgactgaaaacgccctattcggactcgctttcgctacgcatacgccacacggcttatgctcgccacccgccactgactcgcagactcatttttcgataggcacgccgtcaccccaccagggaggctccgacggtttgtgggcgcacggtttcaggaactgtttcactcccctcccggggtgcttttcacctttccctcacggtactggtacgctatcggtcagacaggtatgcttagacttacccaacggtctgggctgattcacgcgggattccacgaggcccgcgctacttgggacaacacgatcggaagacggctcacgtccaggtacggggctggcaccctctacggccaggccttcaagcctgttcccctggcaagccgttttatgactcccgcccggcccgtcggaaccgggacacgtgatcccacaacaccggcaacgcaacccccgacgggtatcacgcgcaaccggtttggtctgatccgctttcgctcgccactactcacggagtatcccttcctgcaggtactgagatgtttcacttccctgcgtaccccccgcccataggcggtgccggcccatgacggccggcgggttcccccattcggagaccctaggatcaaagccatgttggaggctcccctaggattatcgcatcctcaaacgtccttcatcggtactgtctgccaaggcatccaccatacgccctcgcaagcggcacaacagcaagaccattgtcccacccgcgggtttcctgatagcaagatcgccagacgacaaatcttaacactaaaatgatcacaaaacgatcgatctcgaaaccaaactcaattgaagagtttggcgaaatcgcgataagcaaaaagaaacgttctttcagtttctcttgctcgcgtccactatccagttctcaaaccaccacgcgccacacgatccgaccagccacccaggaccggccaccacgcatgggcatcgaaccgcgccacagaaaacccgtggggtggcggtccgggagcccaaaagcatacccataccactcccggacatcccgacgggacgtccaagcccatgatctcttccacaccagcatccacaacaacgacgccgactgccggcgtccatgtggctcacactgtccaaaaacatggactgtattctccgtagaaaggaggtgatccagccgcaccttccggtacggctaccttgttacgacttagtcccaatcacgagtctcaccttagacggctcccccaaaaaggttgggccaccggcttcgggtgctacccactttcatgacttgacgggcggtgtgtacaaggcccgggaacgcattcaccgcggcgttgctgatccgcgattactagcgactccgccttcatggagtcgggttgcagactccaatccgaactgagaccggttttaagggatccgctccccctcacgaggtcgcatcccgttgtaccggccattgtagcatgcgtgaagccctggacgtaaggggcatgatgatctgacgtcatccccaccttcctccgagttgaccccggcggtcccccgtgagttcccaccacgacgtgctggcaacacagggcgagggttgcgctcgttgcgggacttaacccaacatctcacgacacgagctgacgacgaccatgcaccacctgtgaacccgccccgaagggaggccccatctctggggctgtcgggaacatgtcaagcccaggtaaggttcttcgcgttgcatcgaattaatccgcatgctccgccgcttgtgcgggcccccgtcaatttctttgagttttagccttgcggccgtactccccaggcgggatgcttaacgcgttggctccgacacggagaccgtggaatggtccccacatccagcatccaccgtttacggcgtggactaccagggtatctaatcctgttcgctccccacgctttcgctcctcagcgtcagtgacggcccagagacctgccttcgccattggtgttcttcccgatatctacacattccaccgttacaccgggaattccagtctcccctaccgcactcaagcccgcccgtacccggcgcggatccaccgttaagcgatggactttcacaccggacgcgacgaaccgcctacgagccctttacgcccaataattccggataacgcttgcaccctacgtattaccgcggctgctggcacgtagttagccggtgcttattcgaaaggtacactcaccccgaagggcttgctcccagtcaaaagcggtttacaacccgaaggccgtcatcccgcacgcggcgtcgctgcatcaggcttgcgcccattgtgcaatattccccactgctgcctcccgtaggagtctgggccgtatctcagtcccaatgtggccggtcgccctctcaggccggctacccgtcgaagccatggtgggccgttaccccgccatcaagctgataggacgcgaccccatcccataccgatagaatctttcccagaaggacatgcatccaactggagcatccggcattaccacccgtttccaggagctattccggtgtatggggcaggtcggtcacgcattactcacccgttcgccactctcacggccggagcaagctccagccgatcccgttcgacttgcatgtgttaagcacgccgccagcgttcatcctgagccagaatcgaaccctccacaaaaaaacttatgcggaaagccaacacgtgactctcatctaagaaaattgacgatcgccttataaggaaaggcgcatcgcacaaaaacctcaccgtccttcaaggcctcccggccactcgcaaggagcggacgatgaactggcaatcattgactataaagaagtagtacaaatacgctcttgagttctcaaaccaccaccgcaccagcagaccgccccaaactcaaggagccaggccgccgtgctgagcagcaagagataaacttacacgagaacccgcaaacgcgcaacccgacgggcatgacgaagcgtgaaaccgttggaaatccaacgttccatcggcgtgtcgaaaacgagccaaacgcgacctgaaaccgttgatgacaccatcataggacgctaaaaccacggccaggtgaacgcgaaaacaacaacccacggcgtgtcggaatcgcaaagccaaatgcggatgaagcgaagacgcgaacaatgcagccatctgcgctatgaacgcgatatgggatccatagcctgacaaccgcaccaatgcaatatcaggaaatacagcgccaagaaaaagcagcacacggatccgaacgaaggcaatgagatgcaaaagccgggaggctccatgttccacggagactcccggcttggtattcaattattggttttcagttatcagccaatcactcggcctgagcgggctctgcagccggctcaatcgtggcgacggccttcttgcggctcaggtagcgcttgatggtcaggaactccagaccgatcacgagcaccgcaaccacgccccaagccacgtacatggcggtcttccagatcggggtggcgaccttcggctcgccattcgcgtactgccagctgttggcggccgtgtacaggatgttgtgcgcggcctgacgcatggccttcacggaagtggcggacttatcggtgatgtggttggtgatcttggtggtggcaagcatcgaatcgttgcccgcacgcacttcctgatcggcgttctggtagccgtagccgccgaagtagtcggtcaggacgaagcctttgaagccccactcgccgcgcagcacggtctgcagcagcgcgctgtcggcgccggcataggtgttgccgatgtagttgaaggagctcatcacggcctgggcgccgccttccttcacgctcatctcgaacggcttcagatagatctcacgcatggcctgctcgttcgtccacgtgcacagcatttccgtacgcttggtctcctggtcattcagagcgaagtgcttcatgaaggagtacacgcccttggacttggcaccggagatctcgctggatgccatcacgccggagagcagcgaatcctcggagaagtactcgaaggtacggccggagaacgcgttgcggtggatgttcatggccggtgcgtaccagccagccacgtgcatgtcgtgggccatgtcgccgatcatctcaccgaactgcttggcgagatccttgttccaagtgcaggcgaatgccgtggaagccgggaagccgatggagccaacgccggtgaagttgttattcagcgatgccgggccgtccgcatcggtcagctggatcttgccgacggacttcagagcctgggtgccatagccaccattggcgatgaggttgtccatatcgtcgaaggtgagctggtcgagcagcttgtcccaatcggcgtcgtcatagtccttgccgtacatatcggacagcttcagaccgttcttggcaccggtggtcggcatcttgtcggaatccttgtcgaacttcttcggatcgtagttcgagttgttgtagaaggtttccttggccttgtcggacatcttgaagttggtcggggcggcggtggcctccttgtagttcgcgaagtggtcggcgcgggacaggtacgtcacatcgcccgccacatcatcgaactggttcgtggccacggtcttgtcgccattgtgggtgttcgaatcggaatcgtaggtgacggtgtccttcacggtgatcgccttgtgatcgatcacgtggtgcgaatcggactggatggagatgtcataatcgcccttctccagcacgtacgccttcgcgcccttgtagtcgtaggacgccatgtcgtcgtcatcgaacttgacggtgaccttctgggactcgcccggctgcagttccttggtcttctcgaagccggccaggttcttggacgccttctcgatgccgccgtcggtgtacggcgggttgtagtaggcctcgaccacgtccttgccggccttatcgccggtgttggtcacggtggcggtgacggtcaccttgccacccttgtacttcacgctgtcgagcttctgatcgaacgaggtgtaggacaggccatagccgaacgggaacgcgacggtgtcatcataattaatcaggccttcgtccgaagcggtctcatagaacttgtagcccacatagatgccttcggagtagttgacaaagcccggaatggcagtgacgtcgtcacccgtgaagcccttgtacttggctgccttgtctgccatattggtgtattcgaacttgccgaagttgttataggacaccgacttggtcagatccttgaggaaggtgtcggaggtcttgccggacgggttggtctcaccggcaagcacctcaccaagggcggagaaaccggtctggccagccggcgggcaccacacgacggactggatctgcggatagtcgttgaggaaatcgaactggaacgtgttcgcgccgttgtagacgagcgtcaccttcttgaagttgctggtgaccaggtcgatcatgtcacgctcggtcttcgacaactgaaggaagctctcacccttctggaagtcgtcataatccttggagttgttcttgtaggtgatacccttcgccttcatgtccgtcggcaggtccgcgccctcgccgccgacacgggtcagcacgaccacggcctcgtccgagaaatccttcgcgtcggagaccagcttgtcggagtactgcttggccggcacctcgggcagggtccaatcctgagcgaacatgccgacctcaggacgatccttgcggtagtccgtgtacagcttgctcagctccgtattggtcttcaggccagcctgcttcatgccgtcaagcagggagacggtcttgtactgcttcgacatggagccggagccggtgccgccgtagacggggttggtggagccccagccgaacacgttgaccttcttgccggacagcggcaggttggaatcgtcattcttcagcagggtgacggcctccgactgcacatccttggccagctcgttggccttggaaaccgtggcgtcggacagcgtgtacttggtgatggtcgcattgttgagcagcgtggaaagcgggccggtcagcatcatggacacggccacgacgatgcctaccagcgccaccagccaggattcggaatggacgatcttacgggtcgccacgtccttgaccgtcttcttgttgacggcgaaggtgatgatcagcgcgagcacgaatagcacgccgatcgcaatcagatatggtgtcaatgaaccgatgacgttcatgacatcagccatgttgatttgcagcatggtctgcctcctccttgattctcataaccaaacgacacattggctccaatgcctttatcggaaccacgaaaccattcaacactgccccgcatctcatggtttcggtgaagtggctgcagatgcgtgcggcaagtgaagacacttcttcatgtcgatgattcgatttcatcagacttcaacgtgcggcacatggcgtttccccagcctgtcaattcgcgtgcataatctgcacgccaagtacgatggaagtatgagcgacttaagcgcattgaatctggaagcaggcagcctggttggcggctacacgttgatttcccggcttggttcgggtgccatgggctcggtatggcgtgtgcgggacgatggcggccatcaatatgcgatgaagattttgcgtgattccctctccgacgacgattccccgcagcggcagcgcgaccaactgaccgcacgcgagcgcctgcgcagggaggcgatggcgttgcagaaggtgcggcatccgggcgtgtgcggcattgtggatatggaacttgacgacgcgttggcttttattgtgaccgagttgatcgaaggcaagaatctgcgtgaggatgtgcgcgtcaatggccgatatgtgggcgacgatttggaacggctggcacgcaagctgattgaggcggtgcgtgccgtgcatgcgtccggcatcgtgcaccgcgatatcaagccgacgaatgtgatggtgtcgagcaccggcccggtattggtggatttcggcatcgctatgggcgaaggcgaaagccatgtgacgcgtaccggtctggtgatgggcacgccggggttcatcgcgccggaaatcattgatggcgcggaatcggatgaaatgaccgattggtggtcggtggcgagcgtattggcgttcgccgctacgggtgagccggtgttcggcacgaagccgatgatgaccgtgttggaacgtgcggcggcaggcagcgccaatcttgcgggacttcctgcgggcacgatggccgcgttccgttcggcgcttaatccggatcggacgaagcggtgcacgccggacgatttgctgcaggcgatcgccgtggatgcgttgaatccgcaggcgtgggttgcggccgacaatggtggcgcagcggatggcgatacggaggcgatgcccccttttgttgaatcgcccgacaatccgcgcacgttgtggcgattgcaggacgatataaccggcgaaaacgccatcggcacgcgcacgatgccaaggctcagcgaagcaacgcaggcgatcgggcagcccgatgtgagcgcaactcaagtaatcgggaaacaagtgaccagccaatccgacgcgagcgcaacgcaggtgatcgcacctgttgacgatgccgagaccagagtgctttccgacgcacttcccaacgtggacagcacgcgcacgatgccgcaatcgcaaggcacgcgggcgatgccgacaggcacacaggtaatgccgcaatccatgccgtcaacacaaatgctgccggcccagaacgcatggaatccagcggaagcgccgacgcaagtcgacccgaccatcaaacccgcgttgcaacgcatcgccatgcggcagccaccgtccgtcataccgcaggccacggtggccgcggcgcagcaatcgcccgcaatgtcattcccgccggtacccggtatggatgggccgaacgttgcggaagcacccaatcccgccgatgtgaagcgtggcgcgatgttgggccggggcatgctcccctgcgcgctgatggcgattcccgtggccgtctgcggactgttctcactgtggacggcgatggcagccgcgttgctgttcgcctgtgcgctggccaccatcggattcaacacggaggcgcagctcgagcgcgaaggcaaacgtggcggcgagaagaaaagttccgactggctgctgcgattggcgggactgccctggcacatcgtgaagggcttcggcgtcgccatcgtgcggacgctgatcatgttggccgtggccgcgctgggtttgtcgctcaccacggtcgtgctgcagcttccgtatgccgtgatggatatgtggatatttggattgacgattccgatgccgacgctgcttggcggtccgctttccgaaagcgggctggcgcaggctgcgttctgcgcgatcggctggcttgtggccgtggccgctccgggcgcgatcgtactgcgattgggcggcggcgcactgcgtaaacagccgtatctgcgccacttgagcgagctgccgacgcaatcgcaaggcaatacggaattcccggcgaatcgatagcaaggcatcgctagtatggtgcccagcataacaacgtgaggtcgaaaggaatatcgatggcccagaacagcaaggatgcgcagaagcgtaccagccgcgccgagcgtagggccgccgaggccgcggcgatgaaggcgcgcgccgagcagatggaaaaggaacgcaagcagcagacgatcatcggcggcatcgtggtggcggtgctggtgattctggtggcgatcggcgcgttcaccgtgtaccacaacatgcataagaaggccgaaacgaaggcttccaccgaaaccgtgcaggaagcgtacacggcgttgcagaaagtgaagaacactccgaagctcgtcgataagaacggcggcctgctgatttccaagaacggctacggcaaggctgtggagggcgcgccgaccgtcgagctctacatggatttcctgtgcccgggctgcggcaacctgcaccgccagttggacgccgacctgcagaagatggtcgatgcggggcagatcaatctggacctgcatttcatggcgttcatggaccgttggtccaccgacgagtattccagtcgcgcggcgaacgcggccatctacctggccgagcatgacagcgacccgaaccatctgatctccttcctggagaaggtctacgccgaggatttccagccggaggaaggctccgcatacaagtcggtgagcgacgccaagatcaaggagcagatgatcgccgcgggtgtttccaaggatgttgcggacaaggcgtttggccgcgattatcaggaatggcttgatgcgatcgacacttacacgccgaagcgttccgaactgtggcatcagtccggcagctacaagggcagcatgaccacgccgaccgtgatcatcaacggcaagtattgggatatggaccagctgaccaccgcccagacgacggttaaggacggtctgttggaatcgatcggcctgaaggacagcgaagtcggcgttgccggcaagatgccgtccatcggagccaagaaggggccgatttccgtcaccacgggcgaataaccccttacgggcagccggcgcgtctcaacccgcaatactaagttgacggcggtggaagcgctggttatgctattcatcgttcctctgttgttttcatagcaaaagaggacatgcctccttagctcagatggccagagcggccgccttgtaagcggcaggtcgtcggttcgatcccgacaggaggctcgaacccgtatgacgggcttggacctcttaccatgggtaagtgctccagaagtcttcccccaacttgagacttctggcaaagcggacgagacgtcccccaacctatctcgtccgaccgggggcaggacatccccttctctcctgccccctttttatttttcgcttttcgcacctgctttcaaaaatgtggcggtatggataaaaccatcggaaagcacggcaaccgttccagctgagccgttacaataacggcgttgtaggcagcgctgaaaagaggataaatgacgagaaggtggacccctcggagattcgtgacgcttcgtcgtgtccgcgtcatggcatgcgtggcctcattgactttgacttcggcgttggcgtttggtgtgggcgcgcgcaaatccgtggcattgaccgtcaatggggagaccaccacggtgaccacatatgcgatgagcgtggaccgtctgctgcaggagcagggcgtgaaagtcaaaacgcacgacctggtggagtcgaccagcccgaccagcatgctgaagaaccatgatgtggtgaacgtgcagagcgcataccagaccaccatcaccatcgacggccaggaagtgccgttctggacggtcgcgtccagcgccgagcagttgctggacttcttcaaccaaaacgaaaccgaagcggcgaaaatcaccgtcaatatcagcaacgtctacaacaagctcaccggcggtctcatcatcaaccagaaggggcccgtcaccgtcatcgcggacggcaaaagctcggtggcgccgaacggcaagctgcccgccgcctccattcttgacgccaaaggcatcacgttgggcaaggaggatcgcgtcagcgtcgaaaaggacggcaaaaagaccattctgcgcgtccgccgcgtgacccacggcgaggaaacacgtacgaaggaagtgccgttcggcacgcagaccatcatcgacccgaacctgcagccgggcgaagtcacgatacggcaggaaggcgaaaacggcgaaatccagcagacgtacgccgtcacctacgtggatggcgtgaaggaaagcgagacgctgaccgaagagaagaccacgaaaatcgccatcgacaaagtcattgcggtcggaccggaaaaaactacggacgataccgacaaatccgacaacagcggcaacggcaatggcgataacggcgattccggcaagacggacgacggcaagaacgattcgggtaagaacgactcgaataaaaacgacaataagtccgattcgaacaagtccgattccgacaaaaccgattcgaacaagtcggattcctcggataagaacaattcgaacaacaactcgaataacaattccaacaacaccaagaaggacgatccggcaccgacccccacaccaacccctgcaccgcagccgactcccgcaccccagcccaaaccgcagcccacgccgcagccgagcaatccttccgcaggctgccgcttgtaccatccttccgcggcacaggcacaggcctacgcttccggcgcggcggcgcagcgcggctggaccggccagaactggacggatctggtcaaactctggaatcgcgaatccggatggagctggagcgcggaaaacgtgtattcgggcgcatacggtattccacaagcgttgccgggcagccaaatggccacgttcggcgcgaattggaaggacgatgccgccgtgcagatcgactggggtctgagctatatcgcacagcggtacggcagcccgtccgcggcgtggcagcactccgaacagaccggatggtactgatccggctaatcgccaacgattttcgtaccggcatgaacggataatgagggaatgacagaaaacgtgaacgagcatacgcagggccatttgctgggggcggccgacatccgacgcatcgccgccgacgcgggtatcagcccgacgaagaaattcgggcagaatttcgtgattgatccgggaaccgtgcgtcgcatcgtgcgcgaggccggcgtgaccgccgacgaccatgtgctggaagtcggtcccggactgggttcgctgacgctggcgattctggaaaccggcgccacgatgacggctgtggaaatcgacccgccggtcgccgaacgcctgccgaaaaccatcgccgaattcatgccggacgccgtggaccgcttccgtgtggtcaaccgcgacgcacttaccgtcaatccggagaatctgcccgatttcaaggatgacgattccttcacgctggtggccaatctgccgtacaacgtggccacgccgattctgctcaccctgttggaacgtttcgacaatctgggcaccttcctggtgatggtgcagaaggaagtggcggaccgtttgagcgagaagcccggttcgaagatctacggcacgccgagcgtgaagctcgcatggtacggcaccgcggaacgcgtgggcgtcatcggccgcaacgtgttctggccggccccgaacgtcgattccgcgctggtgctgttcaagcgctacccgggcggtcacacccccgccgcggacaatgcggacggttccgtggtggatcgcgaaaccgtgttccgtttgatcgacgcggctttcgggcagcgccgcaagaccctgcacgccgcattgaagaaaatcgtgccgtccgaagcgttcgagaaggccggcatcgacccgacccgtcgtggcgagacgctcaccatcgacgaattcgtggcgttggcacgcgcgttggatgaggtgttcgcgtcatgagcaccattgattcgcccgccatcggaacggccaccatcaacgccgtgagcgtggactgcccggcgaaaacgaatctgaccctgcatgtgggcccgtcgcatgccgaatggggcggccgtcatgaactcgacaccatctattgcgcggtcggcgtatacgacaccgtcaccgccacgcgcaaagcgccgggaagcggcttctcgctgaatctcgagggcgcgtatctgggcgacctggcctcttccggcagcgatatgcgccgcaaccacgccgtgctggcattgttcgccatggccgaagcgagcagccatgagccggacgtggcgttgaacatcgacaagcgcatccccgtcggcgcgggcatggccggcggttccgccgatgcggcggcgacgattctggcattgaacacgttgtgggatctcgattggccgatcgaacgcctgcaggaagtcgcggccacgctgggcgcggacatgccgttctgtctgaccggcggttacgcgcgcggcaccggtttcggcgaacgcatcgaacagcttgatgacgatggcgatatcgtacgcgatcttacggaacgtgggtttaccggccatctgctggtcggcgcataccgtgcggaactgcgcacgccggaagtgtatgccacattcgatcagatcggtgccggcgatggcgatgagaaccacctgcagaaggcggcggtctccctgcatccgcgtagcggacaggcgatcgaggaagccttgcgtgcgggagccagccaggcgttcgtctccggttccggcccgtccgtcatcgcgttcgtgccgacggaggatgcggcggacgccgtgcagcgggcatggcaggacagccgttgcgtcgatcgcatcatcgccacgaacgccccagcccgaccgattgtgcatatcaccgcatgacacatatcaccgcatgacagtaaagttgatggcaattggtttgttcaaaaggaattcgtaaatgacccaggctaacgacgagcgcgccgcgcgcaaagagtacattcgccgccgtcagaagacggtgttcagcatcgtcggagccgtcatggtggtcgccatggtggtgtccctgctgttctttttccatgtcggaggcctgggcaacgtcaagtcggccgccgtacagccgaactacggccagcaggcaccgtgccccatcaaggaagccgacggcaacaaggccaagtatgtggagaatcgcaacatcacgctgcgtgtgctcaacggcacgaagttctccggcttcgccaaggcggtgagcgacgcgttgcagaaccgcgagttcaacccccagacgccgggcaactacaccaagaaggtggatcgcacgatgatcgtcttcggcaagaacggcgtgaatcaggcgtacaccgtggcaagcaatttcaccgatgccatgctggttatggacgaccgtcaggaccagctgatcgacgtcatcgtgggcgccacgttcgacaatctgcaggatacgaagaaggttcccgccgcaggcaaggcgatcaccggcatccagggctgcgtcgcggtggacaagatgaccgacctgcccaaggcgcccgagcatgatgcggtgaatccgcaaagctgaccgccaatcgaaatcgatataggcaatatgaaaaacccgcgctcccccaatcgggaacgcgggttttcgtattcgagctgttccatgcatgcggcgaaaccaccgcatgtcaatcgctattcgccctgctccttgtaccagcgttccagctcggcaacggccacgtcacgctccaccggaccgttatcgaggcggtattccagcatgtgcttgtacgccttgccgaccatcgggcctggttcgatgcttagcagctgcatgatctcgtcgccgttgaggtcaggacggatcgcgtcgaagtcttccttttctttcaggtcgcgtacacgctgttccatctcgtccatggccgccgagaacatcatggccttgcgcttgttctgtgtggtcgtgtcggcgcgcgtaaggcggttcagacgctcgtacagcgggccagcgtccttgacgtagcggcggaccgcggaatccgtccacggctcctccacgtagccgtggaagcgcagatgcaggttgaccagctcgctgacgtcctcgaccatgtggtggtcgaaatgcagtgccttcaaacgcttgcgcgtcatcttcgcgccgacggcgtcatgacggtggaagctcaccttgccgcccgcttcgaaacgacgggtcttcggcttgccgatgtcgtgcagcagagccgccagacgcagcgtcaggtccggggccggcaccggaccgtcggaaccggtttcgagggcgacggcgcgttcgatgacgatcatggtgtgttcgaacacgtccttatggcgatggtgctcgtcgatttccagctgcagcgcgggaatttccggcagcacgatgtcggcaagaccggaatcgaccaacgcttcgatgccggcgcgcgggcgatcggacagcagcagcttgaccagttcgtcgcgcacacgttcggcggagacgatttcgatgcgatcgaccatgtcggacagcgcttcggcggtttccggctcgatgcggaagccgagctgcgccacgaaacgcacggcgcgcatcatgcgcaacggatcgtcgtcgaacgactgccgcggatcgacgggggtacgcagcacgcctttggccaaatcgttcgcaccgccgaacggatcgacgaattcgagttccggaacacgcaacgccatcgcgttgacggtgaaatcgcggcgggaaagatcgccttccagcgtgtcgccgtaattgacttccggcttgcgcgagtcggggtcgtacgtgtcggaacggtaggtggtcacctccactttcacctcggtgccgtcctcacgcctgcgcatcgcgccgagcgtgccgaatttgcggcccatatcccagaagccatcatgcccaaaacggcgcagaatatgctcaaactgctcgggacgcgccgatgtgcagaaatccaaatcatgcgatttgcgatgcagcagcaggtcgcggacaggacccccgaccagtgccagttcgtagccttccgcagcaaacatacgtcctaattcaatggcctctggccacacttcgaagttcacgccatacctttcagcaccacaagttttccgtttaccagcataccgttaccccacctgcacacagaattgagtatggttggaatcatgattacgcccgcagaccttgcacgcatgcttgcccatgctgcggacgaccatgcccaaaatccgctggaaccggacgaactgctgtacacatcgcagtcggtttcgctgcagcagctgcaacaactacagcaattgcagcagcgcacgatcatcacgccgagcgcgcctacgccggcgatgatgccgcgccggcgcaccgcggatggtccgaccacgttcgcatcgcttgacgcgcaggagctgccggtggtgcgcgagtattcggcgggcgggctggtgttcgacgacaagggtcgcgtggcgatcatcgcacgtcattcacgcagcgggcatttggaatggtgcctgccgaagggacatatcgaaaaaggcgaaacgccgcagcagacggccgtgcgcgaagtgcatgaggaaaccggcattctgggcgaggtggtcgattccatcgccaccatcgactattggttcaccggtaccagccaacgcgtgcacaagctggtgcaccacttcgcgttgcggcagatcggcggcgagctgaccgtcgaaggcgatcccgaccatgaggccgaagacgccatttgggtggattttgctgatttggacgatgtgctgagctatccgaacgaacggaagatagcatggttgtacgcaaggaaactcaacagacaggcgtaatagtgaatcaatccgcacaacggcacgtttcgcgtggccttcgcgcgttatcatccatcctcgccatggtattgaccatggcgttgatgttgttatacgcacccacgccatcggcaagggccatggaatcgaccacatcggcggagtcgacggacggtatgttgtccatcaactcttccacggccgtattgacggacacctccggataccatctgaacgccacggtgaccaacacgaccggacaggagattcccgcgggaacgctgacgctggccatgaacgccttctacacgttcgtttcgcgcaacgacatccaggattggtctgaaggcaacgggcgaatccccaccccgcaatccgtgggacaggccgatgtgcccgcgttgcagccgggagccagcgccaacgtgagcatcgacgcggacgcccatcaggaatcgctcgcggccatcaactcttgggggccgaagccggtgctgctgagctattccgccaacggaaccccccttgctcaatcgcatacgttcgtgacgcgcaccggcgcgggactccacacgcccagcacgccggcgctgcacatcaccgtcgcccagccgctggccgccaacgggtggaccaccgacagcaagctgcttggacagctggtcgatgaagggggtatttcctcctcgaaactggcgaaaatcgccatgcccagcaaggatgacgacgcacggctcaaatcgttgcagcagaccttcgccaagcacgacatgctgcaggtcgtaggagatccgacctacctgcaggcgatggcgatgccaacgcgggtcgacggcatcacccagcccgcattgttcgacatgaccgcctacagcgccatgaacaacgctccggcctacagcgcagccggtatcaacgaccgtcaatggtccgcagccaaagcccggaaaacctatcaatcggcattgggtgacagcaacgcggacatcaccgcatacgcgtggcagggcaacggcaattggaccctacaagcgttgacgaaggcccgccagcaggggtacggcaccgtcatcgccacgcatgacttcgaagaggacgatgcggataccgtacgtaccggcaagacggtggtctccaccgatgtcggggacatcaccgtgctttccgcgcagaatgtgctttccggcctggcccaaggcaaggcgaccagtgacgatgccaacgccgacagcgagggaaccacggccggcagattggcgcgattcgtcgcgcaaagcgcgttctaccagatggaacagccttatgcggaacgcaacctgctggtctgtctgaacgaggattccgaccccagtgttgtggacgcgctgatgagcgacatcgagcagtcgccgtggctgaacctcaccgatctcgccacgttgaaggatgccgacatctccgaagatgcggccagcatgtcaaccgaccttccccaaacggacggccttaccgatagcatgcgcagcgacgtccagcagactctgagcgcgctggcgaactcatcgagcaacatcaaacgtttcaatacgtcgatcctcgtcaagccgaacggaaaagacgaatccgacgtcaacacctggagcaggcagctgacgaacgcccacaccatcatggccctgcacgcgttgggcggcgaaagcccttccagaagcacgatggcggaaggcgcgaaccagctcgcggccctgctgatcaacggtgtggcgatcacgccgacggaaagcgtgaatgtggtcagcgaaaccgcgaaaatgccggtgaccatcagcaacagccacccgtacccggtgaaggtgaaggtctcgtcgctgaccgattccatgcagatcgtcacgtcccgattcgacaccgtgcaggtgccgccccacggcgaggcacaggtggcgttcaccatccgtgtgtccacgtccggcaccgccaacgccaccatcagcctgttcgacaggaatggtgcagcgtttggagccacgcaggtcacccacatcaccagcgcgctgcagatcagcgacaagagcggtttcgtcatcatcggcttcgccgtgctcttgggcgctgtgggactgtggcgtcaattcaaccgtaagaaggatcccgacgaatgagttcttccgttggccgtaactcactgatcatggcctccggtaccgccgcttcgcgcgtgaccggccaaatccgcaccatcctgcttgcctgggccttgggcaccaccggctatgccgccaacgcctaccaggccggttcgatgattccgcaggtcatctacacgctggtttccggcggcatcttcaacgcggtgcttgtgccgcagatcgtgcgcacgctgaaatcgaaggacgccgaaaccaagctcaacaagctcatcacccttgccatcaccctgttgttgggtgtgacgctgctcatggccgttgccacgccgttgttgaccaaactgtatgtcaacggcagcgccgaaaccatggccctcgccacctccttcaccttgtggtgcatgccccagatcttcttctacggcctgtatacggtgatcgggcagattctcgcggcgaaggaccatttcgtcacgtatgcgtggagctcggtcggcgcgaacatcatcagctgcatcggtttcggcgcgttcatcgcgatgttcggcagggccacggaacgtccgctggacttctggacgccgacgaaaatcgcgctgaccgccggcacttggacgcttggcgtggcgttccaggcgctggtgctgttcattcctttgacgagaatcggcctgaaataccgtccgaaattcggcgttcacggcatcggactgcgttcgatgggaccggtcgccgcgtggagcctcggcatcgtcggcgtcgatcagatcgtcaacatcatcgtcacccgcgtggccaccagcgcgccgttcaaggcttcggaacagctgcatatgagccagttggacgtggccggcaacgcctcgtatcagaatgcgtacaccatctacatgctgccgtattcgctgatcgccgtgtccatcgccactgcgatcttcccgaaaatatcgaaagccatcgcggaccgcaatatcgacgaggcgcgcaaggatctgagctcggccctgcgtaatctcaatctcatcatgtgcttcttcgcagcggcgttcatcgtgcttccgttgccgatcatcctcgcactgctgccgtccatcagcgtgcgtgaggcgctgctcatcagcacgccgctcgccgctttgggcatcggcctgccgctttccagctcgtatctggtcatccaacgcacgttctacgcgttcgaagacggcaagcatccgtttattttcatggcgatcaccatgaccatccagggtggcgtcatcatcgcgtcgacgttcattctgccgcccacgcagtggatcaccgtcatcggattggcgatttcggtgagcttcatcctgccgtatccgctgcttacgcacatgctccgctcccgtttcgacggcgatgtggacgacaagcgcatcatcaccgcctatgcgaaggcgctggtggccacgatagccgcctgcgtgattggcctgctgtgccgcaacggcgtctaccggctggtcggagcgcatatcggccccgacgacggcactatgaactggggtcaggcggttctgtccgcgatactgctcaccatcgtcatcgccatcgtctatctggcgtgcctgtgggcgctgcgtgccgaggagctcacttcggtcgtgggcatgctcgccgcccgcataccagggcttggcaacaagcctaagtctggcggaacggccagccccaacggtaaacttgagcaaagtaccgccgaaaacggcgaccaagaataacagcgtaggtagaacaatcgttacagagttgaaggaaaccatgaaacctcaactgggagataccatcagcaaccgctatgtgctggtttcgccattgcgcgaggaaaccggcttgcaggtttggaaggcaagcgatcacgtgcttgcccgggattgccagctttttatcgtcaacaaccgcaaggctttgcaggacgtcaatgcgacggcctccatgctggcgatttcccacgacgcccatttcacgcaggtgctgcagcttcagcacgtgggcgaggtggcgttggtgatcacgcagctcgatgccggcatgtcgttgagcgagtatctcacgcagtccagcaagccgctgagcttcaccgcgatccgttccattcttggtgaggtcgtcgaagccctgcacgtgttgcagaaagacaatctcacgcatttctcgatcagcacggacaccgtgcgattgacccgcaacggcattgaaatcgccgacgcgccggtaagcatcatgctggccgatacttcgcgcgtgcaatccgtggaaaaccaggagcagcttgcgattcgccaggtcgcttccctgctgtattccctgctgacgcgcacgccgtcgacgctgtccacgaactaccatcttgacgcgatttcaccgaacgtgccgatggagttccgcgtgatttgcaagcgtggtctggatctcaaggagaaggacggtttcccgaccgttccgatggccaccatcgccgaattggaggcgttgctgggcgactacgagccgctggtgaagcttaacggccccgatattgcgttaccgtccgcggattcggaatgctcgattgtgaacgtgcccctgctgcagattctcgagcaggatgccatcgccttgcccgatacgctggctgaaaccggaagcattccggaaatgacgttcgaagcgcctgaaccacacactgatttctccgacagcaaggaagccttggccaagggtatggccgcgaccggcggtgccgtgaaatcgctgtggaacaacagccgcgaactactcagcgaagaggacctcgacggatcctccgaagatgtggattcgccgttctccttccccatccgtgtttccacgccgtcgccgcagggcgattatcatacggacgattcgcaattggagaagaccggtcgcattccggtgatcggacctgacggacgggtcatcgagccgggcgaggaatccgcacgcgcgttgaaggcggagcaggaagcgatcgacgcggcatatcagaacgaaaacggagcccccgttgcggtgccgccgagctttgcccctaaagcctcttcctccagtccggccgaggtcgccaatgccaaattgttcggcaagctcaccaccaaggtcgtggccattgtggtcgcgttcattgtggtggccgtcgcattgggattcgccattcatggtttgaccaagaagcccgatgacggcatcaccaatacgaattccaacaatccgtggccggaaatgaaccttgacgacgtgcctttcggcaataatggcgattccggcaatggcagcagctccgccagcgatgcaaacaacgattccaacgatgccaacagctccgacaacggcagctccgattccagcaagccgaagaaaaccacgaagaagagccattccgccaagaaggacgtcgacaaggtggtgacttcggataagaaggtgcggaaggttccggaaccgaagatgccagagaacacgactccgtatgagatcgacaaccgccagttcctgtccaatccggacggacaacagggttacggttattacctccacctcagccagccccagaaagcgtatcgcatggtcatcaagatccgttcttccggtggccagggctacattcgcgtgaacgccaagtccagcccgaaccagggtgaacaggtcgcccagttcgagttcgacgccagcggcaccaccgaaatcaagttcaacaaggccgtggagacccaggacatcctcttgtgggtgccgttcgacagccttcccggcaaccagctgtacatcgattcggtgcagattttctgacgcatcggcagacaaggagggtgtgcggattgttccgcacaccctctttttgtttcacgtgaaacaacgtgacggatagctgacttttttgaacgcctttttgaacgcttttttgaacgccatctgcaaaaccgcccgcaaccgtcgtggaaactgcattacagtagcaaccatgagtgatatgcgtgatgtggtgattatcggttccggcccggctggctatactgccgcgatctatcttggccgcgccggcttcgagccgctggtcgtcgccggcgcgctgacgcccggcggccagttggtcaacaccaccgaagtggagaatttcccaggctttcccgatggcatcatgggtccggatctgatggacaatatgcgcaagcaggcggaacggttcggcacgcatatcgtttgggacgatgttgtttcggttgcttcgaatgccgattccggcatcaaaaccgtcacccttgacgacggcgacgtgtacgacgcacgcgcgctggtcatcgcaacaggctcaaactatcgtaagctgggcgtgccaggcgagacggaatacgcaggcaaaggtgtatcctactgcgccacctgcgatggtttcttcttccgcaacaagccgattgtggtggtcggcggcggcgacagcgctttcgaagaagctgatttcctgtcccgtttcggctcgtccgtcacccttattcataggcgttccacgttccgtgcttcccgcatcatggtggagcgtgcgcaacgcaatccgaaaatcgatttcatgcttgacgctgtggtgcaggagattcgcggcgacgagaacggcgtgcagaaggtggaggtgcgcaacaccgccaccgaaaagacctctgtaatccccgctaacggcgttttcatggcgattgggcacactcctgccactgcttttcttaacgggcttgtagacgtcgattcagccggttatatcacggtcgatggcgccagcacgcgtaccagcgaacccggcgttttcgccgcgggagactgcatggatagcgtctatcggcaggccatcagcgcggcgggcatggggtgccgcgccgcgctggatgcgcaggcttatctcgattcgctcaagtaaggctcaaatcgttcaaatcattatcgctcgccgagctcgattggctcggttcgttcagctctgctgctgcataagcaggtcgacgatgcgttccatatcgtcttccgatttgaacacgatttcgattcgcccgtgcttcttcgatcccttgatggagaccttggtgccgaaacgctgctccagaccaacctgaacgggggtaccagcccacggattgagcttgctggccttcggcttcttgggctggtcgctttcggcggccttcatcgacacgatttcctcggtgctgcgtacggacaacccctcggcgatgatgcgcgtggccagctgttccatatccgcttccgtcggcagtcccagcagcgcacgcgcgtggcccgcggacagcagtccggatgcgaccttcttctgcacggcggccggcaggttgagcaatcgcaaggtgttggcgatttgcggacgggatttcgacaccgacttggacagttgggcctgcgtcaggccgaaatcgtcgatcatttgctggtaggcagccgcctcttccagtggattcagcgcgacgcgatgcaggttttccagcagtgcgtcacgtagcatatcgtcatcggcggtggttttgacgatggccggaatcgttttcaggccggcgatctgcgatgcgcgccaacgacgttcgcccatgatgagctcgtacatgctatccatgcgcccgtcgaacatgttgtgcggttcggccggtttggctgtggcttccctgcgggcggcttcgatttgcgattgcggacgcttgcgtacgacgattggctgcagtacgccgacttccttgatggattcggctagctcgcgcaggtcgtcttcatcgaaaatggtacgtggctgatgcagattgggaccgacgtcgctcaaacgcagttcaaccagatatccaccctgcacgggaagcagttccggttcatccttcttatgttcggtcggcgtggtttcacgtgaaacactcccctgctgctcgccctgttcggaagctggctgagcggtggagccgaagaacatgtccgcgggatgcgcgctttcgttcaacgaaatcgacggcatgctggcacgacgatgctggtttttcttggttgtttcacgtgaaacagcatgcttcatcccctgcacggcgttcaccgatgcctgtgcggtagcggacgcgctcttggattccacatgctcatcagtcttggaagccttgacttctttggcggcagcggcaggcgccgcatgctcctgatgctgcggctcccccggaagagaaggaaacagtgcgccaagacctttacccaaacgcgacttagttgccatgatcagttctcattccttcttgcatcgattgcctgcagcaccgtatcggaacgacgcgaaagttccagcgcggcttcgcagtacgcgatcgcacccatgcccttggggtcgtatgcgatcacgctttggttgaagcttggcgcttcggaaatcttcaccgtgcgcggaatggtggtgtcgagcacgattgtcggatagtgcttcttcacttccccatgcacttcgcggctcagcagcgtgcgcttgtcgtacatggtgatgagcatcgtggagaccagcagcgacggattgtaatgttcctgcaccagtccgatggtgttgatgagctggcccaaaccttccaaggcgtaatactcggcctgaatcggaatcagcatttcgtgcacggcgcacatggcgttgatcaccagcagacccaggctcggcgggcagtcgatgatcacgtaatcgtaatgctcttcgctggtggcgaggaactcgtccaccgcgttcttcagcagcgagttgcgatccgccatgtcggcgacctcaagttcggcgccactcaaatcgatggatgcggggaccacgtcgaggttgtcgaaatcagggcacgtgcacttgacttccgcgatgcgcttgcgtccttcgatgacgtcatacaccgaaggctgaccggaggcgtgcggggcacccaatgccgtggaggcgttgccctgcggatccatatcaataagcaggaccttgcatccgaaacgggccaaggccgcggacaggttcaccgcggatgtggttttgccgacgccacctttctggttggcgactgcgatcaggcgcgtttgggccggcttcgggcagaccgcatgctccaatgccttgtatcgcgtcgattcatcagcgatttgcgcgcctacgggggatgtcgagccttcgaagattcgcttgatggtttccgtggcggattccatcgacgtcaaattgtctggttcttcaggtccagtcatgaactagccttcctatacatattcaacaatcaagtttcatcatttgggtggacagattttcacctgttcacggccatgtgcaccattgtgaacaacggtggatagttggtggataactcatccgaccacccaaaagttatccacagaacaatcgttgcaattccaagcttcttcaagatgcttcgtaacacatttccgcgattgtggatactgtggataactcacgcgattttgtggataacttatcgctcgtccaccatcagcacatgcgtcggttccagacccggaccgacctcggcctccaccacgcggggatggataccgccgtttttggagatctctttggtggccttgacgatttcctcctgcgcggatcgtcctttcagggcaaccagccgtccgcctttgtccagcaacggcagcgtccatccggatagtttggtcatcggcgcgaccgcacggcaggtcaccacggcaaacggatgcctgaccgggatgggatttccgtcgagatcgacggcatcctctcccctgcccttccggccaccgttcgaaccgcggacggcttcgattacggcgttggctcgggagcgcactatcgagacattgtccaatcccatttcgtcaacgcactcatgaagccattcgatacggcgttccatcggttccaccaaagtgaactggtggtccggcaggcaggcggccgccacgataccggggaatcctccaccactgccgatatccgccaccgtcttgaattgcctcttggccgttgcttcacggatgaacggtacgatggccgcggagttcagaatatgccgttcccaaataataccgacatcgcgtggccctatcagcccgcgcggctctccttccgcagcaagtttcacgtgaaacaccttcaacttgcccaatgcatcgccaagcacttcctcaagaatcggcgacccatccaattcgtcattcacatcactcatgcacaccatcctaatctacaggcatcaaaaagcgccgcgagaaactcgcgacgcttcatgtttcacgtgaaactatttcaggcttcgtcgatctcgtcggcgtcatcggctgcggaagccttgacgtacaccgtgacgtaacgatgcggttcttcgccatgggaccgagacttcatgccttcctcgcgcaccacatcatggatgatcttgcgttcgaaggagttcatcggcttcaggtccaccggctcgccagtctcgcgcgcctcgtcgatggcatccagcgcaaggtcgtgcaggcgctggcgcttgcgcttcagatagccgtccacgtccacgatgaggtgggaccgctcgccggtcttctgttgtacggcgagtcgggtgagctgctgcagggcgtccacgacttcgccgttgcgtccgatcagatgtttgatgtcggtgtcgtcgtcggcaacgatctgcacggtcggacggttgttgcgcacgcccatttcgatatcgccctcgtagtcgacgatgtcaagcaatccttcaaggtaatcggcagcgatgtcagcttcgtcattgagctgatcgatggttttctcagcatcctgcgccatggtgttttactcctttgagcggggttcgtattatttcaagtctactgaaagtctactgaaagtctactgattgggttgtatcatatgggcgattcgcccgatacaaaagcggtgtgtcctgcgtttcacgtgaaacacaggacacacacttgatgttatttcttcttcttctttttgcggcttggctgctgacgctggaagccgttcttttccttcgcctccgcggccttcttggctttctgcagctcctcctcttcgagggacggcagaccggccttggcgcggcgggcgttctcgtgggcgtggtcgcgcttttccttcgcttcggcggccggggatcccggagtcgggaagacgtggatctgccagacggaacgcagcaggttgcagatgttgttggtcaaccagtacaccagcactgcgaacggcatggcgacgccggagaagatgtacatgatcgggaacatccacagcatcatcttctgcatcatttcagtctgcttgttcgcagcgctctgggccatgttgcgcttcatgctgttgtactgcatgagccacaggcagaagcacatcaacgccacgaagatgccgatgatgatcttgccgtggatgtcggcggtggtgaagttctcggccacgttcacgccgaacacgttggtggaggtgaactgcttggcggtggcgatgtcgaaggcgccgaggccggaaccgttcctgaacttgccacgggcgatgtatggaatggccgacagggtgtagaacatgcacatgaacacaggaccctgcacgaacataggcagcatcgacgtgcagccgcccatcgggttcgcgtcgttgtcctggtagagcttcatcatctcgcgttgcaaagcctctttgctggcgggatcgttcttgcctttgtacttgttttggatgcgctgcatcttgggctgcaaaacggccatctgggcctgcatcttgcgcatgcccttcatggacttgtagaacagcgggaacacgcacgcctggaccacaatcaccaggaacacgatggacatgacccacgagaaaccgatctcgttcatgcccagcatcaccatgaatcggtggaatccggccataatctgcgtcatgagccactcgacggggtacaggagcttgtacagccagccccagaaaccactatcgaggaggaattgatcttgattcattacaggccattctccttatcgcctataggttcatctacatccagaggcgtgagacgaggctcctcatgtgccttcgaccacgaacatctgtaaaacaaggaatagagctgtggaacgtcgtcgattcctccacggttccactggttgcaacgaagaaggcgtaataacgcaagaaggccacctttaaggcagccaaatcgttcaatcgcctgaatcgcataactggagcagctgggataataccggcaccgaggtgcggtatgggcggaaatatgtttctgataccagcggatgagccgcaccatccaattgcgatgatgccccttgctcattgtcgggaagcggttttacgtttcaccgcttcgaaacacgatgccatctgctgctcaagcgacaggaaatcggcacgtgcggcacttggcttggcacgcaacacgatatcgcaggattcaggtaatagtgattcgtactttcgtgcaagcacacggaaacgccttttcacggcgttgcgcgtgaccgcgttgccaacagctttggaaacggccaagccgacacggcggccttgcaccgtcgctgtatcgcccgttacgacatcgtcgtgcatcagataatgcacgacgatgtcttctcgcgataccctacgacggcgtttgagcaccgcaacaaaatcgcgatggcttttcagccgttccaccgctctatgccactaaaaaatcaggcagcgagggacttgcggcccttggcgcggcgacggttgatcagagcgcggcctgcgcgggtgcgcatgcgctgacggaaaccgtgcttcatgtggcgacggcggttgttcggctggaatgtcctcttcataattaatgctcccggtgtttttagccatgccaaggcacggctcctcatgagtcaagctctactaaattactctgacccctgaacagattgtcgcgtcgtccatttttcttcacattttcatggggattccccgcataaaacaatccacataatcgttgcgattccgccgaattcccccacaaaagttatccacaaactacaacaatgttattcacatttcaatcttttcaacacgcacgccggtggataactcggggaaaagagagtacaaatatacagttgcacatcagtggtacgtctgtcgagaaaggattatccgtggctgataacacgacaacagatcctctcgagcaggctcgtggggtgtggtccgacgctttggccctgctgcaccagaatccgtcgctgtccgtacgtgacaaaagctggctggagaacgtctatcccgaaggcatgtggggtccgaccatcatgctgtgcgtgcccagtgaggcggctcagcaggctttgcagaccgaattgaacaagccgttgatggaggcgttgcgcgaatccgccgaacaggacatcttccccgccttcaaaatcgttgaaatgaagccgaaaacggaggaacagccggaggaaacctatccgcgcttctcccccgcgaaatcgccggcgaagtcccctgcgaacgagacgatgcagggccagttgccgattcccgcgacgatgccgccggaacaggaccatttccagagcggccagaacaggccgctgctcgaccccgaaacgcatttgaacaagaacgccaccttcgacaccttcgtgcccggcgattccaaccgtttcgcacgtaccgtggcgctggccgtggcggagggttccggccatgatttcaatccgttgtgtatctacggaggctccggcctgggcaaaacccatttgctgaacgccatcggcaactacgcgctggtcaaggaccccaatctgaaggtccgctacgtcaccagtgaggaattcaccaacgaattcatcgaggctctggccgatacgaaccaaagttccggccagatcaaggaattcaaccgccgctaccgcgaggtcgacgtgctgctcatcgacgatatccagttcctgagcggcaaggacgcgacccttgagcagttcttccacacgttcaacaccctgcatcaggccaacaagcgcatcgtgatcgcctccgatgtgccgccgaaggacctgcagggcttcaacgaacgtctgatctcccgcttcgaatcgggcctgaccgtggacgtcaaaccgccggatctggagacgcgaatcgccattctgcgcatgatcgccaccatgaacggctccaatattcccaacgacgtgttcaacctgatcgcggaacggttcaccgagaacatccgcgagctggaaggcgcgctgaaccgtgtgaccgccatggcgtcgctgagcaaccagccggtcaccaaagcccttgcggagcagactttgcaggacttcttcaccaccgacgtggagatcaagcccgcggacatcatcacgcaggtggccaagtacttctatttgacgttcgacgacatcgtcggccgttcgcgtaccaagaagatcgcgctggcacgccagatcgccatgtatctggtacgcgagctgaccagcatgagcctcaacgacatcggcctggtcttcggcggcaaggaccacaccaccgtgatgcacgcgtatacgcgcatcaacgacgagatgcaggagaagcaggagatctacaactacgtgaccgagttgactctgcagctcaagcagcgttccaacgacaagtaacggaagcaaccacaacaaacggcgtatttccaacggttttccttaggctggtaaattatttaccagcctttttactatccgcgtgacacgcccggacataatttcttgtacatcgagttttccacatacatatccacatttcggggaaaggtctgtggaaaagccgttggaaacacggaaaacggcagtggatgactcgtggattattcacagtgaattgtggataagttttgcgcggccatgagcctgtggataacccatgctcttatccacattcgactcagaagttatccacaggtgacgtctcgtactgaagcgttgctgcacttgggctacgcgagcttatccacactatccacagggcttattattacgaaagtacgtttttcttactttcatcgtcattctcgtaatgcggggaattccccacgctttcgtcgtcgttgctcttatcgctagaatggcatgtggatcgaacgaaacgaggaataccccatgaaagtcgaagtcaattcccaagctcttgccgatgccgtggcatggaccacacgtgtcatcgacgcacgtcccgcaaccccgattctggcgggcatccgtctggaagccattgacggcacactccagctttccgccttcaactacgccatttccgcacgccaccacatcgaagccggcgtggacgaggccggtagcgttctggtgctgggcaaactgcttgccgacatcaccaagtcgctgcccgctgcgaaaacctatctttccaccgatggttccacgatgaccatcacgtcgggcaagtcgaccttcaccatgcagctcatgccggaaagcgaatatccggatctgcccgtggtgccgacgaaactgggtcaggtggactcccccaccttcgctcaggccgtcaaccaggcgtccgtcgcggtctcccgtgaggagaaccgtccggtgctcaccggcatccgcgtccagttccagggcgacaaggtcatcatgagctccaccgaccgtttccgtctggcccgttccagcttcacctggacgccggaggatgcgaccatcagcaccaccgctttggtccgtggctcgctgctgcgcgacatggcacgttcgctggacgagcatcagaacgtcaccatcgatttcgatgcggacaacccgtccctgctgggcttcgagaacgccggccgcgtgtccacctcccagctcatcgacggcgaattcccggccgttgaccgcctgtatgccgatgaatacccgattcatgccgtcatcaacaagcaggccctcatcgacgccatcaagcgcgtttcgctggtcgccgaacgcaacgccccgatccgcatggtcttctccggccaggagctgacgctgtcggccggcaccgccgacgaagcacaggcgaaggagattctcgacatcgacatggacggcgaggacatcaccgtggcgttcaacccctcctatctggtcgacggcctgagcgccatcagcgagccgttcgtgcgcatgaagatgaccaccgcggtcaagcccgtggaattcaacggccagcaggaagcggattccgacgaatccatggactaccgttacctgctcgttccgatgcgcttcaacaactgatttcgttccacctgtggcccggacggcaagttcccgtccgggccaccatgccatcaccttcaaggaatcccggttttcatgcatatctcccgtctcgcgctcgaccattaccggtcatgggaccattgcgtgcttgatttcgaaccgggaatcaacattctccaaggctcgaacggcctagggaaaaccaatatcgtggaagccgtggaagtgctgtccaccggctccagccaccgcacctcgtcatcgctgccgctggtcgaaaaaggccacccttccgccactgtccgggccaacgtcgaagatgcgggcgaacagcgcacatatgagatcaccatcgccgcgcgaggcgccaacagggcgcgcgtggacggcggaaaatcgcaatatatgagggatatcgtgggttgggtcccctccgtgtcctttaccccgaagaccagcggttggtgtctggcgatccggccacccgacggaacttcctcaaccaggcggcttcgctgctgttgccccgttatgcgcagtcgttgcaacagttcacgcacgttgccaaacagcgtgccgcattgctcaaacagctgtccgacggctccggcatcgatcccgaatacgggcgtcaggccgtgctgagcggtctggaagtgtggaccggccaattcatcgccctcggcgtgcaattgaccaaggaccggaacgatgtgatcggactgctgcgcgagccgttcacccgcatctatgcttcgttggcgggcgaagaggaacaggccgacctggtgtatgagccgtccttcgacgaggtgcttctgttcgacgagccggccgcggaaatcagccgtcatttccaacgcatctaccccggcgaagtggcccgtgggcagaatctgatcggaccgcagcgcgatgatctgacattgcggctcaacgacatgccagcccgcgaattcgcttcgaacggcgagatgtggacaatggcgttggccctgaaaatggcgctgtacgaagtggtttcggcgcagcgcgacgtcaagccgatcgtgatactcgacgatgtgttcgcccagctcgacgagtcccgtcgcgggcagatcctcgacttcgcgcgacggcaggaccaggtgctgatcaccgtcgccgcggcaagcgatattccgcaaggcgaggcgcatgtcatcgacgttgccgcgctgcgtgcgcaatcgcaggagacggacggcgatatcgcggcgatggcggccatgcttgccgccggacgtggcgcgcaatcgcaaggaatcgaggccgaatcctaatgccgaaaccaccaatctgcgaactgctgaacctcgaccaacgcaaactgccggccgaagtgttcgaccgcatcagcgaccgtgccgggcggctcaaggaacgcgaggaacgcgcgcgcaaggcgtgggaaagcttcggcaaacccggacgcgatccggaaaccgtcggcagcctgttcaatctgctggcatcgaacggcgcatggataccccacctcaaaatggcgcagatgcgcgaccattgggaccaggtggtgggcgtggagaacgcgaagcactcctaccccgccagcctgcgagacggcgtgctgacgatacgttgcgacagcccggcctggaccaccaccctgtcgtatatgacgccgttgctgacggacaccatccgcaggaaactcgaaggtctgaccatcaatgaggtgagggtcaccggcccgcagagccaagggttcagccgtgggcgtatctcaaggaagattcgctactgagggctattgcgaagtcgacttacaatcgacctctctgacaggagagatcgattgtggcgcgcgtgaaacaggccgttgcgacggggtttacggaggttttccggctcgtcggacgcgttcggaaccatgccgaagccgttgaaaaccgttgaattccaaggacaaatgtctatagcgcgctgtccccctccatgagtagaatatccagcagtgtatgtaaacgcctagaaggggcctttatttgcgttctaggtggtatcacctgcggaaatgacccttgatggcgggaaaaatgcaggaaggaatctctgtggcagaccttgatgcggattcgctgaacgaatcagctgaaaacacgcaggaagatcagattcaggatcagatccagaacgaccagctcgaagatgcgcaacttgacgattcgctgtctccggaacactacgacgcgtccgatctgagggtgctggaaggccttgaggcggtgcgtatccgcccgggcatgtatatcggctccaccggccctcgcggcctgcaccatctggtgtatgagatcgtcgacaactccgtcgacgaggcgcttgccggctacgcgtcgcacatcgaagtgacgattctgccggacggcggcgtgcgtgtggtggacgacggccgaggcatcccggtcgacgaagtgccgggtgaaggcatctccggtgtcgaaaccgtgatgaccaagctgcacgctggcggcaagttcggtggcggcggctacgcggtttccggcggcctgcacggcgtgggcatctccgtggtgaacgcgctgtccacccgcgtggacatcgaagtgcgccgtcagggcttccactggacccagacctacatcgaccagaagccgaccgcgcgtctgctcaagggcaagccgatggaggaaggcgagtccaccggcacttccgtgaccttctgggccgatggcaagatcttcgaaaccaccacctacgatttcgagatcctgcgcaaccgcttccagcagatggcgttcctgaacaagggcctgaagatctccctgaccgacctgcgcgagcccgaccaggccggcgacgaggtttccggcgaggaatccgaaaccgaagacaagttccagaccgtcacctaccagtacaacgacggcatcaaggactacgtcgactacctggtgaagtcccgcaaggccaccccggtcgaaccggacgtcatcgacttcgaggccgaggacctgaagatcggcatctccgcggaaatcgccatgcagtggaccaccgcgtattccgaagccgtgcacaccttcgccaacaccatctccaccaccgaaggcggcacccatgaggaaggcttccgcgccgcgctgacctcgctggtcaaccgttacgcccgcgagaagaacatcctcaaggacaaggacgagaacctgtccggcgacgacgtgcgcgaaggcctgaccgccgtcgtgtccgtcaagctcaccaacccgcagttcgaaggccagaccaagaccaagctcggcaactccgaagcgaagaccttcgtgcagcgcgtcatgaccgacaagctcggcgactggttcgacgcccacccgaacgaggccaagaacatcatccagaaggccatcgaggcctcccgtgcgcgtctggccgccaagaaggcacgtgagaacacccgccgcaagtcgatcttcgaatcggccggcatgccggacaagctcaaggactgccagtccaacaaccccgaagaatgcgagctgttcatcgtggagggtgattccgcaggcggctccgccatccagggacgcaacccgatcacgcaggccatcctgcctctgcgaggcaagatcctcaacaccgagcgcgcaagcctggaccgcatgatgaagtcggacaccatcgaatcgctgatcaccgccgtcggcggcggctacggcgaggacttcgacctcaacaaggtgcgctaccacaaggtcatcatcatggccgatgcagatgtggacggcgcgcatatcgcaaccctgaacctgacgctgttcttccgctacatgcgtccgatgatcaccgccggctacgtgtacgtggccatgccgccgctgtaccgcctcaagtggaccaagggcccgcacgacttcgtgtacaccgacgccgaacgcgaccgcgtgctcgccgaaggcaaggccgcgggccgccagctgccgaagggcgaaggcatccagcgctacaagggtctgggcgagatgagctaccaggaactgtgggagaccaccatggatcctgaccatcgcattctgaagcaggtgcagatcgaagacgcggccgcggccgacgagaccttctccatgctcatgggcgacgaagtcgaaccacgtcgtctgttcatccagcgcaacgcacgcaacgtcagctggatcgacgcgtaaacgcgtagggtttcgcaggacttcaaagcaaggattagaaattggcagacgaaaacaacagcaacgaagacggccagttcgtgcctgacggctccatggaaccgttgagcccgcaggaggccgacaacaccgattatggcctgatggtcggcgaacgcgtccagaagaaggatctgcagcaggaaatgcgcgaatcctatctggcgtacgccatgtccgtcatcgtcgatcgtgcccttccggacgtgcgagacggcatgaagccggtgcaccgccgcgtgatctacgcgatgtacgacggcggctaccgccctgaccgcggctactccaagtgcgcacgcgtcgtcggcgaagtcatgggcaagtaccatccgcacggcgattccgccatctacgacacgttggtgcgtatggcgcagtcgtggtcgatgcgatacacgctcgtcgacggccagggcaacttcggctcccccggcgacgacccggcagccgcaatgcgttacacggaatgccgtatggcgccgctcgccatggaaatggtgcgtgacatcgacaaggacaccgtcgatttcctgccgaactacgatggcaagacgcaggagccgaccgtgctgccggcccgcttcccgaacctgctgtgcaacggctcgtccggcatcgccgtcggcatggcgaccaacattcctccgcacaacatgcgcgaggtggcagaaggcgtgcattgggcgctcgaccatccggacgcgagccgtgaggaactgctcgacaacctgatccgcatcatcaagggaccggacttccctaccggcgccacgattctcggccataagggcatcgaacaggcgtaccgtaccggccgtggcctcatcaccatgcgagccgtggtgaacaccgaggagatcaagggccgcatgtgcctcgtgatcaccgaactgccgtaccaggtcaacccggatcgtctggtcgtgtccatccgcgaagcggtgcgcgacggcaagatccaaggcatcgccgacatgcgcgacgaaacctccggccgtactggccagcgcctcgtgctcgtgctcaagcgcgacgccgtgccgaaggtcgtgctcaacaacctgtacaagcattcccagctgcagcagaccttcggcgcgaacatgctggcactggtcgacggtgtgccgcgcacgctgtccctggatgcgttcatccgtcattgggtaaaccaccagctcgaagtcatcgcacgccgtaccgcctacctcaagcgcgaggccgaggaacgcgaccacatcctgcagggctatctgaaggcccttgacatgatcgatgaggtcatcgccctcatccgtgcctccgagtccgcggagaccgcccgcacgggccttatggacctgcttgacgtggacgaggtgcaggccgacgccatcctcgccatgcagctgcgccgactggccgccctggaacgtcagaagatcctcgacgagcacaacgagctcatgcgcaagatcgccgactacaacgacatcctcgccaagccggaacgccagcgcaagatcgtcggcgacgagctggacgaaatcgtcgccaagtatggcgacgaacgccgtaccaagattctgccgtactccggcgagatgaacgtcgaagacctgatcgccgaagaaaacgtggtcgtcaccgtgacccactccggtttcatcaagcgcaccaaggccgacgaataccgcgcgcagcaccgcggcggcaagggcatcaagggcgccaagctgcgcgaggacgacgtggtggaccacttcttcctgaccagcacgcacaactggctgctgttcttcaccaacaagggccgcgtgtaccgtctgaaagcatacgagctgccggaaggctcccgcgattccaagggacagcacgtggcgaacctgctgcagttcggcccggacgagacgatccagaccgtgctgtcgattccgaactacgacgtggccaagtacttggtgctcgccacccgttccggcaaggtcaagaagaccgcgctcgccgaatacgactccccgcgtcagggtggtctgatcgcggtacgactcatgaccgacgagaacggcgagaacgccgacgagctgatcggtgccgcgctgtgcaacgccgacgacgacatcatcctcgtctccaagcagggcatgagcctgaagttcgaagccaacgacgagcagctgcgcccgatgggccgccagaccgccggtgtgcagggcatgaagttccgcgacggcgacgagcttttggccatggatgtggtgcagggcgattccgacagggatctgctcgtggtcaccaacgagggcttcgccaagcgcaccgccatcagcgaataccgtctgcagggccgtaacggctacggcgtcaaggccgtgcagctcgccgaaggccgtggctccctggtgggtgccgtgatcgtggaggaatccgaccagatcatggccatcatgaagtccggcaaggtcatccgctccaacgtcgccgaagtcaagcgcaccggacgtaccacccagggtgtgacgctcgccaagcctgacaagaacgacgaaatcatctccatagcacgtaacgaggagaccgacgaggatgatgccgagcaggccgccgcggaaaacggagcagtccagaacgacgcagccgcgcaatcgcaagccgaaaccactactgaaaactccgctgaaaccggtacggaagccacttccgatgccggcgatggcgagaatgtagaggcctgagacacaggcggggaatcgtctgcgaaaactggtagcctcggctagaagtaggcaagattctgcaaggagcaacgatgagcgagaacaatgaaagccatcaggcgcaggcaggggcgcaggccccacgcgtggcccgttccgcatccagccagccgttgagcggtacggaacagtctcaggcgcatgagaacatggccgccgcgtccggcggtgtgaaggttcgtgaaaaagcgcgtcgtggcgcgcctcgcgcccgccgcatgagcctgtccctgacccgcatcgacgcatggtccgcggccaaggtggcgttcatgctttccatcgcgggaggcatcatccagatcgtcgcggtgacgctgctgtggctgctgctgaacgtggtcggcgtgttcgatcaggtgacgcagatcgtgtcctccaccggtcttgacgccggcggattcgaccttgccaacgtgctttcgctgagcaccgtgctgagcgcggtcaccatcttctccatcatcgaagtggtgctgttcaccgtgctggtggtgattctcacgctgctgtacaacgtggtgagcacgctggtcggcggcatccacgtgacgctcggcgacgactgatcgattcgtcatacggcgttcgtacggcgcttgcgcaacgtaagccgttcgtgcaacataagaagacggcgcttccctacttcgggaggcgccgtcttttcttatgtaatcgcgattatgcggtcgcttttatgcaatcgtcatactgcgttgcgcgttatgccgtaacgcatatgaaaacggtccgtgcgaacgaatcgcacggaccgttgaaacggattgtgaaagacgatcagagcacgccctgggcgaccatggcgttggcgaccttgacgaagccggcggcgttggcgccgagcatcagatcgccctcatggccgtactccttggcggcggccagggaattggcgacgatgttctccatgatggacttgagcttgttgtccacctcttcgaacgtccaggaaaggcggtaggagttctggctcatctcaaggccggacacagccacgccacccgcgttggcggccttagccgggccgtacagcaggccgttgtcctgatagacggcgattgcctccggggtggacggcatgttggcgccttcgcacacgaccttgcagccgttggcgacgagggccttggcggactcctcatcgatttcgttctgggtggcgcacggcagcgcgatgtcgcacggcacggtccacacgcccttgcagccctcgtggtattcggcacccggaacacgctccgcgtactccttgatgcggccgcggtggccgagcttgatgtccttgacgatgtcgagcttgatgccgtccggatcgtagacgtagccgttggaatcggaggcggtgacgaccttcgcgccgagggcctgggccttctcggtggcgaagatggccacgttgccggagccggagatgacgacggtcttgccttcgaaggaatcgttcttcaggacgcgcagggcttcctgggtgtagtagcacaggccgtagccggtagcctcggtgcgagccagggagccgccgaattcgaggcccttgccggtgatcacgccggagtattcgtcgcggatacgcttgtactggccgaacaggtagccgatctcacgggcgccgacgttgatgtcgccggccggaacgtcggtgaactggccgatgtgacggcacagctcggtcatgaacgcctggcagaaacgcatgacttcggcatcggacttgcccttcgggtcgaagtcggagccgcccttgccgccgcccatcggcaggctggtcagggagttcttgagaatctgctcgaagccaaggaacttgatgacgccctcgttcacgctcgggtggaaacgcagaccgcccttgtacgggccgatcgcggagttgaactggatgcggtaaccgcggttgacctgcaccttgccctcatcgtccgtccaggcgacgcggaacttcaccacgcgctccggctcgacgaggcgctcgagcacgcccgccttctcatattccgggtgcttctcaacaaccggctcgaggctttcgaagacctcgcgaacggcctgcaggaactccggctggtcgccatcgcgcttctcgacctgcgcgtacacgcgcttgacgtactcatcagtgagcatatttttccccttcgggatagttgggttatcaatacggcggtttcattctatgtgcttgactgtgagacgcacaagatattgctcaagatttggctggaggcgtttggaacgccataggatagtgtgtggaaggcgaggagagagcgtcgtccgcaacatcaactccctcatttcccacaggagaaaaaccatgcttgaaggattcaagaagttcattgcacgcggcaacatgatcgacatggctgtcggtgttgttatgggcggtgccgtcaccaccgtggtcaattcgatcgtgaacagcgtgatcaacccgttcatcgccatgattttcggcaagccgaatatggacggcctgctggcgatcacgttcaacggcgcgaccgtctcgttcggcgctgtgctgggcgcgattctgaatttcctgattatcgcggccgccgtttatttctgcattctggtgccgattaacaagttccgcgacatgaccgaagcgctgcttgccaagaccaagcttgccgagcagaaggaagccgaggaaaaggccgctgaagagccgtctgccgaagagcagaccgtccagctgctgcagcagattcgtgacgagctggccaagcagaacacggcccgcaactagttgcgattcgtggtgccgctcccctattgatttgatgattccggccgcttgtgggtatgcgggcggccgttttatttggtttgcgggcgatcgcgtccgttggatggtcgacaagaggctgaatacgaaaaaggcttccgattactcggaagccttcaattctgtggagctaaggggattcgaacccctgaccctctccatgccatggagatgcgctaccagctgcgccatagccccgtggagctagccgggttcgaaccggcgaccctctgcttgcaaagcagatgcgctaccagctgcgctatagccccataggtgaaaaaagcggctatgccgcttccttaccatctacgtgggcccgggaggacttgaacctccgacctcatccttatcagggatgcgctctaaccacctgagctacgggcccaacttgctgtgtcttgaacacaacgaattgaaatgatacttgaatcacagggaaagtcaagtgccgccgtgtcatcggcgtgtcgtggcataatgcaggcatgacatacgggcagcgcaacggcggtaacggccgttacggcaggggagtggggcatcgcaaccgcaatcgcgtgatttccgaaacgacggcgagcatcgccggcatgcgggtggccatcgtgcgcaaacccatcaaaaacatgtacctgcgcatcaaaccaccgaacgcggatatcgtcatctccgcgccgcaacgaatgtcgcaaagcgctatcgaacggtttgtaacggaacgcaagccgtggatcgaacgggcgcaacgcagcatgcggcaggccagagacgcgcaactcaacgcgcagcgtgcgcaaaacggcaatattggcgatactggcgcttccgccaacccgcccgctttcgtatggacggacgaggccaaggcgcgggcgcaacgcaacatcgaatcgcaattgcctgtgttgcttgccaaatggggcccgatcgttggccgtacgccgacgcatatcacgttgcgtctgatgagttcgcgttggggatcgtgcacgccgaagaccggacgtatccgacttaacctgcagcttggtttaatggcccctagattcctcgaatacgtgctggtgcatgagatgacccacctgtgggagaacggccacggagagggctttcaaaggcgtatgagcgcctatctgccgcaatggaggcagttgcgccgcgacatcaaccggcaggtggtgctgtaagaggccgctcgggttacttggcgtccgccgcggaatcgccagccgcggaaccgtcctcatcggcggtgtgccgacgcacttccagcgtttcgatacgacggccgtccacttcggtgacgaccatgtcataaccgtcatcggatgacagcacgtcgccgacctcgcccattttgccggtgtgcgccaggaaatagccggcaaccgtctcgtacgggccgtcttccagctcgatgccggtcaaatccgcgaaatcctcgatcgtcatgccaccttcgatggtggccacgccattgacgaaagcggcgcgttctgtgcgttcgccgcccttttcctccggcaggtcgtattcgtcgcggatgtcgccgaccaattcctcggtcatgtcttccaacgtgacgatgccgtcggtgccgccgtattcgtcgattaccacggccaggtgaatgcctcgtttgcgcagcagctcaaggcttggcagcagcttcgacgtgcccggcagggaaatgccctcacgcgtcacgtcggcaacggttctcgccttcggatcgcggatgtcgagcaggtcgcgcacgtgcacgaagccgagcacatcatcgaaatccttgccggtgacggggtaacgcgaatacggcatttcacgcacgtacgcggcggcttccgcaatcggcatggagccgtccaggaacgcgacgtcggcacgcggacgcatgacctccgccacaatggtttcggatgcgtcgaacacgtcgtcgaggatggtgcgctcgtccttgctgaggttggtgttggtgttgacgagcacgcgcagttcgtcgtcggacacctcgctgtcggtttcgttcggatcgaagccgagcagccgcacgatgccgttcgtgttcttgccgatcagccagatgatcggcttgcacactttggcgaacacatggatggccggcaccacggcacgcgcgatctgctcgttgcgttgcatggcgatacgcttcggcaccagttcggaaatgacgatagagcaatacgagatgatcagcgtcaacgcgatggtggtcaggggagcggcgacgttatgcggcacaccccagtcttcgatgaccggcacgatatacggggcgattgaggattcgccgaacgacgcggacaggaagccgcacagcgtcacgccgatctgcacggtggacaggaacgtgttcgggtcgcgtgcgatctgcgccacacgcttgccgcgcgcatcctcctgttccatctggtcgatctgcgatccgcgcaggctgaccagcgccagttcggtgccggcgaacacggaaccgagcagcaggaaaatgaaaatcagaaggatgttcaaaccaagcgacatgattccaatctaaagcaacggcatgtcaaaacagcgcgacgcaacggatccggaagccgtctttttccggaaaacgtcagaagctcaatacttcgacttttccggtgtcgagctggtagcgtgctccggtgatcatcagccggtcctccgccagcgcgtgctgaatcacctcggactgttccaccagttgctcgatggtgcgtgcgatgtgcacgcgctcgaaatcctccgtcgattccagctccgactcgtgcgcctgccagatcgaaaaaccgacggtgcgcagcatcagcgatttcgcgttcagaatacgttcgtcaaggtcggcaacgctgtcagcggccatcagcgaatcctctgcgtcggcggtcaactcgtgcaacaacgcctcgtattccttgcatgcctgcttgatcgcgccgcaattctgatggccgagcaccaccaaaaggcgcacgccgagcacgtccaccgcgtattccaaagaggcgatcacagcatcgtctatgacctgccctgccgtgcgcacggtgaacagatcgccgatgcctgcgtcgaaaataatatcggggctgacacgcgcgtcggagcagctcagtatggccgcttccggctcatgcgtgtcgatagtcgcctcgcgcgcttccacgctgcggttcggatgctccagcttgccttccgcgaatctacggttaccggccagcatacggctccacacgccgcttgcggtgccttccacgtcgttctggttcacaaatggttcgtccgtcattgattccacctctttgtcatttcatcacaggctatggttcatcataaacggtgtttctgaagttgtttcgattgaatcgccatctaaggcaggggctgcggacgttttcttggagataatcacgcagctattccttggctctgacggtatcgtgccggactcatccaaccgagcgactgccccgggtgctaaatagacgtgcaacgccttgtctaggtttggaagtgttcagtttctaatttaagaaggcgttgcgcttacaagttgaatccgggaacgcgagcggggaggcccgcgccgtttatcggcacggaacctccccgctcgtatcatccaggcggtcagccgaaaatcagcccgtgttctgcaggcctgctgcgacacccggcgcctgatttgggcgttgccatatggattcagcgatgatcattgcacttcatgtaactgcaatatttgctgttattcattgaaattcttgatacaacgatgttttattggtatgaaaaaatgctttgaaagttgcggcgaaagagacgggacctcctttgacaaccgcatgaaaagttcctttgctaagaacattcagatttccttcaaaccaggaataatttggagaccattggaaaacacagaccccggtctggtatgagcttccaagcaaggattttgaggtaactttgtaattcgttactgtagctcgaaaatcttgctttacccaacaagctcctcctgctgggactccagaaaagacgcttgaggtatatgttgccgtaccgcgtgtgcttgcgtttttggtttctctggtattagaggctgtatcttcttcgtatgctttcgcaatagattcagcgtatagattggcgtcaccgtggtattcatcaatcgtactttgaggagcatcgattttaaattcgccgaattcgacgtctaagttattcgtggaagcaatgttagagagtttttcttgcagagcgacttctgcagaagaattgaaggcgcttcggtcatgtccagaagtgctagccattgctgatggggtaccagagaacgccagtattgccaccagtactgtggtgaacgcgatttttttatgaaggttcattcgtagtctcctttggcttcgaaagtattttttatccagtgatgcgtctttgcgtcactttagttctatctattctatactgattatcgttgttctcataattttgtcggcgaaggtttgtcctttggtgtcccataaaggccaaagaaacccaatgaaacatggcacgaaatcaacgcagtgagctatctcgcgtaaacccatccttactcccgatatgggcaggttggaatattgatcgactacctgcagtcctagaaaatgatgcgaccaagcttgtccgttgcgcgtagaacaggcagaaatcacgcaaactatgattatggagacgcagttaatccagattcccatggttccatctatggaagatctcccatataaaacgctgtttattaattgtgatagcaatgaagttggcaatattatgcgaagaatatatgacgctgctctgcgacaccatattttccccattgacggcctccttgacgaacccggccagattggaaacagtataagaaaaggttcagtgtaatgctgtagttccccttctaagttatttcaatcttatgttggattccataagaataggacaaaacgccggataacgcgagcggggaggcccgcgctgtcaacggcgtaggcctccccgttcatcgagcggtcggtcagccgaagatcagccggtgttctgcaggcctgctgcgacacccgacacggtgcacaggatcaggtaggtgttactgcagtctgcagaagatgaaaagaataagagctaaaacaagaaaggcggcaccgcttattctcattaaggatgtgtatagattgctcggatctcctttttgagtccagaggaaattgcttattttccagagttgccttggaaaaataagcatacataatcctagcagggcaagtgctgtgagatatatgtactgcactgttctccttctggtttgtccctactgttttattgataacccttttgcctgaggttgtggacaaggctagaactatattggctccaaaatcgacggggttagctctatgcgcgtgcatttcgaaactggtcacacggctggagacttgagggcgcatatagaattcgcccccattggtgccattgttgaaaacaatggaaggtgaaaccatataggtggaatattgatcatttgaactttgcccatcgagattgactacccggtcgatgacgttattggcgacaatccatccaacctgctaccaatttacagcaaaggctggagtggtcataactgtgcataggcaaactgagataattgtggagaataaaaaaactcttctggatttcataatttcctccatgtgaaaatttaatctcaatcgacaatgattaagatattaagagtattctaatggaaaatgagtaggggtgcactctagggtgtgattttctagtgaaaatagcaaaggttctctctcgtggaagttgcaaacgagggcttcgctatgtgtctgtgtttcaggagtcatgcagttgttactgaatcatgagtggattgaggataagtatgctagtgctgcatgttaggcgctgaacaaaaaccttcgagtgcggcgtcttccgtcaacaacacaactcgttcagaaatacacccaatatggtcaaacagtaagacagcgctatgatgcgaacaatcttcttccaagacagtttgtcatgaaggaaagccgtaaccaaaagggttgtcattggggttataagcaggacgaggaagaaatagagaaatgtggactaggctcaatctgccgagaatataagtctgaccgaaccagttgtataagcccacgatggctgtcggtgtcgcggcgtgggtaaacgcggacaggcgccgggttacgtcggatgattgggagtctgtcgctcggcctgcgtgcctgttttgtgcgctgtcgccggccaggctagggccgcgcgacgcgagcggggaggcccgcgccatttatcggcacggaacctccccgctcgcatcattcaggcggtcagccgaagatcagcccgtgttctgcaggcctgctgcgacaccggacacggtgcacaggattaggtaggtgtagttctccttctgtccgtgcgtgagctcttccttgtccaccttcttgcgcagcgacctgagggcgagcacctgggtgacggacagcgcgtccacgtacggggagcggatgcggatggcctggccgagcacgtggcggtgctgcagcggccacttgtcgcccacgatgcgctcaagttagtccggtcaatggctttggaaaatcatggggagtgcggctgcgcgggttcgctcctcgacaaggtgacttgatttgggaccgccgttaactttcgtcagacacatcgtaaatcccgtccaagtatccgtatcgtccgttgtgcttgtccttcgagaattcgacgatattgatgttatcgtcaagaggaatgccagccatgtgattcgtgttttcgataatgatgatttgttgtgaaaccgcttgtttcgctagataggaaaacaggcccactttcatggatgagtcttccaggggtcgtattccttcgtcaaacccatgcagaggcgtatcaataagcagccaacccggagtatgctttgactgttcattgagataatcatgaaatgcgagcataacaacgctgttaagaaatgcgcagtatcccttgccttgttcatcagccttggaataccctgctatttcgacatcaaaagaagatctgctgaaatctgcagtatcagcaccttgaaaatgacattgttgcagaatgctgcgtatggtgttattcatggaataccagaaatcactctggaaacattcgcgtggcttgtatttttcatcattctgtgttgcttgaccagcgtcatcgagtgccttgttgaaacgagcatgcagcgctatgagttccgcatattccgcatgcaattgttctgcatgggcaatttgctcaatatcttgttgcatgtgctgcgctgttggttgaatgtcggatttgagcgaatgcatattttgccgatgctgctgtttctccagatgcagctcctgttgcacctcatcggctttgtcgacgaggatggctagatcggtttcaacgtctgcttggattctgtggatatgctcaatttctgttgagacgattagaatgtcctgttcagtcggcacagacatgtggatggggctgtggcaaaactgacatgtggcgggataggcatgtgtgcgggcatgtttcattgcctgtagttgcaaatcaagacgtgcagcgtctgattcgtattgactgataagtaccttacgttggcgaataagtacctcaaggtgctcatattgttgattaagctgagagatatgtgagatggtatgggcatctcgattgaggagagtttgtctttgctgttctacgtgtaatgcttttttgtgaaggtcttaaataggtgtgaatggtcttcccctcatttgttgcgatatggcgcatctcctcaaggtgtctgatgcgaggctctatatcatccaactgctgatggatgaactgttccacggcttttctgcgggcgtgacgttcgctggcactctctgtctgtatggagttgtcgattttttcatcttgaactagcacgagcaacgaggacagactttgtgtgagagttgctagagaggtacttttggggaaaagaatggaggggcgtgcacgtcctatttggtcctcggggacaatcatgagatgtctgatggcattccatgtgaaagcaactgtatggtaggtttcgtttgtcgctattctacgggttgattcaacgcctagtaaggcaagaagaaccgtattgattgatttaccggcacgtgatgaaacggagtaggaaccggggacgatcattgggttgctggattttacatggatagtgttctgaacgtgaatcgaacgactaagcgaaacctcaccgccgttggtcacgaacgtgacctgtgcaatttcataggcagttttatcggtaaaggggagctctttccctccgcaggcaaattccacggtttttgcgattctggttttcccggtgttcgaagcgccgataatgcagttcagcccgcatgtgagattaatggcggattccactccgtcctttctgattgccgaaattcgacgtatccatgtgtttctcataactggttgttctctttcgttattcggttcatgatggtttcataatcgttttttatcaagagctgaacagcctgtcgataggaggcagcgtaatcgccgtgcaatgcttccgaatattggaaacattccggagtggcgcggtacaacaggcaagtggaatccacggttgctgctccaacgattacgagttgggctaatcctgcttgtattcgtttgcgacgagcatcatattcggctaaagcatgtggaccatcgccgtgaagattgcgctgtccgaatccgaatgttttcatataggtggcgataaggtcaatggctgtgatttcgtcaattgtggaaggtctagaaagaaggggaaggcataatgtcaatcgtgttgctgtttcctgtgttgtgttaaataatgaattattcattttcgtgtacccactccagcatatggtcgttgaccagcatatgacacagccctttcttttccgctgccttaatcattgatgggaattgggctataactgaaccggatagggggaaaccggctgcctgagatagcgttgctcgcatgcgtaacagtccatcggcgtaatcagatgcgcaggtatcgcatattccgtcataaagatcaaccttcagtgcatcaaattcttgctctccgttttctataacatcccgtagattcctgcgcattccttccgcatcgtaaaaatattcacgttgcttggcgtattcaggacgacatgtctgaggaagatcgtcggaacagttgattggcttgtgcaagtgatcggcataggcggcttgcatctgcgtgaggtatgtctttttcaagatgatcatctggtttatccggtggaattggataagccttccaggggaccgaagagcgcccaaggtgcaatttgccgttgttgatgcgaccagacgccagaggtaagttttcgaaaatatcgaatttcggctgaaagcttatgccgtcgatgagaatgtcacgtccaccggcattcgcctggagtattgacagaagccattttcctgtggcagaaggaagctcactgatatccgtaactctaatatttgccttgataagctccttttgaaaatcggcaagggcatcaatgctgatatcgcagcaaagacgttctactttcgagatatctaggcgctgataaaactcggcggctttccaggcaggaatcttcttgcgaccgttataaaaacgagtcagatcagtatcgttgattccagaccagaccccggtggtaatagtggtctttccgggtttgcggtttcgatgatgttggggaagtggatttcttagaccgtcatcctctaacacagcatcgaagaaatccttcataaatccctttttgtggtggtctacgccagatatataagggtttacgagctgacagaagactcccagagcataggtagcagtagtttcggccaagtgagtctccttctcgtctccatttgtcttcatccgtcgccttcccatgaggtcactgttcctacgatggaagccagattcagacgaataagccggtaaaacactggaatatcgccagtatacgccgcttacagctggatcagagaagcgcaactttcgtctattgaaaggatttgagaccagacacatcgtaatttcttcttcaactcgatgtcatgcgataaccggttatagaagtagggcattgggctgttcatccgttgtgccgcagtgaagctgactggggcttttaactaatcacatgcatgagatctgcctgcttattcatggtgacgcgtcggttttctcctgaactgacgcgtcatgcttatccagcaggttggatgctcatgtggtggcctatgcaagcaggtctcgaagacccaataactgggtgggatcgagactggaatgagaatttcattgaaacatgaggcaatgcgcgccggtaatgtgtccgtaactgatatatacaactgttcggaagtggaattacggacgatggttgaacgcgatagatgtttgcgcgcaatccgtatgggttgttcgccacgtgatattgcactacgtacccctcaaacgatacttcaggaattgtggaatgcggaggaacgttccgctcacgcttattatcgatcggaccgtgtcagcggagttatttgctcctatgaggatttggttggtgcagggcgggaaccccaggggtgttctgcttcttctgaggatattctcttatgcgcggaggatgcgagagaaagagctaactgtttgcaagctatctttgcggagatcgaaaaactgccagcaggtcagcgcaatatcgtcaggggtgtactggtaaagggggcatctcaatcagatatggcacgagagctgggcgtgtcccgagctgcggtgtccaaacagctttcaacggctgtgcgcaaaattcgtgccgctattcgcgacgaaagcaaagaaacgaagaacacgacaacatcagcagtttgtgaaagaaaggagcattaatggttcatttcagtgttatcagagtgaaaggaagcccgtcatatgacttcgatgcatgcggagacattttggctatggccaaagctgtaggtgtcatgacggaaaacatgcgcactgatcgctgcgacaatacacagtgtgatggaagtcgttgtaagggaaacactatgtttcggttggagttagacaccgaaaatcgcagagttcatcgcagacgccatgccagatgaaacgcccgaggttaacacctcgtggcgaaacggcagtgcaggtgagggcagatattgggtctgccttcagcaacaggtcccgaaggaggacatcatgactgatcagatggtgctgcagacgcagcagtggctgaacaagacatacgggaatgatccccgattcaagaaaatcaacccggacggcagaactggttggccgacaatctatgcgcttactcgcgcattgcagattgaattgggcatccagtccactgccgataacttcggtccttccacccagcggttattcaagcagcggtatccgaatggggtgcggcagcaggcagttgcggacaagagcacttccaacgtgtattccatcattcagggggcgctgtggtgcaagggctactccactggtggcaacatctcacagcatttctacgacggaacaggttccgcgatcaggaagcttaaggctgatatgggcatagagggagattccagcgtagacgttgagatcatgggggcgttgctctcgatgaagcagttcgtgctgctggcctcttatggcggtatcgactccgtccgtagggcacagcagttcatcaacaaagcatatcgtccatacacgggcatcattccgactgatggactgtacggcagggagatgaacacggctcttatccaggtgcttcagtcgcttgaaggtttttcacccagtgaggcaacggggaatttcggcaacggaactagatctcgtttgaaaacgataacagcaaataacgcatcctctaatgagtcgtgggtctggctcgccagcacggctttggcgtgtaatgggatcgggggcgggccgaccttcgtatggacgagcacgttcgccaatatcgtgaaagcgttccaggagcgttatgccattgctgtgacgggctctattgattcgaccacgtggatgagcctgttgacatctaaaggtgatcctgaccgtccgtgtgtggcctgtgacactaggttcgaaattaccgacgccaggttggcgacgttgaaggcagacgggtatgaaatcgtgggacgttatctgacggagcctggccagtcgtcgttggcgcccaaggattactttaaggccatccgtccgggtgagctcgagcgcatcactcggggcggcatgcggttcttcccgatcttccaggagtactccacgaagctggagcatttcaccccggcaaacggcgctgctcatgccaagaccgctcgtgaggcggcgcagcgtcttggcatccctcccacccatatctacttcgctgtagacttcgatgcgaccgatgaccaggtgaccagcaatatcctgccatacttccgtgcggtttgttcgtctcttggtggtggatacggagtagggatttacgcgtcccgcaatatttgttcccgcgtcatcggtgcgggatgcgcgagtaacgcgtttgtgtccgacatgtcgacgggattctcgggcaatctcggcttccccatcccggacggttgggtctatgaccagttcaccgagattgacgattacaagggccagggctgggatctggaccgtgttgcctattccgggaaggtatcagcatgcgcttcactgttgcctgccgtgccagtgcctgcgcctgatcccgatcccgtctcgccagaaacggatccgctgctaagatgggtcgccgtcacggagcaggagtgtcgcaaagcccttgccgctctgggtacccaggtagcggtttacgaggacagcatcggtcaattcatcctggaatggctccgcaaacctgaatactggtcggaaggcggtagcgggacacaagcaatgtggcacgcatatactcctgaagtttcgactccgcccgacttggacgcggcgcgtgtggtatgtgccaatgtatgcgaagcacagccttcaattaaagagaaactgccatcgactcgagatgttgcacacatggctgcaactgctctcggatacctgacatggggtatcgaaaacaatccagccaaatatggtctaggcgatttaggtggctggcctctcgacttgttgcagatctggggtgcctatcgccgtgacggcaagcatgccgacttggcagcatggctctataagcaccttgggaaagatgaaggattcgggtacgatgacgttcttgcggatgcagatgcatggctaattgcttctagtatgaggaaacgatccggttcgacggttctttctgctgctatgcgtgaaacgtttaagcagagtgagacccatcgtatcgttcgattctacgacgaacgttttgcatcaagcgcagataatgtggtgagtgcatattcaacaatggcggacggtcttgatgcacttggtttgacaaatattggaatgagcgaaagcatcctaaaaaaggctgccggtacagacaagcttcctgataagcaggaagctgaagtgagtgctcgggcgttcgctgcattcattgatcagccaagacggtagctcgcataatgcattatgtgtgggcagatgtgtcgtctgcccacacattcgctgttgtgctttcgatttggaattcctctgccagatacggggaaacttctaaaaggccgctatgccgaggaagagtcctgtaataccggtggccatcaatacgatgatggtgatgattccggcgaagatgcgtacaggaagggtttcttttccatggtttgatgggctgtccgcaactaatctcattactccagctgtaacccagcaaactgcgcccaggactagtgccaggaattctcgacaccattccgtttcaagtgcgggaatgccgacgattgatgacgggtcgcttgccagtcttggcggaatagcgcataggatacgctccaatatcaggtaaggggtatcaaaatggatcagagtcaaagcgaatgggagctgtagcgccagtcctatccaccacagcgtgcgtcggatggtcgcgagtctgtcgcccggcctagtgtccggcttgccgccttcgccctccgtcccggcaccgtccgcgggcgtgtggtccccctcgtgcgcgtccgtcgtcccgtccgtgtccctttccgcgtccatatgtccccctccgatcatccgagtctgtcgctcggcccgcgcgcccgttccgtgcgcgccgtcgccggccagtctagggccgtgcgacgcgaacggggaggcccgcgccgtcaatcggcacggaacctccccgttcatcaagcggtcggacagccgcggatcagcccgtgttccgcaggccggcggcgacacccgagcaggagtgtcacaaagcccctgccgctctgggtacccaggtggcggtttatgaggacagcatcggtcaactcatcctgcaatggctccgcaaacctacgtactggtcggaaggtagttccggcacgcaggcactatggcatgcatacacaccggagccggttactcccagcgaattggccttgtcgcgtcaggcatgcggtgtcgcatgtgatgcacagcctgtcatcaaaggcacgctgcccaatcgggacatcgcccatatggctgccacatccttgggatacttgacatggggcgttacgaacgatccaatggactatggtctcggtgatctgggcggatgggctctggatttgctgcagatttggggaagctacctggcgaataccccgaaagaggacctggcgtcatggctgcacgctcatctcggcgagcaagacgctcgtatgggattcagttacagcgatgttctcgcggactgtgatgcatggttgctggcgcggtccatgcagagcaattcttccgaaaggtctttgtccaccgctatgcgggacatgttcgcgcaaagcgagacgaatcgaattaaacggttctatcagtcccggttcaagggaagtgcggacaacctggtcatcgcatttcgaaagcttgttgatggaatcgatcttggaatattcgataacgtatccggaagtaaaaaagcactgctcattgcgtcacatgcagaccgactcccgagtcaagcggaggctggtatattggcattatcctatgctgaatctcttgaaaatccgaaccgttaatcaatcatgattgtgatcgcattgcgtggaatgattcagccattccacgcaatgcgcctctggtaaaacgtcatagagtcattagagcggaaagtagcgttatcacaagaacgggaaagaccatgaccagcacgagaaacgatatgattcccacaaggacatgcgaggcggaagaggaatgatcacgaagttccggatatacagatcgcatatatgaacgcacgccaaagatgacaagcgccgcaatccagcagactacccccataatcaatactaaggtaagtctacgtacatactcagttgccgtagttaaattcatgcacgaagaggaagagaacgttaagactctgcagattatagtatcatcatcgccattggcgccccattccgcccacaaaataagtgctggtgaaagcagcagtaatcccagccaccatagcacgcgtctggccttgcccaaagccacatagcatctactcgccttaaggaatttggtagctgctttcggtgccaaagcatatttcttgccggaaaaattttctgacgtatcttccaggccatgttttttcccaatgtcatcgatcatagccggattcgctttgcaaatgtggcgttcgtttccggcatcgccctccgccttgatgccgtccgttggcccggtgctcccgcgctcattcgatggcttgtccatgtcccctccgatcatccgagtctgtcactcggccagcgcgcccgttctatgcgcgccgtcgccggccagtctagggccgtgcgacgcgaacggggaggcccgcgccgtttatcggcacggaacctccccgctcgcttttgtcaggcggtcagccgaagatcagcccgtgttctgcaggcctgctgcgacaccggacacggtgcacaggatcaggtaggtgtagttctccttctggccgtgcgtgagctcttccttgtccacgcgcttgcgtagcgagccgagggcgagcacctgggtgacggacagcgcgtccacgtacggcgagcggatgcggatggcctggccgagcacgtggcggtgctgcagcggccattcgtcgccgacgatcttgagcacccacttgcgggtgagctccatctcgtcgaggaccttcttgttgaggtcctcacggtcgccgagggcgaggtacatcttggcgatgcgctcgtcggtcttggccagcgacatttcgatgttgtcgatgaacgtggagaacagcggccactcctcgtacgcctgacgcaaggtgttcaggtcgccgaactgctcgcacgcggtgccgaggccgtaccatgcggccaggttgatgcgggcctgggcccaggagaagatccacggaatggtgcgcaggtcgtcgagggacttggcgcccagaccacgctttgccggacgggagccgatcggcagcaggccgatttcggtcagcggcgtgacggtggagaaccacggtgcgaagccgtcggtgttcagcaggtcgaggaagcggttgtgcgcggcctcgtcgagcttgctggccatgtcggcgtacttcttggtcatatccgtgttgcgcttctccacgctcggagcggactgcagcagcgttgcggctgcgacggactccacatggcggattgcaagcaccgggttgccgtagcgggcgaagatgacctcgccctgctcggtgagcttgaaacggcacttcacggagccgaccggctgtgcgagcacggcgcggttggccgggccgccgccacgaccgacggcgccgccgcggccatggaacagggtcaggtcgatgtcgtgcgattcggcccacttggcgatgcgctcctgcgcggagtgcagggcaagggtggcggaggtcgggccggcgtccttcgaggagtcggagtagccgagcatgacttccatcttgccgccggtggccttcagacgagcctggacctccgggatcttgatcatttcctcaagcacgtccaccgagttctgcagatcctcaagctgctcgaacagcggaatcacatcgatggtcggaacatcctcggggtgggagaacgccagacggttcagttcgtacacgtccttgatgttctgggcgctcttggtgaaggagatgatgtaacggcgggcggccttgatgccattgcgcttctggatggaaccgagcgcgcggaaggtgtcgagcacctcgtgggtcatcggctgcagctcgccacgctcaccgtgcaggccatgctcgcggatgtcctccagagcgcgggaatgcacgacggaatgctgacggaactccatctcgaccatgtggaagccgaaggtctcggcctgccagatgaggtcctgcagcgggccgtaggcggaacgcttggcgttggcttcggcgagggagcgctgcacggtcttcagatcggcgatgtagtcctcgcaggagtggtacatgaggtcggcgtcgcggtcgatggtggccttcagacggtctgccatgaccagcatgacggcgcggtgcagctccttggtggagatcagcgcggccttgtcggtcagacgctcgctcatttccttctggtggttccacagggacttgagttcggcgctcggcggggtggtctcggcctccatcgtcaggttcttgccgacgcggcgggtctcgatctccagcgcgcccagcacgtggtcgctgaacttgcgggccacctgacggctcaccttggcggtgacgttcgggttgccgtcacggtcggaaccgatccagcttcccggatggaagaacgccgggcacaccggcggcacgaggccggccttgtctccgaggacccagtcgtcgaaacgacggtagacctgcggaatggtgtagaacagcgtgttgtcgaagatatcaagaatggtgtcggcttcctcaaccggagtcggcttcttcagcgcgatcggggaggtacggaacagcgcgtcgatctcgttgaagagtcgacgggagttctccttcttgtccgagccgccgagcagcttatgcgcttcgagcagctgggagatgcggcggatcttgccttccacggccttacggcgggcttcggtcggatgcgcggtgaacaccggatggaactcgagctggtcgagcagctccttggctctggccggacccatctcgttgatgagctggtggtaggcgcaggtcatttcgttcaccggatcgacggcctgggtgtcgtcaacggcgttctcacggctgtgcagcacggagacacggtagttctcctcgcacagattggccagatggaagtaagtggtgaaggcacgagccaacagctgggcctcatgcacgtccgtcttgtcgatgatgtcgacaaccttctgcaggtcgtcctgatcgggattcgtgtcggtcagaatgccggagaaacgttcgtcgctggccttcagcgcatgttcgcgcacttcatcgaacttggccagcaggttttcatcgaactcaccgagcacctcgcgaagaatctgcagacacagatccatttcctctttgagggatgcgggaagatcacgctcctcagggcccttggtgccggtgccggacgagacgatagccgcgtccgcaggcgtgatctgttcgttttcagttgtcatcagacctccttctccaaaccatcgggttgctcggtctgtcggtccttcgcggcacctccgcgattgttttggccgtctgttgcgagcccacagccctaagcttggtgggtaaatgctcgaccattgtaggcgcggcaaatcgacagtttggttacggaaacgccggaatggttcgcatcgtggacattgaatgtccggaaaatgggcatgtgggaatgttcggaaaatatccgaccagcccacacgttagacctgaatagtgtgagcgcactacatgaacatgatgagaacaccgaacgcgttgacagcagcgcgaaggcggtcagcaaattccacacccactccattccgctcgatatggaagacatcgaacgcgattgggacaagccggtaaccgaagccggcatcgcggcgaaagccagcgtgatcgtccgcgtcggcatgcttgacctcggcgccggaacaggcagcttccgcgtccgcgaaatgatgcaccgcatcgcctatccattgggcgtgcacgtgcgcgccgacgtgaacctcaccgacatcgaagcctcctgcacggacggcaaggaccgcatcaccgaagtcgtcgacctgccgaccaccggcgtcaacaccgaacgcatctggctgctcgagcacttcgccgactggttcaacgtcaacctcggcaaaggctctatgtaccacagccaatccgacgtttccgaagggctgatgcagcatctcgacaagcgcgacgcctcgcaggtgtcggccgaactgtccaagcagctcaaggaacggcagaaggccgagcagaaccaggaaggttccgacgatcccgtgctcgacgcgctggaaatggtcacggaacgcgcgcaggaaggcgattccaccgcacgtccgctgcacatgcgcgatatcgaggcggcggccgcggccggacgtagcaatggcgattcggtcgcggaaaagccgcgtaagaaccgcaactgcaaaccgccgaaggaatatgccgagcatttcgaccatatcgggaaagccgcgggcgaatcgcaaggcgtcaccgtacggcaggcgcacgagcgactcgacatgatcgaacgtcgcaaaccgctgtattcgccggccttcgcgggactcgcgtccgcctgcgcctgcgcatccttcgtgttcctgctcggcggcggcccgtacgacatgatcggcgcgttcgtcggcgccggcctcggccactggctgcgtcgccgcctgttcgcccaccatctcaaccaattcttcgtgacgttcgtctgcgtggccgtcgccgcgctggcatgcaccggcatgctgcgactgatcggcctgttcgatccgatcgccttgcagcacgacaccgcgtatatcggcgcgatgctgttcgtcatccccggattcccgctgataaccggcgggcttgacatggcgaaaatcgacttcccatcaggcgtgcaacgactcacctacgtgctgtgcatcattctgatggccacgttggcaggatggatggtcgcctcaatcgtgcacctgaatccgcaaggattcgagccgcttggactgaaccccgtcatcaactgcctgctgcgcatgctgttcgcgttcatcggtgtgtggggcttctccgtgatgttcaattcgccgcagcgcatgtgcctcgtcgcagccaccatcggcgccatcaccgataccttgcgattggagatcgtcgacttgggcgtgcccgcggaagccggcgcgttcatcggcgcgttccttgccggcctgctcgcctccgcatggcgttcggcggtgcgccacggcctacttgctccgcatttgggatatccgcgcatctgcctgacggttccgtctattgtgatcatggtgcccggtttgtatatgtaccaggccatgttccacctcggccagttcgatacgctgaacgcgctcgattgggcgttccgtgcgttcatggtgatcatctgcctgccgatcggcctggcgatggcacgagtagtgaccgataaatcctggcgctacgacatttaataacctgcagaagggtaaaaacacttggtaaccaaagatttctgggtgctgctggccatggtcttgtacttcgcggccatgctgaccatcggcttcgtctactccaagaggtccaattcctccaccaaacagtatttcgcgggtgggcgtggcgtcggaccgtggctgacggcattgagcgcggaagcctccgacatgagcggctggctgcttatgggcctgccgggcgtcgcctacttcaccggcgcggtcgacccaatgtggacggccatcggtctggcgcttggtacttacctcaactggaaactcgtcgcacgccgtctgcgccgctactccgtggtggccggcgacgcgatcaccattcccgacttcttctccaagcgcttccatgacgatcgcaatatcgtatccaccatcgctgcgctcatcatcctcgtattcttctgcgtgtacgtcggcagctgcttcgtgaccgtcggcaaactcttctccacgctgttcggctgggactaccacctgaccatggtgatcggcgccgccatcgtgttcgcgtacaccatcatcggcggctatctgtccgtggtcgtgaccgacttcatccagggcctgctcatgttcttcgcgctggccgtggtgttcatcggctccgtggcgtccgccggcggcatcgacaacaccgtcgccttcctcaagggcattccgggattcctcgacggcacgcatgtggccacgccgatcctcaacgacgccggcgagcagatcgtcaaggccggacaggccatgttcggcgcgcccgccgactacggcatcatcaccatcatctccatgctcgcgtggggcctgggctacttcggcatgccgcaggtgctcgtgcggttcctgtccatccgcagttccgaggaaatcaagaaatcccgcatcatcgcaaccacgtggtgcgtgatctcgctggcgtgcggcgtgtgcatcggcctggtcggccgtgccatgatgccgacgcagttcgccacgcaggcggccgcggagaacatcttcatcgtggtgtcgcaggcgctgctgccgagcttcatgtgcggcatcgtcgtgtccggcatcttcgccgcgtccatgagctcctcgtcctcgtacatgatcatcggcgcctcggccgtcggcgagaacatcttccgcggactgctgcaccgcaaggccaccgaccgccaggtgatgatggtggcgcgcatcacgctgctcgtcatgttcatcttcggcatcgtggtggcgttcgaccagaactcctcgatcttccaagtggtctcgtacgcgtgggccggcctcggcgcatccttcggaccgctgatgctcacctcgctgtactggaggcgcaccaacaagtacggcgcgattgcgggcatgctgtccggcacggccaccgtgctcatctggcacaacctcgtcaagccgctcggtggcatcttcgccatctacgagctgctgccggcgttcatcgtctcgctgctgttcatcgtggtggtctcgctgcttacgcccgcgccaagcgcggaagtgctgcacgaattcgaccactatctcgacgatccggacgaccgccacgtggacgacgacctcgtggccgccgaaatcgccgcaggggagaagcgctcgcagatctaagcgggatggcatccggcggaaggcgtaatccgccatttgtaagcgaaatgggtcgggaaccgatgtggttcccgacccatttctcgttgtgaacgtgcgaacacgtaagcgtgcgacggccgcacggctcaaacgcgctcagtagcgcatgcccatggcgtcgcgcacctgctccagcgtctcgttggcgatggcattggccttcttgttgccctcggcgagcacgtcacgcacgtaatccatatctttggccagctcggcgcggcgttcgcgcatcggggcaaggaagttgttcacggattcaaccacgtacatcttcagtgcgcccgcgccggaatcaccgatctcctcggcgatttccttcgggtcgcggccggtggtcagcgctgcggtggtcagcagtgcggagacctccggacggttgatcggatcgaaggtgatcttgcgttcggaatcggtgcggctcttcttgatgagcttggcggtctccgctgcggtggcactcagcatgatggagttgccacgggatttgctcatcttctggccgtcgaggcccggaatctccggcgcatcggacaggatggcgtcaggctccgggaacaccgggttcttcttggcgtaacgctcgttgaagcggcgggcgatggtgcgggtcaattcgatgtgcggcagctgatccttgcccaccggcacgatattgcccttgcagaacaggatgtcgcaggcctgatggaccgggtaggtcagcagcaggccggtcagtgcgtggccggaagcctccatctcggctttgacggtcggattgcggtgcagttcggactcggtgacgagcgacaggaacggcagcatgagttggttttcggccggcacggaggagtgcgtgtagatcatggtcttttccggatcgatgccggcggccatgtagtcgaggatcaggttgagcacgttgtcctggatgtgctcggtggtgtcacggtcggtgatcacctgatagtcggcgatgatgatgttggtgtgcacgcccttgttctgcatctccacgcggctgcgcagcgtgccgaagtaatggcccatgtgcagacggcccgtcggacggtcgccggtgagcatggtgaacttgcccggattcttttcgattgcggcgagggtttcatcggaacgcttctttgcggcgaggaagctcgcgctcatttcattgccgacagcagtgatctgctgctcctgggtttcgtccgtcatacgtgtccttttcttaagaaaatcaacgattttatcgtaaaagtctgagccgacaacgaaataatgcgcaataagtggtactctcttgtttgatgaattgatagcacagtaatttcagggggtcagatgggccgcggacgtcagaaagccaaacagcagaaaatagcccgaaagctcaagtacctgaccaccgacgccgattacgatgagcttgccaaggagctcggtgcgcaggagcccggttctggttccttcgacccatttgccgatatcgaagccaagtattctcacgatgtggacgccgaagatgagaccgttggggacggccaaacgtcttccgattccgccgatgaccttgacgaatacgccaagtgggccgcggaagccgcggcgaaggccacgagtggcgagtttccggcggcaaaggccgcgccgaagccgcacaagcccatcccgatgccggtgcccagcgcgctgaagccgaagaagcaggactgactgcacagattttttcaacgaatggcccgtggtttcgaccgcgggccattttttattatttcgatttcgattgtcgggcgattgtcgagctcgtcccgccaaccatcaccggtcgcaccacgccgcgacctattcctatgccagcggcagcagcccgctcagatcgtcgcgttcgccgacggcggtgatgcgtccggcgtccttttcctcgccccagctggtgatgccggtggcgagcctcatccacacgtcggggtccagttcgatgacgtccggcggcgtgagattgtgcggatcggacgccggcccgtcgaggatcttgatggcgccccacggtgccacgcgcacctccacgccttcgcccggagccttcttttccagcaggtatagcgagtagcgcaccgccatcgcccacagctggcgcggcagacgcggcgagaagttgagccggaaatcgaaagcggcgtcgtcatcggccggcagctgctcgctgaaaatgttgtgcgccgcgtcctgccactgttcgaaggcggcgcgtcctttgcccaagtcttgttctcgtatgacagccataccggtattgtgcagcccgcaaacgactatgatgggactttgcaaacgatgtagtcgtaactaaataggggtttgaggggcgattttcctgcgattgtggtgccctcgcttaatgggcgccatacgttgcgttgcagtttttgcaatgttttttgcaaacgaatgccggcttacgattgctgggaatttcgtctttttatgattacgtagtatgctgtacatgagaacgtatgcatgatgttacttagtgttcatgcggccgcaaatgcaaggacgctgaagtaaggcataatgttcctggagagtatccgtcaaagggagtcaatcaatgactgaaattaccgcaccgaagtccgcggtcaccgcggaacagttcgctgacgagattcgtgagcagctgaagtacacccagggcgtcaccgtcgagcaggccaagccggccgacgtgtacgttgccgcgtccgccgcagtgcgtcgccatctcgtggattcctggatgaagacccaggccgacatggtcaacggcaacaccaaggccgtgggctacctgtccgctgagttcctcatgggcaagcagctcgagaacgcgctgctcaacgccggactgaccgaccagttcgacaaggccgtggaagctctcggcttcgatgcgcaggaagtcatcgacgccgaatacgagccgggactcggcaatggtggcctgggccgtctggccgcctgcttcatcgactccctcgcctccctcggcgtgccggcgttcggttacggcatccagtacaagtacggcatcttcaagcaggaattcgacgagaacggcaagcagatcgagaccccggattactggctggccaacgaagagccgtggggccacatcgactacaaccgcgaccagaaggtctccttcggcggcgaagtcgtcgaagagaacggcaagaaggtttggaagccggcttggtccgtgcgcgccgtcccggtcgactacatggttccgggctacgcctccggccgcgtgaacaccctgcgcctgtggaccgccaagagctacgacgagttcgatctgctcaccttcaacaagtccgagtacctcgacgccgtcaagccgcaggtcgaggccgagaacatctccaagatcctgtatccggaagactccaccccgcagggcaaggctctgcgcctcgagcagcagtacttcttcgtgtccgcctccatccacgacgccatccgcgtcttctacccgggccaggacaagccggatctgaccaccttcccggacaagatcaacttccagctcaacgacacccacccggtcatcggcattccggagctcatgcgcgtgctcatggacgagtatggctacgattgggacaccgcctggacgattaccaacaagaccttcaactacacctgccacaccctgcttccggaagctctggaagtgtggccgtccaagctcatcggcgaactgctgccgcgtcatctcgagatcatcgagaagatcaacgaccagttcgaggccgagctcaaggccaagggcgttgccgaggagaccatcaaggacatggccatctacaccggcgactccgtgcgcatggcctacctggccacctatggcggctcccacgtcaacggcgtggccgagctgcactcccagctgctcaaggacgtcaccctgaagaacttctccgacgtgtatccggacaagttcaccaacgtgaccaacggcgtgacccctcgccgcttcatcaagctggccaacccgcgcctgtccgacctcatcaccgaaggcctcggcaccgacaagtggctgagcgacctcgaactgctcaagggcctcatcccgctggccgacgatgacgagttcgtcaagaagttcgccgccgtcaagcaggccaacaaggtcgacttctccaacttcgccaagcgcaagtacggcttcgacatcgacccgaacaccatgatcaacaccatggtcaagcgtctgcacgagtacaagcgccaggccctgaagatcctgtccgtcatcgccgactacgccgacatcaagtccggcaaggtctccgccgacgacatcatgccgcgcaccatcgtgttcggcgctaaggccgctccgggctactacctggccaagcagaccatccagctgatcaacaacgtcgtccgcgtcatcaacaacgacccggacgtcaagggcaagctgaacgtctacttcccgtggaactacaacatcgagctggccatgaacctcattccggccaccgacctcgacgagcagatctcccaggccggcaaggaagcctccggcaccggcaacatgaagttcgccctcaacggcgctctgaccgtcggcaccctcgatggcgccaacgtcgagatccgtgagcgtgtgggcgccgagaacttcttcctgttcggcatgaccgagccggaagtctctgcgctgtacgccaagggctacgacaccaagggtctgtcccgcgagtactacgagaaggacccgcagctcaaggccgccatcgatatggttgccgacggcaccttctccgacggcgacaaggacacctacaaggacctcgtcaacgattggctgaacaaggattacttcatgacgctcgccgacttccgcgcgtacatggacatccaggcccagatcgaggaaacctaccgcgatccgatgaagtggagccgcatggccgtgctcaacgtggccaactccggctacttcagctccgaccgctccatcgaggattacctcgagcgcatctggcacaccggtccgctcaagtgattatggagcggtcatgaaacgtcgctggcatcgccgacgcacgcatgatcgctttcgctccgtccgtttcgcaatgggcggataagtgatgacgacgaaggcccttgggattttccaagggccttttcgtatgtttttcgcatgtccgattgcgtatgccggtagtgcccgaacgtacgtgccgaacgtacgtggcaatacagcgacagtacgacggaaggccgcaagccaatcgcaatcgcaaaagcaaaagaaaaaccctgtatcgcaagatacagggcgaagcaacaaacccaacgcggcataggtgtgccggggaaaggcgaaatcaagcggcttccggctcagcggcaggagcggcggcagtggcgtcggcctccggctcggcgtccttggtcaggcccaggtcgaccggcgaggagctgttctcccacggttcctcccacgggtcatagtcgggattctgctgcttgtagatgtacagaccgacgacgccagcaagcaaagctccgaagagcagtgcgaagaacttccaaccgttagaagacttgttctccatgacggctcctttcaaggtttccaaacactggctgacctgctcgttcaagccagctctgttccctatcttaattcgtggaatgtgtcgattgggtggatttacgcgccggaaaataccgcatgtgccggtagtgttgagctatggcataccaacgattcagtctgtttcccgattccccatcgttcaaggatctgttctccgcccgatcgctgcgataccggtggcgcaacggcgacccggtcatcaccaccgccatcatggcgatctgcatcgtggtgtggaccatcgaagcggtcctcttcctcgtctggcccgaaggcggcaacgcgttcgtgaacgccggcatgctgctgcccgccacggccgtccggcacccgtggaccttcatcacctcgatgttcctgcaccagccgacctcgctgtggcacatcctgttcaacatgcttactttgtggtgcgtggggcccgtgctggaacgcatgatggggcattggccgtatcttgcgctgtacctgctgtccggattgggcggcggcgccggactgatggtgtgggccgtgtgctcgccgtcgggatggatgaccgccgcatatggcgcgtccggcgcgctgttcggcctgttcgccgcgattctggtggtgtacaggagaataggcatcgatattcgttcgatgctgatttggatgctgatcaacttcctgatgccggtgatcacgccgggcattgcatggcaggcgcatgtcggcggattcatcgtcggcggcgtgcttgcgtggctgctggtcaccggcctgcatgcgttccgcggcaaaagcctgacgtggcgcaccacggtgtacggcatcacggtgttcgtggtggtcgtggcgatcatcgtgggatgcaacgccggcaatccgctgatgcatatgtcacttctgtaccagtaatgcgggaactacacacatgtagttttccacatccgtggataactttgtggataagtgatgtcaaacctgtgggtaagtcggggataacgtggtggattatccacaaggatattcacaaaatggcggaacataaggaatttcctatgtgaaaattgtggataaccgatatccacaccccacaaaaatggggaaaatcgccgccggtatttcgtggtgcgacgttgactcaggcacaaaatatgggcgttatccacattcatccacatttgtccacttgttatccacaggaaagataagatgacgaaggcaatcgacaaggacgcaataccgatgcgccacggacgcaggatacgcgtgcgacgatatacgtgcgacatggcagatacttgcgaagaaggggagaggaaccatgagtgacggaccactgctcaacgacgtgacgcgcgccttcgccgaggcgcatcgcaatgaagatgtgcgtgacctagcgctcaaaaccaaacggacggcggacctcgacttgccggccgcgctcgaccagatcgcgggctggcaaatcgcccgcaacaaactgccgcaatgggccgcctgcgcggatatcgtctatcccgcgcatatttccatggaacagtgctcatcgcagttcacaacgcaatacaaggccgaaatcgcccggcgtctgttgcgatctctgccgcaatcggcgggacagacggccaacgacgcgaccatgacggacctgacaggcggattcggcgtcgatttctcatatctcgcccgaggattcggtcacgccacgtacgtggaacgccaatcgcatctatgcgaactggccgcgcacaatatggcggcgctgggcctcacgcaagcacaggtggtgtgcggcgacggcgtcgaatacctacgtgcgatggagccggcgcagctgatctacatcgacccggcccgccgcgacgagcacggcgcccgcacctacgcgatcgaggactgcacgcccgacgtgctggcgctgcgcgatctgctgctggctaaggcacgatatgtgatgatcaaactgtcgccgatgctcgactggcgcaaggcggtcgacgatttcgcgggcactgtggccgaagtgcacatcgtctccaccggcaacgaatgcaaggaactgcttctggtgctggacggcaaggctgccggggcaacgtccgatgccgcagcggcagacacgcgtgcgccgcacgtgtactgcgtgaacgacgatcagcgactcgactacgatgcggccgcctatacgcgcggcctgcgcatcggggacgcgccgctgccgcacgagctgcgctacctgtacgagccgaacgcgtcgatcatgaaggccggctgcttcgacgtggtggaagcgcgattcggggcggtgcagatcggcccgagcagccacctgttcgtatcggacgagccggtcgatggttttccggggcgcggttttgcgattgaaacgatcggcggtatgggtaagaaggagctgaagcgattgctgtccggcttggaccgtgccaacatcgccgtgcgtaatttcccactcaccgcgccgcaattgcgcaagaaactcaagctcgccgacggcggcgacgcctacctgttcggcaccaccatgcaaggcggcgaccacgtgctgattcggacggcaaaaatcagcagataatcggcgggtaagcggcggctttccactcgacaggaaaccgcttttcctaaagctgaagcggggcgatgcagacgcggtaagtaaagtggatgaagtggatgaagcggatgaaaaaagacgccggatcgcaaagaacccggcgtcttttgaataagcctcgatggaataggcgaaacggagaaaaccgactcagcgccaccacatggtcataatgaaaccgaccatgatgattgcgaacgcgatggccaggttccaagcgccgatgtgcggaatcggataatcggtggtcaggtagtagaccacggcccacaccagaccgatgatcatcagcgcgcagaacagcggcacgaaccagcgcgggttggacttggtgcccttgatgctttcctccacacggcgggtgttctccgcctgacggttcatcatgcgttgcatctgcggtgacagcgaatccttatcaacggtggcgttcagcaccgcttcgacacggtccataggaatatcgagatcgtcatcgtcggactggtcctcgtcaacagaagtcttgtcgacgacatcttcggtggtttcctcgacggcagcggtgtcgtcggcggactgcagatccttctggtcatccgcggtggtttcgtgcagctcttcgtcagccatcagcatagtctcctttaataggctaaaagtcataatagtgggtagactcgaaagcggcgaactcacggcgtaaaactgttcaaaatcaggacaattgttcagtgaaacccggcggattcaggcaggtttggaaaggcgcgtatggcgaagcataccggaaagcacagcgcgaaacggtcgaaggcggccggcgtcgcggcgttcctcgtgctgctgttctccggattcctgctgtccaccaacctgcgcgtcaaccgttccgtggtggtcagcaacgataccgccgaactcgtggaacagcgcgtgaaaaaagtgaactcgctacggtccgaaatcgatgcgctgagcaccagagtcaacgatctgagcaaaacactcgacagccagaacgccgacggatcgcaagacagcgaaagcgccggcaacggcaccatgctccccgccgtggaaggcccgggactggtggtgacgctcgacgattcgccgctatgggagaacatggtcgacgccaacggatccagcgccaacatcaacgattacgtggtgcaccagcaggacatcgaagccgtggtcaacgcgctgtgggcgggaggcgccgaatccatgcagatcatggaccagcgcgtattgttcaactccgccgtacgctgctccggcaacgtgctgctgctgcaaggcaagaagtattcgccgccgttcaaaatctcggcgatcggaccagtggagggcatgagaaaagcgctcgacgattccgaggaagtgtccatctacaagcagtacgtgagcgcgttcggcctgggatggcaggtcgacgagaaaacgaaactgcatttcgacgcgaccgacgcgttgcagcagccgttgcagtatgcgaaagcgctcgaaaacgacaagaacggcgactcgcaagaggggaaataacaatcgatgaaacatgtggcaagccgtggcggacgcaccaaaagcgcgctgtggacgatactcggcatcctcgccgaactcatgctgaccgccgccgccatctgcgcgctgtacatcgcatggcagatgtggtggacgggcgtgcagtcggagcataaccagatcgaaacccgccaatccgtatcctggtccgatccaggaaagtccggcaacgtcaccgtggcgaaggcacagcagggtgacccgcctgtacagccgcaaagcgccacggaaggcgaactcatcgcccaaatctacataccgcgattcggcagccaatggcagcgcaacctggtggaaggcacggacctgacacagctcaacaagcacggcctcggccactacacggattcgcagatgcccggccaggtcggcaacttcgcattcgccggccaccgcaacggctacgggcagccgctcggcgacgtcgacaaactgcaggaaggcgacccgatcatcgtccgcacgcaggattactggtacgtgtaccactacaccagctacaaaatcgtgctgccgacacagaccgaagtggtggcggccaaccccgaaaaccccggcgcaacaccgaccaaacgcatgctgaccatgaccacctgcgaaccgaaatactccacgccgacgcaccgctggatcagctacgccgaattctcctactgggcgaaggtctccgacggcatcccacaggaactggcctcccaaaacgccaacggcacagtcaaattcgtcaacaacgaacagtcgtcgttcctgtcgtcgatcgatacgctgaaaccgtggatcttcggcgcgctcgccgcatacgtgatcatatttatttccgccgccgtcgcctggcgatggccgtatctcgccgacgtgcgcgcaggaagacgaaagaaggccgatttcagcctgtacggcagcctggtgcgactgcagccgggcgtgctgccgatccgtctgctgctggtgctgctgctggttttcgcagcggccgcatcgtgcttcgaatggctgttcccgtgggccgcgtcgactattccgatgttgcaggagatgtcgaactacacggccatctaaaggctgccgctgcgtgagacgcggacgttgctgcggcacggaacgcacgtacactgctgttcaaacgttgattggagcatgatgaccgattccgcacgcattctggtggtagataattacgattcgttcgtctatacgatcgtcggctatctcaagacgctcggcgccacggtgaccgtggtgcgcaacgacgcgatcgacccgtcccagccgggcgtgatcgacgaatacgacggcgtgctgatttctcctggccccggcgctccggccgaatccggcgccagcgaggacatgatccgcctgtgcgcgaagctcgacaagccgatgttcggcgtatgcctcggcatgcaggcgctcgccgaagtgttcggtgccatcgtgagccacgcgccgaccatcatgcatggcaaaaccagccaggttgagcatatcgacgatgagatcttcgacggcgtggccaatccgatgaccgccacgcgctaccattccctggcagtggaaccggagtccgtgccggacgatctggtggtgaccgcgtggacgcagggcgaccacatcgtgcagggcatcaagcatcgcagcaagccgatgtacgcggtgcagttccatccggagtccgtgatgacccaggacggctaccgtctgctggccaactggctgaaggtgtgcgggcaggattccgcggttgagaagtcggctggattgcagcctaaggttgttgagtaggaggctgtagctcgaaggtagtctgcaatccgcattccgcagagaaccggcaaggtttttacggtacgggatatgaaaaaggagcggcgttgagccgctcctttttcatcatcactgattagtgctgtggttgctgctgattgttgtcagtggtgttgccgttgctattgtcaccggtgtcggtggcgggctgggccttggtggtcagcgtgatggtggagccgttatcggccttgctgccaccattcgggctcatggaagcaaccgtgccgtcctgcgggccggaaacgttgacctggaagccgtagccttccagcagagccttggcatccgcgtagttcataccggccacgttcggcacgctggtctgctgcttgccggtggacacccaaatggtcaccgcggtgcccatttcgacggtgctgccggaacccggatcgatgcgggtgactgcaccggactgcaccgaatcggaatactcgctttcgatggtgatctgcgtcagaccagcctgcttgagctgcgcgatgaccgaatccttggcctggcctaccagaccatccggaatcttggtcatgccggacgaaatgtacagcgtgatgatggtgcccttggtctgcttcgaattcgcggccggatcggtgttcaccacctgatccttcgcaatggtggcgttatccacggtcttgacgttgcctaccttgaatccggcagcctcgaggatgctcttcgcctcctcctgggtcttgccggacacatccggaacagggaccgcttgtgggccagtggagaaccacacggagaccgtggagcccttcgccactttcctgccgccttgcggattctgcttggtgatggtgccctttggctggctggatgtggcatcgtcacgggcgtcaagcttcagaccaagggccttaagctgttcttccacacgcgcctgggaaatgttcgacgtgtcggtgaagtccggcacggacaccagatccgcagtgttcttatgcccgttcaacgcgaagaaaataccgatgacggccagcaaaacaacgatgctgccgaccacggaagcgatgatgatctgcttcttcttacgctcctgcacggccttggcacgctgttccgcacgggtcttcgtttcgactccgccattcggattcggcacggcctcgaactggccggtgaccggattgaacgcctgcgtcggcgcatccgtcgccggcgccatgggcacggtggctgcatccatttcggcctgcttgcgggccttcatgttggtcaggtcggtcaacgggttgaacgcggcagccatcggcacaccgccgttcatgaacgtcagcagatcgttcttgaactcggaagcggtggcgtaacggttctgccgatccttggccatcgccttcgcgcagatcgaatcccacatcttcggcaggcccggcacgatcgtgcttgggggagtggcgacttccgacacatgctggtaggcgatcgccaccgccgaatcgccggtgaacggcggccggccggtgagcatttcgtacagcacgcagccggcggaatacaggtcggaacgcatgtcgacgctttcgccgcgcgcctgctccggagacaggtattgcgcggtgccgacgacgccctgcgactgcgtcatcgtggccgcggaatcgtcgatcgcgcgggcgatgccgaagtccatgaccttgaccacgccctgctcggaaatcatgatgttgccgggcttgatgtcgcggtggatgatgcccatgcggtgcgagtattcgagcgcgttgagcacgcccatcatcacctgctcggcgtcgcgctggctcagcgcgccattcaccttgaggatgtcacgcagggtctgacccttgacgtactccatcaccagatacggcagatgctcgatctcgccggtttccgtggtgacggtttcctcgcccgaatcgtagatgttcacgatgttcgggttgttcatctgcgcgacggaatgggcttcacggcggaaacgctcaaggaagatgctgtcagtggcgaaatcggcgcgcatgatcttgacggcgacggtacgccccagacgcgtgtcggtcgccacatgcacttcggccatgccgccacggccgacgagttggccgagctgataacggcccccggccagagaggtaggcatgttgatgttcatccctgttccttccaatcattgctcacggagatatggggtttgctgaccacacgtcggggaagccttcctcccgaagagacgaccatcgtgtcggccagctgcgtctgctggtcgagcagacggcgttcgatgcgggacagggtgcgtgacaccaccagcgcgtccttcggacggtccagcgggtccttggccaacatcgacatgacgaattcacgcaactgcacatcgacggtgtcgggcagcggcggaaccggattattgacatgtgctgcggcgatgtcgaccggtgtggcgcccgtgaacggacggtgtccgcacaggccctcataggcgacgacgccaagcgaatagatatcggattgcggcgtggcatgcttgccctgcgcctgctccggggaaatgtactgcgcggtgcccacgaccatgccgtcctgcgtgatctgctcctggttggtggagtaggagacgccgaagtcggtgatcttcacctcgccggaatcggacaccatgatgttcgccggcttcacgtcacggtggatcacgccatgggaatgcgcgacgaacaggccgcgtgcggtctgaatgagaatcggcagcagcttgatcgggtccatcgggccgttctgctcgtggtacaggtctgcaagcgacttgctcggcacgtattccatgatgaggaatccgatgccgtcatgctcgtaatattcgaacagcgcagcgatgttcggatgcgcaagattggcggaattatgggcttccgcgcgcagacgaagcagtttggcctcctgggtgacgcccaaatcgccacgtagcgccttgatggccaccggacgtccaagttggatgtcatagcctttccacacttcacccataccaccttgggccaggcgggaatctaacctgtagcgtcggtggatgagctgtccttcaaccagtttcattctgccagcgcctcctgcatcattgctttcataatcggtcctgccgcgaacgagccgtacaggtccacgttatgcaccacgaccgccaccgcgatcttcggatcgtccgccggtgcgaatccgatcacccagccgtcgatggacgtattgccgtttccaatctgcgcggtacccgtcttgacggccacctgcacgccgttgatggccagattcgtgttctccttggtgaccacggcctccatcatctgggtgagcttgttggccgtatccgcactgaacgcatgggacatgaccgtgggcttggtctgcgaaatgaccgacaagtcggcggaacgcacgcggtcgaccagcgtgggctgcataagcttgccatcattggctatggcggcggccaccatagcattctgcaacggtgtcaccacggtgtctccctggccgatagacgccaatgcgagcttgtcgtcgttgatgtcggtggggaacttcgacgtgaccgacacccacggggttccggtgtaatcggaaccgtccacggtgatcgggctgtcaaaaccaagtttcttggccatggacgagacggcgttgtcgcccaacgacacgcccaactgggcgaacgcggtgttcgacgaatacgccagcgcgtcctccatggagatcttgccgtcagcgccgtcggcctgcggtacggcgttggtcagttgcgtgacggtgccgggaagcgtgtagcttgctcctgccggaatctgcgtatccggctggtattggccggtttccaaagccgcggcggccaccaccgttttgaacgtggaccccggaggatacagctgcgaagtggctcggttgagcatcggattggtggcgtcctgggacagcacgccgtagttgctgttcgcctggctcatgtcatggctggccagctggttcgggtcgtagctgggcgtgctgaccatggcgaggatacggccggttttcggctcgatggccactgcggcgccatccgtgctgccgaggctgttgtatgcggcctgctgaatcttcggatcgatggacgtttcgatattggcgcccttgttctcctgcccggtgaacagcgacttgaaccgctgccagagcagctgctccgactggcccgacagcagcgagctgcgggacgcttcgacgccgctccagccacgctggctgatggagaagaatccggtgaccggcgcatacagttcgccggcggaataggaacgctggtacgagaacgaatcgttggaaggatcggattttgcgatgaccgatccgtccgcggcgagaatggacccgcgcggtgcgccgtattcgtggtacagcgcgcggacgttacgtgcgtcgttggtgagctggttggctcggatggccatgatgatggtggtggacatgcccagaatgacgaacaaggccaccacgatggtgaacagctggcggagcgacttattcatgcgatgctccttgctggtcgatcgtcggcaggactccggttatcggaatcgtcggattggattgatcggtctggccggcttggctggtttgattggcgggcacggcatgacctgcttgtccggctgcgcccgcatggtttgcccgcacggccgggatggccgaagccttcgccgcacccgaacgcgtattgccggcgatttcggtacgacggttccgctcgcgttcgcgcaacaccctgacggcttcctgctggaatgtgtcgctgtcaatctcggattccggcctgttcgcggaattggagatgacgatcagcagcgcggccagcatgtagtttgcgatcagcgacgaaccgccggccgccatgtagggaagcgtcagaccggtcagcggaatgaccagcgtgataccgccgaccacggtgaacacctggaaggccatggtgaacaccaagccggacgcaagcagcttgccgaagccgtccttgattttcatcgcggtgatcatgccggctgcgatgatcagcagatacagcatgagaatggccatcaggccggtcaatcccagctcctcgcccaatgccgcgtaaatgtagtcggaatttgcgatcggggtgatcgacgggtggccctgaccgaggccggtgcccatcagaccgccggaagccaagccgaaaatgccggtgacgagctggtatgagccgccgtattccttgttgtattgagccgcggagaacgggtgaagccaggcgtccacacgcgagccgacgtggctgaagatgcttgccgccgccaccgcgccggcggcgaaggcgatgaatccgatgacgatccagcttttacgcccggtggccacgtacagcatggacacgaacatggcgaagaacatcagtgacgtgcccagatcatgctgcaggaccagaacgcccatggagacgatccacaccacgatgatcggtcccatatccttgatgcgtggcagttggatgccgagaatcttctttccgccgacggcaagctggtcgcgatggtcgaacagatacgaagcgaagaagaacgccaggaacagtttggcgaattcgctcggctggaacgatcccaagccgggaatcttcacccagatgcgtgcgccgtactgttcggaaccgaccaccggcagcattggcgacagcaacagcacgatgccgatcaccatgctgacgtacgagaatcgccgcaatacgcggtaatccctcatgaacaccaccagcaggttggcaaacaccagtgcgatcgccaaccaaagcaactgtcggaacgccactgtggttttggtgtcttggtcgaggcgtgcgatcatcgtgacgccgatgcccgtcaataccagcacgcagcacatgaccgattggtcggcgtgcggctggaatcgcagcagcagaccccaggcggtcaggaacagcgcgcttacgaacgcgagcatccacacatagttttgcgggaagccgttcgtggtgcgttcaaacatctggaagaacgccaccgcgcacagcagcatgctgaacagcagcatgccaagctgtctcaagcgtgttgcgatcatgacttgtcaccgcccgacttgttggtctgcgcggcctgatcggcggcctttttcgccgcttcgtcctgctgcttctgcttggcggctgcttcgtccttcgccttctgctcggcttcggccttctcctgctgcctcgcctcttgcttgcgcttcgcatcgttcagctgctttttgatcagacgggtatggcttttcgcttcgccgtacgtgtcgaaggagatgccctggtcaagctgttcgcgccagcttggcggcagatcgctggtcttcatattggtgtcggtgacggcatgtgacagtttggcaccgaagatgctcgtcggcacgccttggaaaatcgccactttgccgttgttgtcgccgatgtagtacttggtttggctccaacggtaggtgcccacgcccacgccggcaacgccaagcagcaccagaatgatgatgagtatggtgatgatgcggttgcggaatttgcgcgaccgtttcgtcttacgttcctcgatatgttcgttgcgaatcgccttggcgacttccggatcgttcggatcggcggaaatacgcccgttgcgcttctgcacaatcggaatttccccggtatcggtattgacacggtcgccattgtcttcgcggaccgacgacggctgcgcgacgcgctgttccggctgtttcggctcctcgttgggatccttgccgctgcgcagggccgcggcacgcgccgccggcgactgtttgccttcgcgcagaggcggggcggaagcgaccggttcgttgacgatgtccgcgatggtttccaagcttgcgctggccgcgccgccgaccagcggcgtctgatgcggcaggtcgaacgcgtccgcgtcgagcgcgagcgtcgcgtcggcgatcaccgcggtgacgttgtcggtgctgcccgcacgcaacgccatcgatacgagccgctgcgcgcactcctcctgatcggcgcaggtggacagcacttcttcaagcgtggaatcttccagcacgccgcacaggccgtcggagcacagcagccaacggtcgcccggatgcgccttgcggatggcgatgtcagggcgcgaatcgatgtcgaaatcgcccagcacgcgcatcaccacattgcgttgcggatggttgcgcgcctcggcctcgctgatacggccggtgtcgatgagatgctgcacgtagctgtggtcgctggtcatgcggaccagatggccgtcgtgcagcagatacgcgcgggaatcgccgatatgcgccaatacccagcagccggcgaccagtgccacggacgtgacggtggtgcccatgccggcaagacgacgctcacgtttggctttgccgacgatcgcgtcgtgcgcggccatgacggaagtcgccatcatatgggagacgacctgcacgtcgccgtcaacattgtcctgttcgatgtgcgccagcgaccggatggcgatggtggaggcggtgtcgccgccggcatgcccgcccatgccgtcgcagatggcgatgagatgctcgccggcgaacgcggaatcctggttgttggaacgcacggtgcccacgtcggagacgacggtggaatacatgaacaattgttgcgaagcggtggaagtcggcaaaaacgtcacctcaattcgaaggtggtcgcaccgatgcgcacaggcacgcgcgcgccaagaatcatcggcgcgttcagacgctgatgattgacgacggtgccgttggtggatcccagatcctcgatggcccaacggccggtggcgggatcggtgtagacgcgcgcatggtgggaggaaacgaattcatcatccagcaccacggtgttcgaagcggaacggccaagtgtgatggtgttgccggccagagggacggaactgccggcaagggggccatcgataatgaccagcagagttggtttggcattggttgcggcgcttgccgaaggggctgcggcggctacgggcgcaggcgattcgacggccttgcgcgcggcgcgctccttacgacgatgagcccgcgacttgcgcgggctgagcgtttcgatatccctgtacagcgaacgtaccgtacaggccacgaagatccaaagcagtacgagaaacccgtacttgaggatcgcaaacgttaattcagtgagcatagaaggcggctctccaggttggggctgattactcctgctcctgcgaggaggcccagtacaggatgcgggttcggccgatggtgatcgtgttgccgtcgagcagcgttgccgcctcaacatgatggccttcgacgtacatgccgttggtggagttcaggtcgcgggcgatgacggtgttgccgttgtcggtgacgtcgatctccatgtgacgacgggagatgccggggtcgtcgatgacgatgtcgcaatcggaaccacggccgatgatggtcttttcctcggtgagcagatactggtgctcgccgatctccaacatcgggcaatcctcggtctgcgcgtcggtcgtgaccggcacggtgttgccctgcacggattcgctggaaagccggtaatcgcccttggaaagttcaagatcctcttcgaagatcaccacgaccgggccgacgaacgcgtagttctggctcttcgcatactgggtgaggttgtcggcaagttcattggcgagcgtttcggcgccccactcgacgatgttgttgaaatccggagtgctgagcttgaaacggtactcgttcggggctacggtgcgatcgcgcgtgacgggcatggcttctttgtcgatctcgcgttccagagcgctggaaaggtcgacgggcttcaggtctttagacccgaacttcgcgaaaaccccgttgacggcgccttccacgctcttctcaaatcggtcgagaacactcatacttgtccctttctgtccttgactatcctacgctgtagcctgccgagcgccaattcgaaggctacttgcttgcaaaaatttcatgtgaagggggttgcgtccggggtattggcggcgagtggtgcgtgacggtcggtagattggaaggtatgaatgatgcgattgatgagtttcctgggctgaaggcccgtaccttgcgattcacctgcggcgcgccacgttccgcccgcgcgatcggcgacggttcgcgtgcgctgttcctgcgttcggacggtccggaggacaccgtcacctccctgtggatgagcgtgatcggcagcgatggcgataccgacgagattctgcttgccgatccgcgtacgctgctggctgacgccgacgccgaggatgtgccggctgaggaaaaggcgcgccgcgaacgtgcgcgtgaaggtggttccggcatcgtcggctattcggtcgatgcggccggcaaccgcgtgacgttcaccatcaacggccagctgttcctgacggatatcgcggccggcgtgacgcacggcatcgccatcgacgaaccggaattcaagccggtgctgaacccgcgcatcagccccgacggacgacacatcatgtatacgaccggcacgtatttggtggacgtcgatcttgcggacgtgtcggacacgacggacgcaggcgaagacgcgggcgatgcggtgtccatcgtcgcgtccgttccgcaagacgacgctgacgacgttgccgatacgcaggacggcacgaaagatgacgcgcaaagcgacgcggccgaatcgcaagcaggcgaatggaaaatcggtctcgccgaattcgccgcaggtgaggaaatggaccgttacgacggcttctggtggtcgcctgattccaagtatgtgctcttcgaaaccttcgacgcatcccacgagcagacctggtacatcgccgacccggccgatccaacgaaacctgcgcaggcccgccgctatccgcaggcgatgacggccaacgccgacgtgcatctgacgctgctggaactcggctacgatacggacggctgctactacggcggcatcgcacacaacgtggaatgggaccgcgaatcgtacgaatacctggccgccgtcagctggaccgaaggccacgagccgctgctacttgtgcaggaccggcttcagcagcacgaccaggtgctcgccgtccacgtgggcgagcctatcgtgaccatgagcgcgccggaaaacggcttcaccgacgaggacggcagcgaagtggagaccttctccatcgccatccccgaatacgcgcccggcgaagaacccggcaccacgcgcgtgcttgaggaacatagcaacgactgctggctcgacctgatcgccggcacccccgcatacacgcctgacggccgtctcgtgtgcgcgatgaacgacatggacgccgacacgaaccgtctgaccgtggacggcacgccattcacacccaagggcctgcaggtgcgcgaagtgctcgacgtgaccgacgacgacgtgctgtgcgtggtgcagcgcacgccggaactgctgccggccgccgatctgccgttcctgtggcagtccaacgcggacgatcacgacgcccgcagcttcgacgtggtctcgatccgttacgacggcgactgggagccgctcacctacgttcccggacagtggacgatgagccgcgccggcgacggttgcgtggtgaccggccgtggcatggacgatgccgcgatgcagatgcagcattgcatgaacgtgcgcacgacggacggtgatggtgatggcgtcgacgccgccgacatgatgtcgatggtggtttcgccgatcgaaaaccacgccgaaacccccggtttcatgccgaacgtgcgattcgtccgcctcggcgaacgcgccctgtacgcggcggtcatcctgccgtcggcggacagcgcatacgcgcatgccgaccagttgccggtcctcatgaagccttacggcggccccggtttccagcaggtcgtggaaagccagtcgttctactgggacgcgcagtggtgggccgaccaaggctacatcgtggtcaccgccgacggtcgcggcaccaccggccgcggaccgaagtgggatcgcgcgatctacgaaaacatgaaagccgtgacgcttgaggaccaggtcgacgccgtgtacgcgctgcccgacgcgcttgcctcgatcgccaccaaaaccggcgttgccgtgccgaaacccgacctcggccgcgtggcgatgatcggctggtcctacggcggcttcctgtccgcgctcgccgtgctggacgcgcccgacaccttcgccgcggcctgcgcgggcgctccgccgaccgactggacgctgtacgacacgcattacaccgagcgctacctgggactcgatccgaccacgtacgaacgtaacagcatcgtcgcggacgcgccgaaactcagtcgcccgcttatgctcatccacggtttcgccgacgacaatgtgacgatcgccaatagcctgcgattgagccaggcgctgatggcggccggcaggaagcacacgttcctgccgctcaacggcatcacgcacatgaccaacgacgagacggtggcgcgcaacctgttgctgctgcagcgcgacttcctcgccgacgcgctggtctgacggtgttccggcggaactgacgttccgatacaaccgaagaaaaaaaagaacgcgtccccctgcgattcgacggactgccaagtatccgtcgggtcacagggagacgcgtaacccttctcaatagggaagataggatggcgtgaacacccctgcaagtaagggtgtaccacatctgtgtagcaccttttgtagtaccctttcgtttctcgcgaccgtcggagccagtcacgattcggggtgtccggcaaggggtggcagggtttcgggcaccggaatcggcagataggcgaacagcgtccattcgccgtcgcgcagcgttgtctcgagtttgccgccatgcgattcgagctgtttgctgaaatacgcgaggccgtggcctcccggctgcgtgcgatccgtttcggtggtcctcgcctggttgatctgcgtgatttcgacggcgttcggcttgagtatcaccgacaggtcggctttgctgccggactgggcgtgacgcgcgatgttggcgtaggtctcgcgaagcagatcattggcgattccggccaggctcggggaggcgcttggcgcaccgcccgccacatggaggatcgaggtgatgtcgaagccgagcgcgcgtagacgccggtcgccgccggccatcgtggctttgagcaggtcggagaaggccttgccgtccgcatcctcctcaaggacggtgacgtccatatccagttcgtcgatgacgcgatgcacgttggtcagggcggacaggatgtaatcgttgacctgcgtccatttgtcgagctcatcgcgtctttcgtccgcgttcttgccgtcgtcaccatccgtcgaggcgctgccatcgccatcgcctccgccggacaatgcatcgatgcgacgttgcgcgacgaaagccgcggcggacagatctcccgtcacggcgtcgtgtatggcttccgcgatgtgactgcggctttccatctcccgtaatcgcgctttcgcctgctccgcctcggcgcggctgccggctacggcctggttccatcgcaaaccgcatccgagcatcagtaccaggctgaccatggcgatgatggccacgggattgctgcggctcgtgccaaggaccagttgacggaacagctggtcgcctatggaataagcgagcagcagcagcgccacgagattgttggtttcgtaggcgagcatgccgaacgtgtaaaggattcccggcagcgagttgacgtcggctccgggtatgagccaaggtcccgactggctcatgatcagaaacagcagcgacatcgatttcggaaagaacggtgacagcagcagcaccgcgatttcgatgatggtccagacgatcgccgcgggattgtcggtcggggcgagcaccaggcagaacaggatccaccatacggtgatgaccacgatggttatgcggatcggatgccagagtttcggatggtcggcacgcatatggttgtgccaggagcggaaggcgcttacgggtctgggttttgtgggttcagcgtgcatgcgatctcacccacaatgccactgcctggcgtgccgtcttgcagttcagcttcttgagaatgccctgcatatgcttgcgcacggtgctttcggagatgtccagtcgttcggcgatctccctgtccagcatgccgtcggcgcacagggagatgatttgctcctcgcgcacggtgagccgcggtgaggtctcctcctcgcgtctgatgcgcacgttggccagggcgggaggttcgaatccctccataacgttgcctccacagagccgctcgatggccttcgccagctgatcggaatcctccttgccgatcagtccctgcgctccggcttccatcagcctgctacggtagctgttgatggagaagctggtgatgcccagaatcggcagatgcctgtccatgagacggatccgatggcagatggccggcccctgcaagccctccatggacatgtccaatacaagcaggttgagattgtcgtcgttcctctggcaacgttcgatcgcttcgtcgccggaagtggccgtccacaccacgtaggccgtggggaccttcgcttcgatgagaaggctcagcgattccaacgcgcgaggatcgttgtcgaccagcgctacacggtggatttttggtatgggagctgcggatttcgcgggattcatcgcatggctcactttccacacagccagtaaagcggcggcgggcagtcgatgatggcggatgcggttcctctcgccgcgtcggcgaagatggcagccttcccgttggaaggggtcatcgttccggctggctgcatggtgcagagcatgacgaatgccacacacaatgacatgattttcataccgacattgtacgggggagcgcgtccacgagtgaggaggcgcgttcgatccgtggagccgaagcgtggggctctgaaggctgttcatgtgggattcgtatgatgaaagcatgactcttaggctgctcgacgaggcgaattacgacgccgaaatggaaagcaaggtgctgcccgcgctggacgcctgcatgacggaaggatggatggatccagccaccgttgactggaacggcgacgcgctgcccaaactggacgaacccggccggttgcactattgctgttacgacgcggccaaattcgacgtgctgcgtgaggacggcgcttcgggcgtgttccgcggtgcgatcgtcatttcgcacggattcaccgaattcgcgcgaaaatacagcgagatggcatggtatttcctgctggccggctattccgtatgcatcctcgagcatcgcgggcacggtcattccgtgcatgacgtggacaatcccagcctggtgtggatcgacgattggcgccggtatgtgtccgatttcgcagccttcgccgacactgtgggccgcgaatacgcgtgcggcgagccactgaacctgtactgccattcgatgggcggcggcatcggcgcggccgtgatggaacactatccgagcctgttcgacaaggccgtgttgtccgcacccatgatcgcccccgtcgtcggtatgccgacatggatcgcacgcatcgctacaggcgcgttgtgcggcttgggattcggcaaagcgcgcgtattcggtcacaccgatttttcccccgaactcgatctcgacgagcataagggcgcgtccgaggcgcgcgttcgctggttccacaagcagcgcgtcgacgacgtggcatgccagaccaacgcggccaccttcgaatgggcgcatcaggcgatggcattgtctcgagccgtactcaaaccggacatgtgcggtgcgatcgaaactccgacgctgctgttccaagcgggccgtgacgtctgggtcctgaacggtccgcaggacgatttcgtggaacgcgtgcgcgaaggcggcggattaatcgaaaaaatacggtacggcaagtcgttgcacgagatcttctccatgccgaacacggtggtcggaccgtatgtgaacaagattctcgacttcttcagcgcgcccgcggacagtctgtgagcggctgccactgcaagacacatgcggcgtgtacggtgtgcgatgagcgaacagtgaaggggaaggagccgcagtggcggaaaaaacgttcgaacgcacgccgaaagacctgattatcggcattgcgatgaccctgtgcggcggcgtgctgtggggcgtcaacgccaccgtctccaaaatcctcatgggcacgtaccacgcctcgccgctgtggatcgcatgcgtgcgcgaactggcagccggcgtgcttttcctcacctgctcggccatcatgacgccgaaactgcttaccggcgcgctacgcgatcgcaaatcatatccgcggctgctggccaccgccatcatatgcgtgctgctggtgcaggtcgcctacctcgaatcgatcaactggaccaactccggcaccgcgaccgtgctgcaaagcctgaacctgctgttcgtcttgggggtcgtatgcctgcgcgggcggcgactgcccggcgtacgggaaggcatcggcgtggcgctcgccttcgcgggaaccgtgctgattgcgaccggcggcgatttcaccacgctgaaactgccgttggtcggcctgatttggggcgctatcaacgcggcgtccacggcggccatggtgtttcttccggtcaagctcatcgaacgttggggcaacttcaccgtcaatggcatcgcgttcctgatttccgggcttgtgctgctgccgttcgtgcggccgtgggctacggcgccgcagttggattggctgggtgtggggctgatgacgttcaccgtgatcggcggcacattcggcgcgttctggctgtacatggccggcgtggtgcgcgtcggttcgatgcgtgccaccatgctcggcaccagcgaaccggtgatggccacgatttccgcggtggcatggacggacgcggtgttcgaaccgaccgatttggttggattcgtgatgattctcatcatggtgtttttggtacgttaagtgccgtgacgggcgttgcttttcgggcggcggcgtgcggacaaacaaaaaagccggacacccacttacgggcgtccggcttcgctttgcttagcgattaccgtgacttacgacgtgcgaatatgacgtacggcagctggaaatcagccttcaatcgcaatctgatgcttggtctcaacctgctgctgcgcttcgggcttcggcatttccaggcacagggtgccgtccttgtagctggcgtgaatgtcggaatccttcacgtcctcgccaacgtagaagctacgagagcaagagccggcgtagcgttcgcgacgcagccagcggccgttgtcgtccttgtcctcgtgcgagctgttgcgatgcgcggaaacggtcagatagccgttctgcaggtccagcgaaatgtcgtccttcttgaagccaggcatgtcgatgtcgaccatgtagcccttgtcggtctcacgcacatcggtgctcatcatgcctgcggacatgttcggatcgcatgcggctgcgcggtccatgttgcgccaaccctcgaagaacggatcgtcgaacagatcggagaacatcgtgtcattcatcaaagccggaaacattgccataatcggtactccttaagcaaatgcgcgttctgtgcgcggagtaatgcggcttggcagccggccgtgcgattatcgctgcggcgtcaccatccagcgagaccggcgaccgggttcgttgccgcatccggaaccctcccgggctcctgaccttgacctttcacttcacccaactcttccgtgtcctgctcattccgcgattatgctcacagtgaaataccgggaaatgcttgcgattgcgtgcgcggaaaagtcgtacggcgaatttcgtttttcttcagaatcggacgcatgggattggtctgcaatgcgttacgtatctgtttttccaaccggtcacgtgaagtgtggttttgggtggctatgtgttcgattctgccgaattggttattcggattgtgttttctggagaatcggacatttgtggtgctggttttgggtttggatgtccgtttgtctgtttctgctgagatagctgggctttcggcgcatttttagtacttttttgtcacatttcatacgttttggataaagcaaaagggctggaatcgttggattccagcccttttcggcccgtgcgagcgggggagttgaacccccacgagcatacactcactgccacctgaagacagcgcgtctaccattccgccacgctcgcagacagtgaattaatttacaccaaaacccacgcaacctcaaatcggcgtgtcgtgccgccattttccgtaggaaaattcaagcggcgcgacgcagcttgtccgattctggagaatcggacaaatagacatgcgaatacgcggctgtgaacgggcgtgaatcaaggcagcatcaaatcggtgccgccgagaaaacggtagccgccgtcatccatcaatcgggttttcgcaaaatgtaagcccaagagcgtggcttgcacctcgtcgatgccgtaaatgacatgctcccagacggtctgcccagaagcgtcttccagacgaacgtctacactccaggtgtcctcgtcgatttgcggttcggaaaccgacaacacccgatctccaccctcgtattggaattgtcgctgcatgctcgtctcccatcaaatgcgcgtatcttcgattgcgggttgttcgctcttcgggttggaagatagtgtttggctatttgtcgcattggaacttttccccgctaggcaggcggcataggctgcggctgccccggcccagcatactgcggccgcagcaccgtgtaggcgtttgcatgttttccctaaaagtttatattcgtgatcacacgttgcttttgaggagactgtgactgcagctgcattgcttactgatggattactgatggcgcatgggggcattccctgaactgttgataatatacaagcgaaggtaattgttagaatagttttcagcataatttaatgtcctgcgataactgatattggaattaaattaaaatattcgccagaatttgcgctacgcaatgtgcagtgcttgcgtttacgccatgctgacggaggaattgctcgattttgccagctgcccaattctcaggtttttgcagaaagccggagagatcgccgagccattttgctccactgaaaatttttgccgctactttaagcgctttggctacatttcctacggctccacgactctgtggcacgtcatccgtgtcattcaatggttgcaaggcgtttgcatttttagtggggaatattccggaagcctccgcctctgccgggtaagcatattgtttgtcggctgtgggctggacggagaggctatgtgcttcgtgttcgattgctgcgctgttcggcacctcatccatgctgggaagcgaagcttcatctgccattgctgtcgcgctccccgatgcaagtgtcgcacaagccaaaatagtcgcaataacacgtaacgtgttctttttcatatatatgtcttttcgtcaagttgacgtgacatcagtcgagagtagaagcgtgttcgcaattgtgatagagtgctgtcacctgttaggggacgtgtcgcattaaatattcaaacgggtgacattgctgttgtacggaaccgcattgcgtgatttacatgatgacggaatgtgtcccccggtgaaaggtgtgaatatgcgacggaagcaaaatgcatgcgactcgaacggtggcgtacatactgagcgcgtgacggccggcatgcatgaccttacatatggcttgaaagattttttccgcgaggtctttcttgataaggatgatatcgactatgagcgccgctttgacgtgcgttccttgccattgctggttgtagcgatggctgcaggatggctctattctcgtgatggaaacggattctatgcgtgtgtcagcgcgatttttgctgtttcctatactgtgtatttcatcgtcaatcgaggcgtgtacatcgtgcgcctgttccgtggggaaaatattttcggtaaacggcgtgtgagatgtatgaaataccgtggcacgatacattcgtcggttgcgggcgggctggcaaaagccttggaaaaattcgttgataacgatacgctgtatgcgtatatcggcggatatggtgttccgttgctgggcactgcgacaatgattgcttatgacgcgtcgcactggttatggttggcattagtcgggggagtcttgtgcgttgtatatgcgctgtattggctgatatatgcatttgttgccgcgcatcgggcgcttatcgcagtgcttgcggatcgcgataggagattggaacaggcgggttatcgcatgacggttatgcgccgagatgcaaaattggccagcaggacgcatgatacggttaccggtggtctgtcgtatattgcctttattgcgcagcagcagctggagggtaaaaccttatcggacgaggaacgggttgcgtggaaacatatcgatgatgcggctcaacgtacgatggacaatgttcatgaagttattgatattcttggacgagatatcgaccccgcaaatcccgttggcggcgaagggtttgattgcgaatcgcaagaaatacagatgccagatgtttcttcattggagagaattattcgcgagcattgtgatgagggggattctcggcttaagacgctcgggtttgttggaacaagtgagattcagctggatgttgcggatgctgatgatactggtgaaagtgtttgtgcggatctgattgatgagtgtacaagtctgattgatgagttatacaccaatatttcttgtcacgctgatacgagtcagccatacgctgtttttgtcagtagcgagaacggatgcctccgcatcacgcaggtaaacgctatagcgtgcccgcacgatgcgcagagcggctataagaagaaggtttcaggaaggggacttgcgtttcatcggaggatgcttgacgcgatgagcgggtcgattactacttgtgaagagggtgatacttggacgctgcatgtggtcataccgttgtgaaaacaataggttttggtgtagatatttgataattattcatgctgaagctttataaaatatcgcaagtaatttggtagttaatgtaatggaaactaatgtggaaagaattgacaaatcagttgaacatataggaatagtcgacaatgatgtgttgacgttgggtgcgttgtctagctatttggctcaacaatttggagacgagaaaattttatggcgatgcacgcttggtaaaaaagctgcggaattatgtagtaattcgcaaacacgtccccagatattactcatggatatgtcattatctgatgccgatggcgtgcagatttgccaggagattcggcgtactgttgacgatatgccgattttggcgattacttcttttccgttgcgccgatatgctgctgcggtggctcaggctggagtgcaaggcattgtcgcgaaacgaaatttgcgcactattgccgctgctctcgaatgcgttgtatctggacacgtttatctgccggatgagttagcggaaaccatgccggatctgcattttgagttgccagtacaggcgcatcgtaggatcgatgcagagactcttggcgggcaggccgtgaaaccagttttgtccgatcgggaaacggcgattatagtcaggtatgcgcgagggcagaccacacttcaagtgggggagtgcttaggattatcggagaacactgtcaagacttataccaagcgtgccatggcgaagcttggggcgaaaacgcgaggtcaggcaatagccctctggctgatgcaaaccatgacgcatggtgtgtgatttaggcagcttttatctctgataaacgtatatgtgctgtgaccgattctggagaatcggacactcgttgggtttaggaaagggcttgggtgtccttattctcccgaatcggacacatgggacgggatacggggaggcatgaaaaagcgccgacgggggttcatcggcgcttgagctgttttcaggatacttaatccggagtggctttgcctcagcccttggagccgttttcgtagaagtgcgcgagcgtctcgtcgcggaacttctcgaaatatccgccgtcgatcgacgcgcgaatgtcgtccagcagcttcacgaagaaatgctcgttgtggatcgtggccaatgtgaaaccgttgaattcgcgggcgcgcaacgcatgatccacgtaagcacgcgaataatgcgtgcacgtgtagcaatcgcagccctcttcaagcgggccaaaatcatgcttgaattgcgcgcgcttgatgttgtagcggccgtggcgcgtgaagatcgcaccattgcggccgcaacgcgcgggggccacgcagtcgaaggtgtcgccgccgttctccacgcaggcgaagatgtcgtccaccgcggcgatgccgagcacatggcgcggacggctttccggcatcgcgtcacagatccaggcgcaggtgtcgccgatgatgcgcttctcgatcgcgccgccgatgccgacgccgtcgaaatcgagcgaagcgatctgttcggcggcatgcctgcgcagatcctcgtaattcgcgccctgcaccacaccatacagcgcctgatacggcttgccgagacgttcctcggtaagccgcctgtgctcggccacgcaacgttgcgcccagcggtaggtgcgttccacggaacgttcctggtagccgcgggtgttcatcagcgtggtcagctcgtcgaaagcgaacatgatgtcggcgccgatcttgtgctggatgcccatggagatttcggcggagaaccggtgcagcgagccgttgagcggcgacttgaacgtcacaccgtcctcgtccacgaacgcgagccgctccttgccttccgcgatcacgtcgtccgatttcatgccggtgacgtccatggcgagcgtcttcttgaagcccgcgccgagtgacagcacctggaatccgccggaatcggtgaaggtcggaccgttccagttcatgaatttggcgagtccgccggcttcgtcgagcacctgttccccggggcgttcatacaggtggaacgcgttggacagcaggcattgcgcgccaagatccttcatggtttcgggcagcacggccttcatcgcggcctgcgtggccaccggcacgaacgccggggtgtggatgtcgccgtggggggtggatgatgccggtgcgtccgtatcgcgcgccgccgcggcccttgccatcggccgcatctggcaggcgggttttctgctcgaagtagaacgcgtcgcggcggccgggcttgccgggttccgcgccgcggggatgctcaataaggttttcggtcgatgccgcgctggtcgtgttgcctgctgcgtcgtgcgttgcgccggctgccgcgttggccgctgaggtctcgtgcgccaccgcgccggtctgtggttcgttcaagcttgtcatgctctcaactgtatgcgatagcgccgattgccgcggtggcgccatcggcggtcgacggtggcatcgtatggagtaaactgccaagcgattcgattgctactttcaacaaacattcaggaaacttccagagcaggtatctttactcttagatagcagttcgagcggcacgattgctgaccatgttgaatgccgcgagacgaataaggagcaacaatggctgaagataatagcgatcagaacatcgcccagccgcaggatggcacgcagcagaccgcgccgcagacgccgagcgagaacgtcgccgacgaagcacagacttccgttaccgaaccgattgcagtgccgaacgcgggcgagcagcccaccaccgcccttcctaccgtggacgcggcggatggcacggcaggcaataccgctgacgatacgccggattatgcttccgctgccggtgaacgcacggtgatcaacaacgcgacgcaggatgcgccgaccgaacagtaccgtccggcgcccgaatacggcgcgtacggtccggtgccgacgccgccggctggcgatgccagcggccagaccgtccagcaaccgcagtacggcgcgcagcagcagggccagcgccagccgcaggacaaccgtccgtcgttcttcggcgctttcggcaacccgtatacgaccggcaatcagcggaacaatggcaatccgttcggcaatccgtttggcggctcgtccgcgcagaacggcgcgcagcagaacaatcagcagcagccgcagtacggcgcgaacatgccccctgcgggaccgggcaaccgcaatccgttcggcgctccggggcagggcttcccgaaccagccgaaccagacgccggtcgtcaccaagcagaagtccggcatgaccagccatgtggtcaccgccgttgtggccgcactggtgtccggcgcgctgtgcctcggcgtcggcttcaccgcgatcaccaacggttgggtgcatgtgccgtcctccagctcgctgtccgacgtcaagtccaacacgtccggttccggttccgccaaggcgaagtccggtacggcggtcgattggaccgcggtggccaaggaagtgtccgattccgtggtggccatcgacgtggcgaccagcgacggcgaagccaagggctccggcgtggtgatcagcgacaagggctatatcgccaccaataaccacgtgatttccggcgcgcagcagattcaggtgacgctcgccagcggcgccgtctattccgcgaaggtggtcggcaccgacaccaccaccgatttggccgtgatcaagctcgacaatccgccgagcgatctgaaagtcgcggaattcgccgattccgacaatctcgccgtcggcgaggccgtcatggcgatcggcaatccgctcggctacgacgacaccgccaccaccggcatcgtgtccgcgctcaaccgcccggtgaccgtgaccgatgacgacaacaacgctatcgtcaccaacgccgtacagatcgacgcggccatcaacccgggcaactccggcggcccgacctttaatgcggccggccaggtgatcggcatcaactcgtccatcgcctccaccgcaagctcgtccggcacggcaggttccatcggcatcggcttcgccattccggcgaacctcgtcaagcgcgtgaccaacgagatcatcgacaacggttccgtgaagcatgtggtgcttggcatcaccatcaagagctcctcggtggaagcggacggtgtgacccgcggctgcgcccaggtgcaggccgtgaccgacggtggcccggcgtccaaggccggcgtgaaggccggcgactccatcgtggcgttcaacggaaaggcagtgaacaacaactactcgctgctcggttacgtgcgcgcctccgccatgggagacaaggtgaagctgaccgttgtgcgcggcggcaacaccatggatctcgaagtgacgctcgaccaggaagagaccaagacgaactcctccaacaagcaggaacagcgtcagcagaacaacggcaacgacgataacggcaacggccagaatggcggcagccagaacggccagaatggcggtaacggcaacaacggcgacggcggtggcctgttcgatccgttcggtctgtggtaaagccggatgcgcggcatcgtacggcaacgtacggtgtgcggcgttcatgccgacagcgatacgggtggctgccacccgataggctgacggcgaagtcgcaaccgcaatccgcgtaatcgcggaaaacgctgaacaagccgaaaaacggcggaaaacaagggctgtgcgagcaatcgcacggcccttttcgtatgcgcggaacgcgcgcgacgaacggaagcacacgcaaacgaccgcggcaatcgcaatgctctgttatgctggaaatatctttttacgccgtgtatcgatggtccgcgcaggcggggcgccgatgggttaacaaggcgtccgatacgagcgtaaggagattctcatgcgtagaatcatttccatttgcaaagaagttccgctgctgccgatcgccatcattgccgcgattccgttggcattgctgggttcgtggcgtccgtgggaggctgcgggcgtctcgctgactttcggaccgttcaatccgggtgtcgggcagtggatcgtgatcgcgctggtcgtgtacacgattgtggtgactgtgatcggcatgattgacgatttgcggcacggtcacgtcggtgtggatttgcttgcggttattgcgatcgcgtcgacggtggcggtgcaggaatactgggctgcgtgggccgtggtgctgatgatttcctccggcgaggcgattgaggaattcgcacagtcgaaggcggaaggcaacctgacggcgctggttgatgcggcgccgcggaccgcgcacgtggtgacgttgccgggcgtgggtgcacgtgcggcggctgctggggccgacggtactgccggtgatgctgagggcgacatgacggcggacggctttcgcaaggtcgccagtgtggatgtgcctaacgctgcggaaacgaataagtccaccacccaaaccaagccttacgacgcggccggcgagcatttcgaaaccgttccggtcgaccaggtcaagcttggcgacgtgatcctcgtgctgccgggcgaaacggtgccggtcgacggcgaactgctgtcgggcgtcgccacgttggatctgagcaatatcaacggcgagccggtgccgcgcgaagtgtatgcgggcgcgcgcgtgctgtcgggtgcggtcaacggatcgaccgcgctgacgatgcgtgccacgcaattggcgcaggattcgcagtatcagaagatcctcgaactggtgtcgtcggcgcaggaatcgcgcccgaccgtcgtcaaaaccgccgatgtgctggcggtgccgttcaccattctttcgctggcgatcgccggcattgcgtgggccgtcgcaggcacgccattgcgattcgcgcaggtgctggttttggccacgccctgcccgctgctgatcgccgctcccgtcgcgtacgtggccggcaccggtcgccttgccaaggcgggcattcttatcaaagcgcaggacgtgctggaaaacttgggccgcgtatcgcatatcttcttcgacaaaaccggcacgcttaccgtcaagcagccgcaggtcgtgcgcgtcgagaagccgttcgaaaacagctcgccgtacgacgagaaccacattctgatgatggccggcgtggtggaaggctactcggtgcacattctgtcgaagggcatcgcggcggccgggcagaaggccatgcaggaactgtacgcgcgctatgagaacgggcagcggctgtgcgccgaacgcgatctgccggggcatggacgcgattaccccgtggtgaagaacatcgaggaacagtcgggcaagggtgtgtccggcgaggtgaacgggcatgccgtgcgcgtgggtcgtttcgcgtacgtgacggccgacgaggccggcttcacgcatgtgctgggcgcaggtgcggcggccggtattgcggctggtgctgtggccgatagcgcggttggcgattcggcgaccggtaccgctgccggcgcttccaagaagccggaggtgaattcgctgttcgccccgctcgagccggacgaaatggccgcgtacgtggcgatcgacggcaagctcgccgcgcgcatcgtgctgcgtgacgtgccgcgcgaaaacgcgaaatcgtcccttgaaaaactgcaccggctcggcgtgaagaaactgtccatgctcaccggcgacaaggaggcttccgcacgcatcatcgcgggcgaggtcggcatcgacgacgtgcaatccgaactcttccccgaaggcaaggtcgcggccgtcaagaacgccacggaagacgcgcaccaaaaccagccggcgtgggacaaggtcgtacagcgcgtggtcggcgaatccatgacccgacaggtgacgatgatggtcggcgacggcgtgaacgatgcccctgtactggcggttgcggacatcggtatggccatgaccgacggcacgtccaccgccgcgtccgaatcggcgcaggtggtcatcatgaacgacgacatcgcctccgtgccgcgcgccatcgccatcgcccgccgcacgaagaaagtgatgctgcaggcggtgctggtcggccttggattggcgattatcggcatggtcgcggccgcgttcaacctcattccggtggtcgtcggcgcgttcatgcaggaagcgatcgacgtggtcagcatcctgtgggcgctcaccgccctgctcgaccgcgagtagcgccggttgcggcgacgagccgtgcggaggctgaaccgcgttgcgccgtgctacatcgagctgggcgagatttcgccagcgatgttccggcgcatccacgtgccgaaatcggccgcgtccacgccctgcgacagcaggaacatgatcttcgcgtatgcggcttccagcgtcatgtcgcccgatccgatcgcaccggcgcgggcgatcgcgtcgcccgtctcgtaatggccgagcagcacttccgcctgctgacattgcgatgcgatgacgaccggcacgccgtcatgcagcacgtcggcgatcacgtcggtcagtcctggctcgtcgctcggcacattgccaacgccgtacgcgcgcaacagcaccgcttccggacgagggtcgagcatcgcggccaatcgcgcggcggaaatgccgggagccatgtcgatcacggccacatcgtgacgggagtagggcagcggcgacgcccaaccgcaaccggagccggccgaatcgcccgcataccaatgccacggcgtgccggtacgtgccagcgggccggtggacggcgccgaaaacccttcgaacgcccagcttgacgatttgctcacacggttgccggcgaacagatgatggccgaagaacaggccgacgccatgaaaacgtccgctcatcgcggcgttcagcgcacccgtgacgttcgcggtggcgtccgattcgattttgccgagcggatgctgcgaccccgtgaaaatcacaggcttgccgaaaccggtcagcgcgtaagacagcgcggcgctcgaatagctcatcgtatcggtgccgtgcaacaccacaaatgcgtcggcgtcatcgcggtgcgcgcgcaggtcgtccgccatcgtctgccaattgtcgggcgtcgcgttcgacgaatcgatcagcgggtccagctcggtgaacgagaacaagctcgggtccagatgcgcgtcctcaatcagccggcgcagccagccgcgcatatcggcgcccggaaccagaccgttcggtgactcgaccataccgatggtgccgccggtatacgtgatgtgaatgcgcatggttgcctttctgctgcgtgttatctgccggcgcgtatctctatgtgcgtgtctctgcatgcttgtccttgtgcgcggaagccggatgtcatcgtactcgccgtgtgccgttgccgcgattgcggttttgtctgtcgtcgccgcggtttttcgaaaaccagttgcgattgtacgtgccgcgtgcgtccgattctgaaagcatcggacgccgagagcgtgactgcgatggggcggtgagacaggcgggtttccgaaggttcatcataggtttgccgaaggttccccgtgggatgtttgagaggcgcatcacagtgccgtaccgtggtcgcatgtgcgttattatgcttatggcttactgatgggggatattcaacgcgtggggcgcggaggatggggttatctatgaatacggttgctgactgcctgcaacggcattaccgtgtggtggtgttcgccgtgtatcttgcggtggtcatcgtcacgatggcgttccacgagccgtggttcgacgaggcgcaatcgtggcttattgcaagggattgcccttatcgagacctgctgctcgtccgcccgcattacgaaggccatccgccgctgtggtggctgttgctgtcgattccggcgaagctgggcgtgccatatgaatgggggttgaaaggggttgagctggtctgttcggcattaatgtgcggattgttggttttccgcgcgccactgccccggctggccgttgcgctgctgccgttcacctactttctgtgctaccaatacggcgtcacctcgcggccctacgcgttgatgtgctgcgcgttgttcgtcatcgcggcctgctggaaatcgcgcgatgaacacccatggcgattgacggccgcgttcgtgctgctgtgctgcaccagcagttacggcattgcgctggcatgcgcgttcgcattggtttggatggtgcgtgcgattcggggcgcaacaggccgtcctgccgtacgtgacgggcttttcggcaatcccgcccggttcgcggcttggatggtattgctggccgtcggtcttgtattgacggcgtgcgtcctgccgcgctccgacacgttcggcgcggtgcaggatcccggcggtaatccgccgatcgcgcaattcgcgctgttctggacggtgctgcccgccgaaagcatgttcaccgcttttgcgggcgatgtttccctgcatggtctgcacatgggcgttcttgcgattgcgttgtgcgtggcgctgtcactggcgatttggagcgtgctggcacgggtcgcgttgcgccgcaagaacctcgatctgctgttggtcacgtatgttctgctgagcctgtgcgcgacgaaatacttcagcatgcaccacatcggcatcatcttcgcgctgttcgtcgtgcaactgtggatcaacgtgcaagacaaggccctcggaatcgccgatattccactgccgacgcctctttcgcgttcgctgcgcgccgcctgtgccacgcacgccgtccgcgtcgcgcacatcgcccgtatcgcaatcgtcgtggcgctgctgccaagtctggtgtggaccgccgccgcgatcgcatgcgacattcgctacgactattcagccggtcgcgcgctggccacgttcgtgcgcaacaacaacctcgaacacaaccgttgggtgtcgttctggcggtatcttcccgacacgacctggcccgacggcacgcacacgaatcgcatggaagacacgtaccgctacagctggccggcgatcgcggcaaatccgtacttcgcgcgcaatctgctggactgcacgtacgagggccgcacgttcgtgccgaaccaggtgccgtcgcgggcgcagatgaaccgcgaaatcgcaagctgtgccgccaaaggcgcaccggaattccttatcggtgacaccgattttccgcaatatttcttccatcggctcggattgaagaggggcgattaccggcaaatcgtcgtcgccagccagcacgtgccgtggaaaacatgggtcacgtcttccgacatcgccgtgtacgtgcggtcggacgtgtaccgcacgctgccgcacgcgtgacctcaatatggaagagccgcaatacggcggaatcgtaatgccccctgttggaaatgcagggaatatattaggctggaacatatgagcgaaaccaacgaacttcgtattgctgtaatcggcgccggccccgcaggcgtctactcttccgatattttcctgcgccagctgggcaagctcggcgaagagctgggactgggcaccaaggcccgcatcgacctgttcgaaaagctgccggtgccgttcggtctggtgcgctacggcgtggcccccgaccatccgtccatcaaattcatcgcatccgcgcttgagaagacgctcgacaatccggacatccacctgtactgcgacgtggaattcggcaaggacgtgacactcgacgagctgctggaacgttacgatgccgtgctgttcgccaccggtgctgtggaagacaagccgctcggtctgccgggtgctgatttggacggcgtgtatggcgcggccaagttcgtggaatggtatgacggttatccgaccggcgctcgcgaatggccgctcgaagccgaggaagtcgccgtgatcggcggtggtaacgtggccatggacgtggcgcgcgagctgatgcgcaacgccgacgacctgaaggaacgcaccgacattccggacaacgtgtacgaaggcatcaaggccaacaaggccaagaccctgcacctgttcatccgccgtggcgtggctcaggccaagttctccgtgcaggagctgcgcgaaatggagaagctgccgggcgtgcagctgatcatcaacgaggacgatttcgatttggacgacgataccatcgaggaggctggcaaggacaagctaacccgtcagatggtcgaggagctgttcaccatccgcgagatggccgaggacatggaagacgacggcgacaccgatttcgaaggcaacccggcggatcgcaagtactacatccacttcaattccgctccggtcgaagtgctgggcaaggacggcaaggtcaaggcgattcgcgtggagaagacgacgacttccgcggacggcaagatgactcgcaccggcgaattcgaagagtacccggtgcaggccgtgtatcacgcaatcggctacaagccggccaccgcgccgggcatcgcgtacgacgagcgtcgcgcgcacctggccaacgcgaacggcgacggccgcatcaccacggaggcctccggtgagggcgcgcaggtgcgtgagcgtctgtacgccaccggttgggccaagcgtggtccggtcggcctgatcggctccaccaagtccgacgcgctgctcatcgtcaccaacatgctggaggacctgtccaaggccgccgaaggcggtcgcgtggccgctgaccgcgatccggaatccatcgaccgtctgctggcctcccgcggtgtcaagccgatcgacttcgccggctggaagaaggtcgatgcgttcgaacgtgccgaaggcgcgaaggaaggccgcgagcacaagaaggtcatcgacccggagcagatgcgcgcgctggctcatgcgtgaggtgggtgtttgaaacccagtctgataggtttcaggcttctttcatgcgtcttgggtgtccgattctggagaatcggacacccaagacgttttttatcctgtacttgtccgcttctggtgaatcggacatccgggagaagctgagcgtgcgaacttccgcaactgcccctagtccttcccgcggcccagtctccagcgcatatccagcaaaaactcagactctgtttctacgctggtgatcatgaacggcaaactgcaggtgcacggccattgcaatggcttgaagacaacgctgttattcgcgttgatgtggggcatcatcatgctcatttggtgggcggccggtgccagtcaaagcacgcttggaatctacctttgcatcggtattggctcgacgttcgtctcctattggttttccgacaaactcgcgatcgccagcatgcacgcgcagccggtaagcgagcaggaggcgcccgtactgtacaagatcgtacgcgaactgtcggcgaaggctggcaagccgatgccgcgtatctacatcgcaccgaccatgagccccaacgcgttcgcaacgggacgtaacgaacgtcacgcggcggtctgttgcacgcaaggtattctgcagatgcttaacgagcgcgaaatccgcgccgtgctcggccacgagctcatgcacgtctacaatcgcgacatcttgacatccgcgattgcgtccgccatggccaccgtcatctcgtacctcggatattcgctcatgtatttcggaggtggacggtcccgtgatgatcgcgacaattcggcatccggcggcttgggattgctgggtgtgctgttgagcacgattcttgctccgattgcggcgtcgctgattcagatggcgatttcccgcacgcgcgaatacgatgccgacgaggatggttccaagctgacggaggatccggaggcgctcgcttccgcgttgaacaagatttccggcggcgcggccgcgatgccgatggagaagaccgcgggaacgcagtcggtggctgcgatgatgatcgccagtccgttctccgcggagggcttctcgcgcctgttttccacgcatccgccgattcaggaccgcattgcgcggctcatgcagatgggtcaggagatgcggcagcagggcgcgcagtcgggctacctggccggcggatacgcaacgaccggcgttgccgcgatcgacattcgacagggcggttatgacgggccgcagttcggctcgcagtatggttccgcttacgattcgtacggttcgggtccggcgggttcggcgggttcgaccggtggatattcgcgcgactattcgcaacgccccatgcgcagaagagggtcgcgctgacgcccccacagcctcccgcgccgctggttcctgccccgactttcagccttttccggtactgatgttgctgcggacgcatacttgctgtgctgacgactcccaaaatcgctatatgtggcagataagagactgccgagaaagtgatttccgctatatgtggcactttccttcgcgaagatgcccccataccttcgatttcgtaccctctaacagctcttgcccgcggagaactgccacatatagcgcaaatcgattttgcggaaccggacaatctgccacatatagcgggaatggcgtgctagactaatggctcgtgcccaaaaggcacaccttgcggatgtagttcatcggtagaacgaaagcttcccaagctttaaaggcgggttcgactcccgtcatccgctccactcaaaacccttggaatcgttggaatttcaagggtttttctattgtcgtaaaagacccgtgaagccaacttcgcgtcgcgcaactgtcggttgcgtcgcaaaatttggttgcgaatcgcaatgcaaccgcaagatggtggcgtggaacgcgacgtttgtgacaagctgctgatgctttgcgacatgttcggtgtgacgttggatgatttggtcatgggcgacgtgtgcgcgtcggcgggccgtggaggtgcgggacgcgtggggctgtgtggatgcgggacgcatggacttggctgccgatacggctggtgtggcagcgtcggatggggtggttgactctgctgttggtgcggttccgggggtaatcgggttcgcggcatcgcaggttgcaggagtgtccgattctgcagaatcggacactcgtggagggcgatgggtaggctggagcccgtgaacacgaaccagaagtccccctccgattccggcgcaaaccaccccaccggcaactcctgcaatccgctactcggccatgccacatcacacgcggcgacactcatcggcctgttcgcaatcgtcctgtggggcttcatggccggcctcgtgcgactggtctccgaatcgttcggcgccacgctcggttcggcgctcatctacaccgtcggtggtgtcatgctgttcattgtgcgccgtccgaaaccaatccgcgaagcgccatgcaagtacctcatcgcaggcggactcatgttcatcgcatacgaggcgtcaatctcgctgtcgatcggcctggccacaacgaacgcgcaatccgtggaagtcagccttgtcaactacttgtggccgacgctgctggtgctgatgaccgcagcggtatcgcacaaacgtggtgcggtcgccaaagcgattcctggcgcggtgatcgcaaccatcggtgtggcgatggcggttggcggagaaagccttgatatgcaggaagcggtccacaatatcgccagtaaccccctaccgtatgtgctcgcgtttgttggcgcctttatttgggcgatttatgcgacttttacgccgtcgttgtccggcggttacgacggcacgacgattttcttctgctgtgtggccgttgtactgtggaccatccatttcgtttcgggagacggtttgccggacacggcgcccggcatcggtggatatgctgcgctgattgcgtgcgccgcttcgatttcgggcggctacgcgtgctggggatacggcatgttgcacggcagtatggaaacgcttgcgattggttcgtacgcgactccgctgttttccacggcttctagcacgcttctgttgggcgtggcgctgggcatgccgttctggatcggtgttgtgctggtggttgccggttctctgatcaacgtgtggtttgcacggtgcccctgagtgtccgtttctcccgaatcggacaacctggggtgaccggatgacgcgtgggtggctgattcgggggaatcggacacttgttggtgcgtgaggaggcgacatgtggggtagtggcggcgcagaggagcgccgggatggcgcagcggtacgtaagggaagtgactgggcaggacaatgccctacgcctccacgctagcttaggtttttgccggctggtcgatggtgacgaattcgtggctttgggttttcaggtcgtcgatgatggcgggcagcgcgttcacgtgtaccagccgaaaccgatctaaaccggctcaaaccagcccgttcaaatccgcctcgtcacatcaccttggtggactccagattgcggctcacccagttgttcaaccggatcaccggcttgcgcaacaccaatcccagcagcagcgaaggaatcaggaacaaggcgagatacaccatatcaagcaggtactcattgccgtacgatccggccatcgcggcgtgcatggcatcgatggcgtgcgggaatggtaggaacgggtagagcatttggaagaacttcggcagcgtctcgatagggaacgtaccgcccgaaccggcgacctgcatcaccagcagcaccacggccacggccttgccgatatcgccgaacgacacggtcagcgtatacacgatattcgagaacacgagcgcggcaagccaccccacggcaaggaactgcagcgcatgattcgcctgcacgccaaggaaatacatgtcacccaggcaaaccagtgtgccctgcagcaacgcgagcagtgcgaagatcgcgtaccgtccgaaatactcgtggtcgagacgcagtccccaacgtgaggcgttccccgggccggacgggccggcgacgcgcggcagcgtgtcgcccaagcccagcacatgcgccttctcgcggtccgaaatcgtcactttcagcatggcgcacaggatgatcgcacccacccagattgacaggatcgtatagaacggcgccatggccgaaccgtagttcgcgatcgggtacaccgagacgcgatgcagtgcgacaggcgcggaaatcagcgtggacagtgtggacgcgttggcggtggccagtgcacgtagttcgtccgattcacccgaatcggacgaactggcgtcgttgccaccattgccaccatcgctgttgccgtcaccggcgttcccgcccgtctccagcttcgtgatcagctccttcaccgtcgctgccgacgagtcgagtttcttcgcgatcgcgccgagcgtggaacggatggacgtcacattcgtccccacatcgcccgtcacatcgtccagatcgtcggcggtgccgctcagctgggtgattatgctgtcggtttgggagatcagcgtgctgactgtggaggcgagcgcgtcgattttcggcttgacgttcgtggcgtaatcgtcgcgcacattgctgatcgactgcttcgcggaggtgatgcggttcaggatctccttgcgggagcgttccgcggctgcggtatcctgcgtgacctgcgtggaagcgtctttcagctgctgcgcgagcttctgcgaatcgcctttggcggcttccagcagcgtgatctcccggtcgatggcttccagcagcgcctgtttcgcggaatcgctgtccggtagttgttccaccgattcgcgcatgtggttgaggcttgtgatgtacgtgtcgtacagcgattcgccgctggagatttgttcgctcaacgttgccaactggctggctgcggtgtctgagtccttgccgatcgcgtcgaacgccttgttcaccttggcagctacttggtcgaacgcgcctgacacctggtcgagcgcggtgttcaccgaggaggtgacgttcgcacctgcagaagtgagtgacgtggcacctgatttgccttgcttcaacgcgttctgggcctgtttgcccgccttggtcgccgaggcgagcagtttgcccgtggaatccacgatgtcgttcgccgagccgagcagctgcgaatacgacgtcacctgctgcgatgcgccgctcagcgtatccgccgtggtggtgagattgccgttgaggttgcgcatgtattcggccatttgcgggctttgcgaatagtgtaggatgcttgaggccaggtcgagtccgacttgcgcaatcgttttggcgaaggttttgtcgatcgtgttgaccacggttgtcgcgccctgatcggtgatatgcggggcgatcgggttgattttctcgttcagatagtacttgagctgcgcgtgtttgatgtcgggggagaacagcgtcatcatgtcggcgctgaaacctttcggaattacgatcgccgcatagtattcgccggatttcaccccgtcgattgccttgtcgcttttcacgaactgccagtccagctggtcgttggcgtgcagtgtgctgatgatggtttcgcccacgttgacgcgcaccggtatgagatccgacttgtaacccttgtcgttattggccacggcgaccttcaatgccttggtgttgccgtaggggtcccagctggccgcgatgttgaaccaggcgtacagcgccggcaccaccaccaggcccatcgagacgatcacggcgatcacgttgcgggtggcatggcacatgtcccgcttgaagatgccccagatcattttcactgttcgttcccctcctcacgcagactcctgccagcatttccgtccgtgtttccagccgcatactcagccgcatgttcaggcgcatgtccggccgaaccaccatgcgcagcctcatacagcctcgtacgtacggcatgcatcggcttgtaatgcatgcccggccggaacagcaggttctcgtgcaggatcgcgctgcggaactcttccgcactcatcgcttcctcgcccagataattcgcataccgttcgcgcagatactccaccacgatgagatacgtgtcgatggcgatgatcgaaatgatccaaccgagcagcatggcgagcttcatgcgcgtgatgaatagcaatagcaggaacacgaacggcagtaccgccagcgcgaggaatccccaacgcaccaggcgcgggtacaggcggaagaaatgaatcgcccgtctgcggacgagttcggggaactcctcggcgatctgctgcgcggtctcggtgagccgcaacggttccaccgtgccttcgttatgttcggtgatcatcagatcagtgtccgccagacggttgtcgaacaggcggttgaggtttaacgccagcttgcggaccaccaagccgatgaacagcgccacaggcagataccagaacagcgagagcatgtcgatccaataatggttggcatacatgccgccgatcggcccgcgcatcgcgttgatgccgtaggtgaacggtaggaacggtttcagacggcggaagaattccggcatcatctcgatggggtagaggcctgccgcgcccggaatctggatgatcaccagaatcacggcgacggccttgccgatatgccggaacgccacggcgagcgcgtaaatgatgttcacgtagacgaacgaggcgaaaatgccggcgaggatgaacaggaacggatgctcgcattggatgcccagcgcgagatcgccgatcgtggcgatgatcgcctgcaggaatccgaccgtgacgaacagcagccaacggcccatatagccttggcgtggcgtgtacatgcggatcttctcatcgcggtccacttcaagcttgtagatcgcgacgagcacgaatccgccgacccacagcgcaagattcgtgtagaacggcgtgaccgcggaaccatagtttttgaccgggtagaggacctgttcgtccaaatgcaccggctcgcccacgaacgagccgacctcgctcgcgtcaagtccgagcgcttgggaaagctgctggaacatcgccgaactgctcaacgcggccacatcggtgcgcgtggtgttgagctgtttggcgagattggcgagctgtgtctgcgtgccagcaatggtggtgttcgtttgggtcacggtgcgcgacaactggtcgagcagcccgttgccctgttccagcgtgctttgcagcgtggtaagcgtgccggacagcgacccattggccaggctgagtgtatcgagcccggtgttgagattcggcatgaccgtgccggtgatggtcgtgcgtgcgctcgccatcgacgccgtgccgttcttcgccagcgtggtgacatcgtcgttgaacccgttcgcggtgttcttccccgcgttgatcgcagccgtggtgtcctgatcgaaggcgtcgatgcgctgctgctggaacgtcagctgtttgcgggcttcggcgagctgcgcggaaagatccttatacgtttggctgttcggatccagctggctggcctgcaacgccttctccacgtcgtcgagcacattgccggtggtggtgttgacgtgatgcatggtgctggacacttggtcgagcgcgtcctgcgtggtgttcagtccgctgagcacggtgccggtggcattgctcacgttgacctgcaggccggacagttgcgtgctgccgttgtcgagcgctccgaccagcgtgttcgagaatcgttcggtttgtgtgcgcgtctcgctcagcaagtcggacgccttgccgacggtgtcaagcgagttggtgatttccgaggtgagcgcgatgttggactgtttggccgaatcgatggtggtgagggccttgtcgagcgtggagcgggtgtcgcgcagctgctgttggacggtttcgagctggttgatggtgtcggtcagatcgttgatgacgtcgctttgcgcgcttttcacgctgccggtggtttctcccgctgcctccttcacttcctttgccacggcgtcggccacgctggaaacgaaagtggtgttgatctgctcgtcgatcgtggtcgcgcccgtatcggtgattttcggcgcgatcgcgttcagcttttcgttgatgtagtacgtgatcgacggtcggtcgcctttaccggtgacggtgccgattagtctggagctgaagtcttccggcagtacgatcgccgcatagtatttgccggattccacgccttcgatggcttgctgcttgggaacgaaacgccagccgagctgatggttcttcttaagctggttgacggtctgctggccagcgtcgagatggccgaccagcgtggaggttgtgcccttgtcctcgttcgccacagcgacttggatgttgcccgtgttcgcgtacgggtcccagttggcgaggatattgcaccatgcgtacagtgatgggatgatggccacacccagcgtgacgacgagcgccacggggttcttcagaatgcgtttcacgtctcgaaggaagatggcgaaaacctggtgcatcaagcctcctcgcgggtattggtcgcaacatctacgtgcggcggcatgcccgtgcgggaacacccggttgggctcttcgtcgcgcgatccggtggacattctatgacttccgatggaacgatcgcaatggtttcgccatgtttattggtcggtcccgcaagtgtcgggatatgagacgaaaacgctcggcatatggctctagtggggcgggcgacctggatatggagcggacggtcgggaaaacggaaaggaaagatggcgaatgttgtcacatgacaagtgggatagggttgggcgataatggaggcatgactattgcaacgccggaacgttatgcgcaaatgctggacgccgcacgccgcggcggttacgcctatcccgcgatcaatgtgaccagcacgcagaccctgaacgccgcactccagggtttcgccgaggcggaatccgatggcatcatccaagtctccgtaggcggcgccgcctacttctccgggcaacgcgtcaacgaccgcgtcaccggctcgcttgccttcgcagccttcgcgcacgaagtcgcggcgaaataccccaacatcaccatcgccctgcacaccgaccactgcgccaaacagtatttggacgaatgggtgcgcctcttgctcgaccatgaagtcgaacaggtgaagcacggtcaggaaccgaccttccagtcacacatgtgggacggttccacagtgccgctggatgaaaacctcgacatcgcagaagaactgctcgacaaatcccaagccgcgcacaccgtgctggaaatcgaaatcggcgcggtcggtggcgaagaagacgggcacagcgccgaaatcaatgacaaactgtattccacgcccgcgcaaggcatcaccgtcgcgcaacgactcggcctcggcgagcgcggacgctacatggccgccttcaccttcggcaacgtgcacggcgcatacaaaccgggcgtggtgaaactgcgccccgaactgctcgacgaaatccagaccacggtcgcgctcgcgatcaaggccggcgaaatgcccgaccccgcgcactcgctggatgtcgctcccggtaagccgttcgccctggtgttccacggcggttccggctccgcgccggaggagatcgcgcaggccgtgagctacggcgtggtgaagatgaacatcgacaccgatacgcagtacgcattcagccgtgcggtggccggtcacatgttctccaactatgattcggtgctcaaaatcgacggtgaggtgggcaacaagaagctgtacgatccgcgatcctggggtcgtgaagctgaatccgcgatggccgcgcgtgtggtcgaagcatgcaagcagctcggcagtgccgggcgcgcgctgaactagccaacggtctttcgaactgttttcgggcgttttctggtctgtttttcggaccggttgcaatccgattacggtcggtccggagccgtgagcatccctcagacccggtagagggtgaagagtaacctttgtaaggctttaggcgcaaggcttaaggcagaatcgcgtacgcacggaggtgcaacaacatgcctggaattgttttgatcggtgcccagtggggagacgagggcaaaggcaaggcaacggatctgatcggcacgaaggtcgactacgtggcccgcttcaacggcggcaataacgctggccatactgtggtggtcggcgacgaatcgtatgcgctgcatctgctgccgtccggcatcatcagccccaacaccacccctgtcatcggcaacggcgtcgtcgtcgatccggaagtgctgttccaggagatcgacggccttgaaagccgtggcgtggactgctcccgactgctggtgagcgaaagcgcgcacatcatcgccccgtatcaccgcgtgctcgacaaggtgaccgaacgcttcctcggcaagcacaagatcggcaccaccggccgtggcatcggcccggcatacgccgacaagatcaaccgcgtgggcatccgcgtgcacgacctgttcaacgcggagcacctgcatgacaaggtcgaggccagcctgcatcagaagaaccagatgctcgtcaagctgtacaaccgtcgcccgatcgacgtggacgagaccaccgacgagctgctcaagctcggcgaacgcctgaagccgtacgtggccaacacctccctggtgctcaacaaggcgctcgacgagggtaagaccgtgctgttcgaaggcggccaggccaccatgctcgacgtggaccacggcacctacccgttcgtgacttcctccaacccgaccgccggcggcgcctgcaccggcaccggcgttggcccgaccaagatcacccgcgtggtcggcgtctccaaggcgtatgtgacccgcgtgggcgaaggcccgttcccgaccgaactgttcggcgaggaaggcgaatggctgcgcgcccaaggccacgagtacggcgtgaccaccggtcgcccgcgtcgctgcggttggttcgacgcggtcgtcaaccgttacgcggcccaggtcaacggcctgaccgacatcgtgctcaccaagctcgacgtgctcaccggcctcaaggaaatcccgctgtgcgtggcgtacgacgtcaacggcgagcgtcgcgacgatatgccgaccgaccaggccgagttcgccgccgcgaagccgatttacgagtccatgccgggttgggacgaggacatttcccaggtccatgacttcaacgatctgccgaagacctgccaggattacgtcaagcgtcttgaggaactgtccggctgccgcatttccgtgatcggcaccggcccgcagcgcgaccacatcatccagatcaactcgctgatcgactgaagctgattcggctgattcgtcgatatgaacgtcggtaacgaacgtcaatgacaagtgccggtgggcctgtgcctgccggcactttgcgtatggtgcgtgcgatggcgtgcgcgtatgacgcacaccgcatacacaccgacggggtgcgcggcggaggaacggaaaaggggagtgcgatgactgcaatgccgcctaacgacaggttcgacaggtttgacaggttcagcaaactggtcccgcgattcgaccacctgaaatggaagatggccgctgccggcattctcgtcggcctgatttccggcttcctcgtcgtcctctaccgtctcggcatcgaatacggcaccgacaccgcgcgctggatctacgcgcgcatccgcgaaaccccgtggctggtcgcaccgtgggcggtcgccgcaatcacagccgcgctcgccatcgcatggatggtcaaaaaagagccgatggccggcggcagcggcattccgcaaaccaacggcgtggtgatctgcggcctgaaaatgcgatggcagacgattctgccggttcgcttcatcggaggcctgctcggatcgctcttcggcctctcgctcggccgcgaaggaccgtccatccaaatcggcgcatcgggcgcgcagttcctatcgcaccggctgcgcggcaagaaacgtgaggacatgcaggagcattatctggtcaccgccggtgccgcggccggcctgtccgccgcgttcagcgcaccgctgtccggcatgatgttcgctttggaaggggtgcatcgcagtttttcgcccgcgattctgatgggcgccaccgccgcgtccctgaccgccgatttcgtatcgaaatactgtttcggcctgcgtccggtgcttgacttcggcaccatcggccaactgccgctcggcgaatacgggtggctgattccgctgggattggtggccggtttggttggttcgctgatgaaccgttcgctgctcggcttccaaacgctgtacggcaagcttcccgcatggagccgccctttgatcgcgatcgcactcgcgctgccaatcggcatttggctgcctgacgtgctcggcggcggctcgaacctgatcgccatggccgagcatgcgcgcgtcggcttgggcatgctgtgcgtgctgttcgtggcgaaagtgctgttcacctccaccagcttcggttcaggcgctcccggcggcattttcatgccgattctcgcggttggctcactcgccggcggtatctgcggcgagacgttgcaccagttcggcaacctgccgtccgattccgtggcgattttctcggtatgcgtgatgacgggcacgctggccgcgtccgtgaaaacaccgatcacgtcgattctgctggccgtggaaatgtccggcacattgacgcacatgctgccggtcgccgccgtcgcgttcatcgcattgctcgtctccgacctgctgcgtacgaaaccgatctacggcgagctgctggaacggtacatgcgcgcgcaaggcggcacgacggcaatcgccaatcgcatcgacaacggcatcatggaactgcctgtggaaatgggcgcgaccgcggacggcaagctgatgcgtgacgtgcgctggccgtacggctgtctggtgattggcctgcgtcgcggcgaacggcagatcgtgccgcatggcgatacgcggctgcgtgccggcgactatctggtcgtgctgttcagcggcgaggacgaaagcgacgcacggcatgcgatgcggcggctgtgcgacgtgtccgtctgacgcggtcttaccgtcttccataaccattcgtagacgtctagggccacccgaagttatccatagttatccaccgaatcggacatgttcgatgtttggttgcaacgcacgtgtagactcgtacaaggttaggaagacggcacctgcggccagctcgttgccgtatggctggggcggaacgacgctgtccgcggaaagccaagtacaaggggaatgtgatggaatcgcaagaacaacgggcggcagactcgccaaacgcgggtgatgagccgaatcccgccacacagtcgatcgacgtcgccgaagtggcgcgcgcggatgtgcgcccgtccggtgccgccgcatccaagcatccgccgcagattccgctcgcgccgatgaaacgcatgcaggcgcgattcaaccctcttgccgatggtctgatgtatctcgtggtgttcgtcggcggcttcgtcggcgtcgggttccgtcgtgccacggacctgctgctgccgtcggtgaacggttcgccgttcgtggtgggcacgttcgtgtcgaatatgctcgcctgcttcctgtttgcgatgctgaccgaatacatggcgaccgcgtcgtggctgcgccgcagggtgcggcaggtcgtcagccgtggcgtcgggcttggtttgcttggcggactgtcgacgatgtccggcgtgatgttggaaaccatggaaggcatgcgcgagcagcgtttcggcagcgcgctcggctatcttgcgggaagtttcgctggcggtctgatcgcggccgcggttggcgtggcgctgatgcaggcgttgctggcgcgcggcacacgcaagcgggtccgtaacgcgatcgccgatgcctccacggcttccgtatcctcaatgtccgattcgggcgattcggacgcgtacggcatcgtgcaggacgtccagatgaccgacactgcagtatcggctacgcagagtgttacgcagacggtccccatggccgattcgggcgaatcggacgtgccggccgcgcaaaatgtgcagaacaacgtgccggacgcgcagggcgtgcgccacgtgaaggtggcggatgcggcgcattcggccgcgcaggccgcgttggaggccgcgcaggcggcacagcaggcggcccaggtcgcccagcaggtcgcgcagaccgggcaggtgccgaaaatcgaatcgcagccgcagtcatcgcaacccgtcgcacctctgcccagcttcgaacccaagccggtcaccgcggaaatcccgctcgtcgccgacccgaccacaggggaggtgcgctgatgacctggatgatctgcctgttcggcggcatcggcgccatggcccgttatgtgcttgacgtgtcgatccaacgcagctggaaccgtaacggcaaccacagcttccccctggccacgctcgtcatcaacggcgtcgcctccctgtgcgccggcatcgccatgatgtcgtactatgcgcagtcggttgatatgggcacggtaatgacgttcgttgtggggttcctcggcggattctcaacattctcgtcggcgatcaacgaggtgctgtcgctgattcgcaaacgccgtttcgccatggccctgggctatggcgctgccacggtcgcggtgccgctcgcctgcgtggcgctcggattcggcatcgccatgctgggcggccacgcatagctgtcaccggcttggccgcgcgtaattttcacgttacacgggcggtcatcgggtaacgttcaggaaatctgagcgcaaccgcgcgagctgtttcctctcctacgttgtgaaaacaacaagagaggaaaaacctatgacagccgtaacgtatctcacacggcatcgtcgaccgggaatcgtcatactctgttcgattgtcgccgttctctcgatgcttttcgtactccctcccgccatcgcgtccgcagccgattccggcgcgcaggccgtcgatgaatgcaatccgaccgccagcaacggctgcgtcaatggcatcctgcaggacgccgacaagaagccgatcgccgacgtcaccatcacgctgtccggcaaggcaacggcggaaaccaaaaccgctgccgacggcaagtgggcgttttccgttgccgatgacggcgattacaccgtcaccatcgacgcatccgttgcgaaagagcacggtctgaaggcaagcagcgcaacggtgacgatcaggaaagccagcttcgacaagcagcgcggagtcgtccgtttcgaccaagctggcgattccaccggcagcggcacgtccggcacatctggatcgtccggctcggcaaacggcacgaaaggcgcgaccggcacatccggatcgacggcggccacgcaatcgccagtcaaaaaaggcggctccaatgtcggcaaacgcatctggcagcaactgtattccggcattatcttcggcctgatgctgggcctcatgtccgtcggcatgaacctcgtctacggcaccactggcctgcagtcgttctcacacggcgaacaggtgacgctcggcggcctcatggcatacgtcggcacgcagatgctgcacatgccgctcatcgcctccgccatcttcgccatcgtcatcggcgcgctgaccggcttcatccaaaacgaaatcgtctgggggccgctacgcagacgccacgtcggcaccatgcagcagatgatcgtcaccatcggcctgtccatggcgttgcagtacacgttccagttcttcttcggtggcgacatcaaaggcatcgtcaaatcggtgccggacagcttccagctcggaccgatcaccaccgacatgccgacgctggtctccgcgctcatcgccatctgcgtgatcgtcggcgtcaccctgttcctctacaagacgcgactcggccgcgccacacgagccgtgtccgacaacgcggcgctcgccgcagcatccggtatcaacgtggatcaggtggtccgcgtggtctggatcctctcgtgcgcgatggcagccctgtccggcgtgctgctcggcgtctacctgaacggcatctcctggaacaccggcgcgaccctgattctgctgatgttcgccgcggtgacgctcggcggcctcggcaccgccaatggcgcgttgatcggctcgctggtcatcggcatcgtggcggacatgagctcgctcgtcatccccaacgatatgcgttacgccagcgcgctggcaatcctcatcatcgttctgctggtgcgcccgcagggcatcttcggcaagcagcaaagggtgggctgatccatggacatcatgacaatcatctccaacgcggcgggcgaactgatcgccccgaccacggcggcgtacgtactcgccgccatcggtttgaacattcacttcggcatgacgggcctgatgaacatgggccaggccggtttcatgctcctcggcgcttacggattcgccatcacgcagtcgatgggctgcaacctgttcgcctccgtatgcgcggcgctcgcgctcgcggtcatctacgcgctgctgctgggcattccgacgctgaaactcggacccgactatctggccatggtcacattggccgccgcggaaatcatccgcatcatcggcagatcgacggccatgacgaacttcaccggcggttccgcgggcatctcgccgcaggacttcaccgagaaattcgaatcgctttcgccgctgccggacggttcgaccacgttcctgctgtggacgtacagcaacaacatcgccaactcctggtggctgcgcatcgtggcatgggttttggtggtgatcgcggcgctgctgtgctggcgctggttccactcgccgtggggccgcatgctcaaaggcatccgcgaggacgagaacgcgatccgttcgctcggcaagccggtgacgcgatacaagatggaatcgctgattctgggcggcctgttcggcgcgatcgccggcatcatcttcgtcctgccgcgttccgtacagcccgattcgctcggccgcaccgtcaccttctacgtgtggacgattctgctgctgggcggcgcggccacgattctcggcccggtgcttggctcctgcgtgctgtgggtgctgctcaccttcgtcaaggaggtcatgcgcaacaccgttcccgaaaccctcatctcttccaaccagatcgaagccctcggctgggtgatcgtcggcgtcgcgctgatgtgcctggtgatcttcagaccacaaggcctgttgggcgaccgaaaggagttggctttccatgcctgatacaacgaattctccgaccactggcgtgcagccggccacggaacccgcaaccggcgtgcaacccgtatccggtgtgcagcccggcgtaccattccaggacctcaccaaatgggccaccaaagctccggaaggcgagaccctcatctccaccgcctatcgtgacaaagtcaccgacgatctgaaattcgtcgaaaacaagccgggcgtgcacaagcccgacccgatcctcgtggccgacaacgtgacccgcaaattcggcggcatgaccgccgtggacgtgagccacttcgaaatcgaacggcacggcatcaccgcgctgatcggaccgaacggcgccggcaaaaccacgttcttcaacctgatgaccggcttcgatacgccgaacaccggcacctggcagttcgacggcaaggacatggcccacgtgcagcccgaaaaagtggcgcgcatgggcatggtccgcaccttccagctaaccaaggtgatgagccgtctgaccgtgctcgacaacatgctcctcggtgcccccgtgcagccgggcgaaggcatgttccgcgcgctgttccccggcatgtggaggaagcaggagcaggcgaacatcgaaaaagccgaggcgctgctggaacgcttcctgctgatcaaaaagaaggacgattacgccggcgcgctttccggcggccaacgcaagctgctggaaatggcacgagcgctgatgtccgacccgaaactggtcatgctggacgagccgatggccggcgtgaatcccgcgctgaaacagtcgctgctcgaccacatcatggcgttgcgcgaggaaggcaccacagtgctgttcgtcgaacacgacatcaacatggtgagacacatcgccgactgggtcaccgtgatggcggaaggcaagatcgtggccgaaggccaaccgaagagcgtgatgaacgatccggccgtgatcgacgcatatctgggcgcccacgcgaacgtggacctgggcgacgattccgtgctggaagacctgaaggaggcctgaaatgagcgacatcgcaagcgtggccgacgagccgctgacccgcgcgcagatccacatgggcgagcccgaaggcgaaccgttgctcgacgcggtcgatttggtggccggatacattcccggcgtgaacatcctgaacggcgcatccctgaccctgcatgaaggcgagatcgttggtatcatcggcccgaacggcgcaggcaaatcaaccctgctcaaatcattgttcggcctggtgcacatccactccggcaagctgctgctgaaaggcgaggacatcaccaacctgcgcgccgacaaactcgtctcccgtggcgtcggcttcgtgccgcagaccgaaaacgtcttccccagcctgaccatcgcggaaaacctgcacatgggcgcgttccaagcaccgaaactgttcaacgaacgcttcgactacgtgtgctccatcttccccaaactcggccagcgcaaaaaccagctcgcaggccaactctccggcggcgaacgtcagatggtggccatggcccgcgccctcatgatgaaaccatccgtcctcctgctcgacgagccctccgcaggcctgtccccaatgcttcaggacgaaaccttcatccgcgtgcgccaagtcaacaaagccggcgtatccgtggtcatcgtcgaacagaacgcccgccgctgcctgcagatctgcgaccgcggctacgtcctcgaccaaggccgcaacgcctactccggcaagggccgcgacctgatgaacgatccgaaagtcgtctccctctacctgggcaacctggaagaagaggttcaagaggaaggaaggtaggacccaggaaatcgcggaacggagcgtataccgcctttccttgccgctcgacgtacgttcgtacgccttcgggctcggacggcggtctccgcacgcgttccgcgatttccccctatgattcaaaattctcaattccgattaccgctgttggggcactgcccgacagtggcttcggcatgcctgaaaacaagctcaaaaccttgtgtttccaacagttttcgggcttcaccttcggttaacttcacgcatacacattcggtttcctcggcacttatagtgcgattcaagatggtcgagcaacacatctcgataatcgtcaccaagggttcggcaatcagcggagccaagagaggaaacggtgattcaaatgaagaagatcaacatgaagggcatgaggaaactgtccatcacagccaccgccatggtggccgccgcagtcatggcgctcgccggctgcggttcatccaactcgtccagttcatccagcagttcggcaagcacctccggcaccaaaaccagtaagttcgtgcttggtggcctatggccggaaaccggctcactggcctacctggccccgccggaactggccgccgaaaaacttgccgtcaaagacatcaacgacgctggtggcgtgctcggcaacaaaatcaccaccgtcgacgccgacacctccgacgcggaccacgccgaccagaacacctccgccgcccaatccgtcctcagcaagaacccgtcgttcatcatcggcccggcctccagctccgtggtcaagaacacctacaagtccatcacctcgcaaaacattccgatgctgtcgatgggcgccacctcggccagcttctccggcctttccgactacttcttccgcaccgtcgcccccgataccgtgcagggcgcggtcatgggcaacctgattgcccaggacggcgtgcagaagctcgccatcgcggtcttcaacgacgaatacggtaccggcctgcgcgacaccatcgtcaaaaccgcatccgcggcaggcgtcgacatcatctatggcgaaaaggacacgttcgacccgaccgaaacgaacttctcatccatcgccaccgccatcaaggcatccaaccccgacgcgacgctcgtcatcgccttcgatcagaccaaaccgctgctgaaggcgctcgcttccgccggagtcaacaccaagaagctgtacttcgtggacggcaacacctccgactattccagcgaactcgacgcgggcctgctggaaggctcgaagggcaccatcccgggtatcaatccgtccgacgacttcgtcaagcgcctcgaatccaccggcgtcgacctgaaaaacaccaccacctacggcgctgaaacctacgatggcatcatcctcgccgcgctcgccgcacagaagggcggcagtgccgatggcaagaccatccaggccaatatggcggccgtctccggatccaccaagggcgagaagtgcgattcctacaaggcctgcgttgccctgctgaaggacggcaaggagattcagtacaagggccagacctccatcggcgcgttcaacgacgcgcatgatccgagctcggcttccatcggcgtctataagtacgacgccgacaacaagccggtcttcgaccactcccaggaaggttccgtaccgaaggcatgacggtcggttcgtccgtggtgcggactgacgtgatggccggacgtgacggctgacggccaagccacgcaacgcaaggggcggtgcgacgcaagcgagatgatcgcaagtgtctcaccgccccttttgcgggcggaacgcgtgtggagtacatgcggagcgtgcgtggaagatgcgtggaacgcgtcgtgaaacatacgtcgttcacgggtgaaaaagtggatttttcgggggaattgaagagggggagggcgtctttcgtcaattgatagttcatattgtgcgaacgattgcaaagaaacgttacagatgcatgtaaaataacacataatatcgcgatttgtaaggaaacatcccgacgatgcgggggagaggtgttgggcaatggtcggcatgcgtgacgtggcgaaagaggccggggtttcgctgagcacggtttcgctagtggtcaacaagacgggctacgtgtccgacgacatgcgcgcgcgcgtcgaagccgccatgaaagagctcaattacgtgcccaacgagctggcacgcaacctgtacaagaaccgcacgaacctggtcggcgtgatcgtgccgaccatccgccaccccttctttgccacccttaccgcgcatctgcaacgcgagctggccgcgcaaggactgcgcaccatgctgtgctccaccgccgacgcggaaaacggcgaggttgaatacgtggacatgctgcgccgtcacatgatggacggcatcatcgtctgctcgcacaccacccatccgaacgattactggacgtccatccaccgcccgatcgtcgccttcgaccgtgtgctgggcggcggcatcgcgtcgatcggctccgaccatgagcagggcggccggctcatggcgcacatgctggtcaacaccggcgcgcaccacgtggtgatgatcggcggcccgcgcgaccagttcttcgatttggcggcgcgcaatggagacagcccggacgatttcgacctgcacaagacaacgttcccgaccgtccgctactaccttgcgctggagcaggagctgaaagcggccggcgtgcggtacgagtacgtcgaagccggcaatgtggaggatttccaagggtataagaacgcggtgaatgctgtgctcaacagtatgccggtggacggcgtcgatgccgtggtcagctccgatatcggtgccgcgctttgcgtgcgcgaagcgatgcggaggcatatttcgattccgcgcgacctgcagatcatcgcctacgacggcacgtatctgaccgacctggccggtatgaaaatgaccgcggtggcgcagaatttcgacaaaatcgcgcaggtcgcggtcggcaatatcgttcgtgcgatcgccaaggaaggggatgccaaggcagatacgacaagcgccacgggacgcaagccgtacgagccggacgtgctgattcccgtgacgctcaaactgggcgataccacccgctaagcgggccgtatcgcccatcattggacgggccgttttacctgctaagcgggtcgtttcgccttattcgtaatcgccggtcggaccgattttcaacgcgtcctcgtgcgtgcggcccgaatggatcgcatcgttgatcgcctggatctccgctgcatccacggcaagtgcgcgcccgtcgatcgcgctgatcggaatcgaccatccgccgtgcgtcatgtacaggctgtccgcttcgcgtagttcggcgatcggcagcttcctgtactccgcctttttgccttcttcaagcgcccaggcgaacatttcgcgctgtgatgtgccattcagaataccgatgcgcgggtcgggcgtgacgaacgtatcgccatagcgtgccacaatcgacgaattcgggcattccatcgtgtagccgtcctccgtgaacagaatcgcgtcgccgacgccacggcgggcgcattcgcggtgcacggcgcagttgaacgcgtagctcagcgtcttcgcgccgttgagcagccacggggcgcgtgcggtgatgtccgacgggtagccgcgcgtcatcgaagccatggtgatcggctccagcgaatgcagcgtgcccttcgcgtcaaggaagatgtagacggtcggcgtgcggtcggccgccttgcccacgccggtgtccggatcgagaccacgggagacgatgatgcgcagcatcggaccgggttccggatcgtcatactggtcgatgaccagctggaccgcgcgggtgagcgctggaatgttcggttccggcatatccaccagacgggccgaattcgcaagacgcttcagatggttctccagcgagaccgggaaacccctccataccgtggtcgcttcgaaaatgccgtcgccgcgcagcgcgcacaaatcgaacgcgttgatgatgggactttccggatcgacgaaacgaaccagatccgcgtcgggcgccacgcctgagcctccgaatagcgtcttgccgttaccgactgccagaacgatcgaactcatgggaacctctcttccgcgctccgcgtcttttgattgccgctttattgctgttgcgctgttgtgttgcgtcagcgttcgcgtgcgtcttcggcgtccaacctaaccatggtttgtttccacttggcaccgccaatttgcaatgcggaaacatacgcgtcatgaatcgcgcggctcccgtaacgttcggcgaccaaggtgagggaaagcgactctgaacgtccgtttctgcggaatcggatttcggagttcgtcggcagttcgttcggaaaaggccggacggcggccgacgggaaaggtaagcgcaatggtggatgggatgtccgatatgggaacaaccgaacttggcgcggcgagcacgcccgaacaggcgcgcgccgcgttccgtgacggcctggtccgcccgacctgcggcattgcgcaaggctacgcgcaggcgaatctgatgattctgcccaaggagcaggcattcgattttctgctgttcgcgcagcgcaatcacaaaccttgtccgctgctggaagtgatggagccgggcgtcaccgcacccgtcaccgcgccgggcgccgacatccgtaccgacgtgccgttgtaccgcgtgtggaagcgtggcgaactggtagctgaagtgcccgatattcgcgagtattggcgatccgatttggtcacgtttgtgattggctgcagtttcacattcgagtttccgctgatggaggcgggcgtgccggtgcggcacatcacggcaggccgcaacgtgccgatgtacgacacgtcgatcgagtgccgttcggccggcgcgttccattcgacgatggtcgtgtcgatgcgtggcattccgtctacgcaggtggccgacgcatgccggatttccggctattacccgtccgtgcacggtgcccccgtatgtgtgggcgacccgtccgcgatcggcatcgacgacatcatgcatcccgactatggcgatgcccccgtgttggagccgggcgatgtgccggtgttctgggcgtgcggcgtgaccccgcaggccgcggtgatggcgtccaaaccggaattcgcgatcacgcacgcgccggggcacatgttcatcaccagcaaacgcgatttggaatacatggtgtgaggccgagcggcaggttgcggggcgcggcatgagatgcgtgctgcggcgactgcggcagaagggacgtcgcggctgaagaacgctgcgacggtagaacgacggaaaggcgacggaaggaatggaaacgatggctgtgcaggaaacagacggaaagcagacggctatgcgaatcgatatgaacagcgatatgggcgaaagcttcggtcgttggacgctcagcgacgacgaggcgctgctcgacgtggtttccagcgcgaacgtggcgtgcggcttccatgcgggcgacccgtccgtcatgctgagaacgttgtcatacgcggcgtcgcggggggtaatggtcggggcgcatgtggcgtaccgcgacctggccggattcgggcgccgctatgtggacgagtcccccgacgaactcaaggcggacgtgatgtaccagatcgtcgaatacggcggcctcgacggcgtgcatatgacgaacgtggcgaccgtcgacggcctcgaacccgaccgttactttaagcaggtcggccagcttacggactgcgcccgcagctgaagtcctgtgcccaaggctgagagccctgcgctcgcggctgcccccgcatgtccgtcgctttcgaatcgggcgccggagacatgcgccgcgattcggccgaaagccggttcgacacgcccgaacaccggttgcggttttggtgtcgagccccattttgcggtaatatcgaaccggttcgacacaaccgtgggaatggccgtaaggactcccgcaaagaatctcgcaacgactttttggaaccgaaggaggctccatgaaaaacaaggtgcagctcatcacttacgccgaccgccttggcgacggcaccatcaagtcgatgaccgacattctgcgcacccgcttcgacggcgtgtacgacggcgttcacatcctgccgttcttcaccccgttcgacggcgccgacgcaggcttcgacccgatcgaccacaccaaggtcgacgaacgtctcggcagctgggacgacgtcgccgaactctccaagacccacaacatcatggtcgacgccatcgtcaaccacatgagttgggaatccaagcagttccaggacgtgctggccaagggcgaggagtccgaatactatccgatgttcctcaccatgagctccgtgttcccgaacggcgccaccgaagaggacctggccggcatctaccgtccgcgtccgggcctgccgttcacccactacaagttcgccggcaagacccgcctcgtgtgggtcagcttcaccccgcagcaggtggacatcgacaccgattccgacaagggttgggaatacctcatgtcgattttcgaccagatggccgcctctcacgtcagctacatccgcctcgacgccgtcggctatggcgccaaggaagccggcaccagctgcttcatgaccccgaagaccttcaagctgatctcccgtctgcgtgaggaaggcgtcaagcgcggtctggaaatcctcatcgaagtgcactcctactacaagaagcaggtcgaaatcgcatccaaggtggaccgcgtctacgacttcgccctgcctccgctgctgctgcacgcgctgagcaccggccacgtcgagcccgtcgcccactggaccgacatacgcccgaacaacgccgtcaccgtgctcgatacgcacgacggcatcggcgtgatcgacatcggctccgaccagctcgaccgctcgctcaagggtctcgtgccggatgaggacgtggacaacctcgtcaacaccatccacgccaacacccacggcgaatcccaggcagccactggcgccgccgcatccaatctcgacctctaccaggtcaacagcacctactattcggcgctcgggtgcaacgaccagcactacatcgccgcccgcgcggtgcagttcttcctgccgggcgtgccgcaagtctactacgtcggcgcgctcgccggcaagaacgacatggagctgctgcgtaagacgaataacggccgcgacatcaatcgccattactactccaccgcggaaatcgacgagaacctcaagcgtccggtcgtcaaggccctgaacgcgctcgccaagttccgcaacgagctcgacgcgttcgacggcacgttctcgtacaccaccgatgacgacacgtccatcagcttcacctggcgcggcgaaaccagccaggccacgctgacgttcgagccgaagcgcggtctcggtgtggacaacactacgccggtcgccatgttggaatgggaggattccgcgggagaccaccgttcggatgatctgatcgccaatccgcctgtcgtcgcctgacggaaaatttcttgcgattacgtattttcttgcgattacgtacggccttgcgattgcgttccaccttgcggtcgcgcacccggtccgtcgcacccggtccgtcgggcggacggcagtggccgcacgtgttggtatcgtaagttgcgttgaagaatcgcccgaatgcgctgaagcaatgcgtccgggcgattttcgtatgtgtcgctcgtagcgggcgggcgcatgcgtggagtatcgaagcacatgaaacgcgacaagcagaaaacgcgataagccaagaaaacagcagatatgaccgaagacaatcagaataacgaattcaaaccgcagccgctgcccggccaggtgttcatccgcccgggcatcgacgatcgccccgattatgagaagaccctgactcccgaagcgaaggcggccatgcgccggctgtcggtgcagcagcatccgcgtattccggaagcgtccaacgagcgtccggaaacccaggccgcgcgcatcgcatcggaaggtggagcgcccctaaccgcggccgcgcatcttgacgtggctgtgccgaacctcgaatcgtccttcctcgacctgcgcgacccgatgaccgctccggacggcaccaagccgaccgcaatgcaggccaaccggctcgttgcgggttttgcgcttggctcaatgctgctgtccgctccgatggcggcgttcaacacggtgctcattccgcaaaccgtcagccgtttgtcgggaatcaaccgcgtcacggatttggcgatgctcgtcatcgcaggtgccatcatgacgttcctgctgaatgcatgcatcgccgtcggttccgaccattcctactgccggttcgggcgccgtacgccatggatcgccagcggcagcgtattggcggctatctgcatggcgattctttccgcatgcgattttctcccgtgggccgtgttcttctggctggccacgcaggccgcgtatgcgatggcggccataccgttcgccgccgcgttcggcgaacgtgtgcctgacaagttccgcgaccgcgccgattcctggcacggcaaggggctggcgcttggccagctggtcggcgtcgccgtggctgttgcgctgacgccgcatgccggtggcgaaggttgggatggcactacgggtttcgcgatgctggtattcgcgggttggcttgtcgtcgcggccgtcgttacgctgttgatattgccgttcgaaggggccagcagctacctgccgcgtagggatgttgagaaaggcgatttcttctcgcaataccgtccgccgcagaacgcgccgaagttttctgtggcattcgcggcccgcatgttcgccgttgcggccacagccggaatcgccgtatatcagtggtatctggcgccgaatatcgtcggcaataccgatgaggccggtttgttcggcattgccggtgccggatcggtggttgtggtcatggccatctgcacgtttgtcggtgctttgattgcggcgttgctgcttggccgcgtcgtcagcctgtttggcgatctgcgtattccggccgtcgcgtccgccgtgttgttcatggtcgctgcgctgctgccgttgctgatggacgacggtttcctggcggttgcgctgtacgccctgcttgccggcttcgcatacgtggtgttcgatggcgccagccaaagcttggatcttgcgatgctgccggatgtgcgttccgtgggccgatcgcttgccgcttatagtctggccaatacgttcggcacgatactgggcgtcgctgcctgcgccgcggtgattgtggcgaccggtgccaccgtgctgatcttcgctgtcgccactgtttcgatgctgttggcgggtctgctgacattgcggttgaaatcgcaacaatgacggcgactatgacggtgctagatcgccaatgattggaaaataaagcgaaacggcgcgtccacatagtgaacctttagtggataggggagatggacgcgcctatgtttacggcttagttcgagcggaaatcccgcccggggaaatgactttgcgaaaggaggttcgccacgatgaacggaatggtcgcacacgtactgctgtccgcacgaattattattccgctttcgttggcggactgattcgagcattgcggcttcaatccctcgccaacgaaggcagggtttgaggcgcgcgtaacacacacgttgatggccctgcataatgcggggccatttttgttgcagcccacaaggcagacgcagcgaaaaccttttgaagccggccggcatagcgcacaacagaaaacagaaaaactacaaacaacatcgttatcggcggaagttgggaaccggtaacaggacgtacagggagtacatcaatgagtacagtcgaagcggccgctggcaaagcgcaggcgatggtccgcgattcggtcaaaaccgtgatcgcagcatccatggtcggcaccgccatcgagttctacgacttttacgcatacggcaccgccgctgcgaattatttcccgaaggtgttcttcggagacaccaccaatccgaccgtcgcgctgctggccagcctgctgaccttcgccatcgcgttcatcgcccgtccgctgggctcgttggtgttcggccacttcggcgaccgtatgggccgcaagaccacgctggtggtctccctgctcaccatgggcattgccaccttcctgatcggctgcctgccgacctacaaccaatggggtgtcgcggccgtcgccgtgctgtgcctatgccgcttcgtgcagggcatcggccttggcggcgaatggtccggcgccgcgttggtggccaccgagaacgctccggaagacaagcgcgcgctgtacggctccttcccggagctgggcgccccgatcggcttcttcctgtcgaacggcacctacttcctgctggagaccttcaacgacaatgacgcgatgcttgcctggggctggcgcgtgccgttcctgctgtcctccatcctcgtgatcgtcggcctcgtcgtccgcgtccagatggaggagaccccgatcttccgtatggcccaggagcagaagaaggtcgtcaagtccccgcttaccgaagtgttcaagaagagctggaaggaagtcatccaggccacgttcctggtggccgtcacctacacgctgttctacacgctggcaacctggtccctcgcttggggcaccaagaccgtcgagcagggtggcggcaacctgggcttcaccaaccaggagtatctgctgatgctgatgatcgccgtctgcgtgttcgccgcgttcatcgtgatctcctgcgtgaacgccgacaagttcggccgcaagcgcgtgatcatcatctcctcctgctgcctcatcgcgttcgccctgctgttcccgttcctgcttgatccggcggtcgtcggtcagcgcaacttcgccaccaacctgctgttcctgtgcatcggcttcgctctgatgggtaccgcgttcggtccgatcggcgccttcctgccggaactgttcgacgccaacgtgcgttactccggctccggcatcggctacaacctggctgccatcgtcggcgcggccttcgtgccgaccatcgccacttggctgtcccatcattggggcgtgcattccgtgggcctgtacctcggtgtgatggccctgtgctgcctcatcgcggtgttgagctgcaaggaaacgaagaacgtcgacttcaccaagtgacgccgaccggcttgccgggctgcttcgcttggggtggctcggagccttagaaaaaacgtttgacgtgaatatagccactatgtgaacgccaacagacatcataaagaaagcggtactagaacagttccgcaggagaggcggagtggttcctcggacacaatccggggggagcaacatcctaggaatcactcgccgtgataacaaccgaaaaaagaatagaaaatagcgagtttgttcggaaaaagcaagttccgaatcgcaaaaaacaataaaggagcgccaattatggcagcaactatctggtacgaaaaggacgccgatctgtccgtgttcgatggcaagaaggtggccatcctcggttacggttcccagggccacgcccatgcgctgaacctgcgcgattccggcgtcgacgtcgtcgtcggcctgcgtcctacctccaagtccgtggagtatgccaaggagcagggccttgaggtcaagcctgttgccgaggccgttgccgaagccgacgtggtgatgatcctgctgcctgaccagtaccaggccgccgtgtacaagaaggacgtcgagccgaacctgaagccgggcgctgctctggccttcgctcacggcttcaacatccactacggctacatcaagccgtccgaggaccatccggtcttcatggtcgccccgaagggcccgggccacatcgtgcgtcgtgagtacgccgctggccgtggcgtcccggtcgtcgtggccgtcgagcaggatccggatggcaagacctggccgctgtgcctggcttacgccaaggctctgggcgcgctgcgtgcaggcgccatcaagaccaccttcaccgaggagaccgagaccgatctgttcggcgagcaggacgtcctcatgggtggcatcaaccacctgtgcgatatgggcttcgatgtgctgaccgaggctggctaccagccggagatcgcctacttcgaggtgttccacgagctgaagatgctggtcgacctggccaacgagggtggtctgaacaaggcccgttggtcctgctccgacaccgcccagtacggcgactacacctccacggtcatcaccgaggagaccaagaagcgcatgcagtaccagctcaagcgcatccaggacggctccttcgccaaggagttcatggatgaccaggccgctggcgctccgaagttcaagaagctgcaggaagagtacagccacccgcacctggagaccgttggcccgaagctgcgcgccatgttctcctggaacaaccaggtggacgccgacgccgatatggccgagtccttcaacggcaagatcgctcgtactcaggttcagtgagattgcttcgctagctgcataagctatttagcgaattagaaagcgtcgcccgcttcgtgcggacggcgctttttgcatatcgtcgtgcgtgcgacggttgcgtacgttccggcataacgaaaggccgccacccaacttgggcggcggcctttaatcgcagttaatgcgattaatcgcaatgaatgcgagacgttactcagccacgggcgatcttgccggtgaaagtggccatgtcagcgtcgtcatccttgccgttgttccaagagaacatggcgcgcagcttcgggccaacgctctcgatacgcacgttgccgtattcttcctgcagctgcttgaacttcggagcgccagcgtcctgatcgtcgatgaactccttggcgaaggagccgtcctggatgcgcttcaggtggtactgcatgcgctcacgcacgtgctcgtcgatgcaggtgttggtgtagtcgccgtactgggcggtgtcggagcaggaccaacgagccttgttcaggccaccctcgttcatgaggtcgacgagcatcttcagctcgtggcagacctcgaagtaagcgatctccggctggtagccagcgtcagtgaggacctcgaagcccatttcaacgagcttgttcacgccgcccatgagcacgttctgctcgccgaacagatcggtctcggtctcttcggtgaaggtggtcttgatggcgcctgcgcgcagggcgcccagagccttggcgtaagccagggtgatgtcccaagcgtcgccgcgcggatcctgttcgacggccacgacgaccgggacgccacggccgttggcgtactcacgacgcacgatgtggcccgggcccttcggggcgaccatgaagaccgggtggtcctcggtcggcttgatgtagccgtagtggatgttgaagccatgagcgaaggcgacggcggcgcccggcttgatgttcggttcgatgtcgttggcccagatggtgcgctggtactgatcgggagccagaatcatgatgatgtcggcctcggcggcggcttccggaacggacttgacttccagaccctgctccttggcgtgctcgacggacttggaggtcgggcgcaggccgacgacgacgtcgacgccggaatcgcgcaggttcagcgcatgggcgtggccctgggaaccgtaaccgatgatggcaaccttcttgccttcgaggaccgagagatctccatcgttctcataccaaatttgtgcagccattgtacttggcactccttttgtgtagtggggtgaacgcttggaaagcgttcgggtttctaccattcgcagatgaaattcgtggtttcgtgcatggattttgtcctgcaaactggggtccatcctaccggagcggccgttttggtacgtatccagtccacaaagtgagccgcgaaatcgtaaaaaattcgtcgcggcgcaatcgtgatacctttcctgcgaaacccctaaggaagcgacgtttcgggccgttggaatgttgtttccgttgggaattgcgattaagcccctaccgaagcgacgtttcaatcgctgaaaatgacgtttgtgtgggcaagcatgtgcttatttaggtgacgcttcatgcattttggtaggaaagtggcttaggataggcacgtaggattgtttgatgaggaagctgaagcaatggtcactgcgacggggattgcgcctggttccgaaatgacggcgcagatggagcaggtggaggagcgtaatgtctcgggcgtgctgcatatcgcctcgattttcgcctcgcacatggtattgcaacgcaacaagcccattgcggtgttcggcgcattggctgccgattgcgccggtatggaggttgtggcggaaatacacgactttgacggctccctgattgcgcaggaacatgcttattcttcgcagaacgtggtcaacggcttttcgcagtggcgcgtgatgctgcccgcgcaaccggaaggcggtccgtacacgcttcgtatcgtcgcgggcaatgatgccatcgaattcgacgacgtgcttatcggcgaagtgtggctcgccggcggccaaagcaatatggaacttgagttgcgtaacagcgagcatgccgacgaagcacttgaggattgcgccgatccgctgctgcgtttctacaatgtgcccaaaaccggtgtcatcaatcgcaatgcggaaaatacgtcgagttggcaggaatcatcgccggaaaacagtggcgtgatgagtgccgtcgcctactatttcgcacgcaagctgcgctccgaactcgaccccgatctgccggtcggcattgtcgactgctatatcggcggcacgtcgatcagctgctggatgagcgaggacgcactcaattccagcgatgccggccgcgactatctgacgcgctaccagcgtgcgatcgcaggcaagacgcaacagcagttcgagctggaaaccagcgaatggcagtcgcagatggacgcatggaacgcggctgtggaaacggtgcgtcagaccaatccgaacgcaacgagcagcgagttgagcgaacagtgcggcacctgcccgtggccgccgccgctcacccctacatcgcaatggcgtccgtgtggccccttccacgccatgctggaacgtatcatgccctactcgctggccggtttcctgtggtatcagggtgaggaagacgagcaatacagcggttcctaccgcgagctgctcggcatgatgatcggcgaatggcgtgcgctgtggagcgaaaatctgccgttcctcatcgtgcagttgccgcaatggatcaacggcaagacggctgcggacggcaacgatccgatgcgctggccggtgctgcgtgaggcccaatgggacgccgcgcagtccatagacaacgtgtacgccatctgcacgatcgactgcggcgaatacgacaacatccacccgctggacaagcgcacgcccggcgaacgccttgccaattgcgcgctgcggcaaatctacggcatggatcgcgttccggtgcacggcccgacggtgctgggcttccgatgcgacccgaacggccgcgtacgcctgttcttccgctatgcgcacggtttgcatttcgaaggcaccacgcccggcggcggcgacgacgatgatttcgatggccagctgccgactttggtgcgcgtgccggaacattccggcttcgaactggccggttccgacggtatgttccacccggcgaccgccgcgattttcgtggattgcgacatcgatgatctcgtcaattccagagtgaacgtggtcgattacaacgctacggaattcggcattccgattaacagccgcagcatcggcacgattacgctggcgactccggatgtgccggagccggtggcgatgcgatacgcctggcgcagttggggtccggctccgctgttcaacgacgacggcctgcccgcgcagccgttccgtctggacctgaccgaccatacctcccccgtcgagtccgccgagcccgtcacccccgacggcaccgctgactgaggccgtcggtctggtcgcgccggtctaatcgccccgtctaatcgcaaaaacggcattcccatccggcttttgttaccgtaaccagccgattcgggtaacaaaagccggaagaggaggccgttttgtgtttcttgcgattactcagcggttgcagcagccgcgtcgacaatcaccgccgcgtcctcgccacgctcgctgccggacttgccaagcgcaagctgggcggcggcgaacagcaccgccagccagatgacgccggcgatcacggcgatgcgatagcttgcggagaagcacatgagcaccacaaccagcagcatgaacgcgattaccacatacggcgtcacattggcgaacggcagcttgaacgcgatcttgtcgagcgcttccttgcccttcagccccttaagttcggccgggccatcgccagccgcaaccatgcgacggaacttaatctccgtaatcataatcatgatccagttgatcgcagccgcgatagtggcgatcgacatcagataattgaacgcgaattccggccatacgaacacgacgacaacggcaatcgcaataattatcgcggaagtgataacacccccgaccggcacgcctttcttgctgagcttacccaggtaagccggcgcgttgccctgctttgccagcgaatacagcatgcgggagttggcgtacaggccggaattgtagacgctcatcacggcggtcaggcacacgaaattgaggatgccggcggccgcgtgcacgccgacggaatcgaagatctgcacgaacgggctggaatcgccgtcgattttgctccacggaatcaccgccatgatcacgccgagcgcgcagatgtagaagacgagaatacgccagatgatgccgttcgtggccttcggaatggtggtgcgcggattctcggtttcgccggcggtgatgccgatgagttcggtgccgccgaagctgaacatcaccacgacgagcgccatcagcaggccggtccacgtgccgtcggcgttgcgggtcatcaggccgtgcggcaggaatccgccgtccacggtgaaccagttggcgaagctcgcgcgaatgcccgaagcggtcggcacgttggcgatcacgacatacaggccgccgagaatcatggccagcacggccacgatcttgatgatggcgaaccagaattcgaattcgccgaacttgttcacgcccatgagattcagcgccgcgatggccacgaggaacaccgccgccgacacccacttcggaatgttcgggaaccagtagttcacgaacgagccgaccacggcaagctccaccatggccaccagcacgtagttgaaccagtagttccagccggaaatgaagcccgctcgccgtgaccagtagcgcgtcgcgtagtagctgaacgcgccagccttcggatcctcgaccgccatctcgctcagagcgcgcacgatcatgaagatcgcgagaccgccgacgaggtaggcgagcagaatggacgggccggccagctggatggattcgctggagccgtagaacaggccggtgccgatggcgccacccagcgcgatgagctggatatggcggtttttcaacgatttacggagcgtcggcggaaccggcacgtcgtcggttccacgcggcttctttgcggcggtgacgtcgctcatggagatttcctcttctctgtttccttgcgattgcgcgttgtgcgttgcgctcgctgcttgcgttgcgtgctgttgcacgcttgcatgtgcttgttttgcttgcttttttgcgattcgccctttgtgagggaacgtttccgattgtagcgggaagcggcgggcaaagtgttggtttgttcgttccggaatgtctggtttgcttaacgggttgtttggtttagaagttcgattcgcgcgattgctgtgcgattcgaacgcgcgatttggacacgtgttgcggatgtgcggtttggcgcgtctttccaagcttcatggtgttcaatggaatgaggggctacgaacggaggtcgacatggcattcgtcaaggacatgctgcgaatgtgggcgcattcgtggaaaagattcatttccatcgccatgatcacgttgctcggtgtggccgtgctcaccggcatttacgcgggctgccgtgacgcgttccgcagcaccgatcgctttttcgacgcgcagggcctgcacgacgtccaggtgctgtccactgcgggcctgtcgaacggcgatatcgccgcgttgcgcaaggtgaacggtgttgcgaaagtgcaggcggaacggtcgcaggaagtgacgttcgatttggacggccgcaagtcggcgaccatgcaggaaatcggcacgaacggcattgaccagccatacttgcaggaagggcgcatgccgaagaaagccggcgaaatcgcggtaaccaggaaatttattcgcgattcgggcaagcgtatcggcagccgcctcaccgtaacccccgaatcggcttcctccgatacttccgatacgaacgatacgaacggtgcggacggcacgaatgaaacgaacggcacggacgaggcgccgagcttcccgaccaagctcaccatcgtgggcgtggtgctcgatccgcagaacctgagcaacccggacggctactccgccatgacctcgttccgttccaccgccaccaccgactacacgttcttcgcgccgtccgatggcgtgaccggcaccctctacacgtccgccacgctgctcgtcaagggtgcggccgccgaaagcacgttcgacgaatcgtacgaaaacaccgtcaagcaggtgaccgaccgcatcgacggcaccgtgaaaaccgaccgccagaaggcccgtcggcaggaactgctcgacgcgggcaacaagaagatcgccgacgcgcgtgcggaagccgacaagaagttcgcggacgcgcagtcgcaaatcgacgcgaatcggcagcaattcaaccagcaggtcgaccagattgtcagcatgcaggcgggcgcggcagctgcgggagctgcggcaaacggcgcgaacgcaggtgcggcggcggccgcaggtgcaactacccccaacttgacgaaaccacgcgtgaaacaatgcgtgaaaccatcatcgccgctagtcccgaactgacgcaagccaagcagcagctcgaccaggcgcaatcgcaattgaacgagcagaaggcaagtaccgaacatacgctgaaaaccaaggaaaacgagctgaaaaccagcattccgcaagtgcgctggtatgtgcaggaccggcagtcgctcggcgggttcagcgcgctcaaatccgacctcgactccatccagtcgctcggcaacgcgttcccgattgtgttcctgctggtggccgtgatgatgagcctgaccgccatggcgcgcatggtcgaagaggaccgctcgctcatcggcacgtacgtggggctcggctacgggcggctggcggtcgcgttgcgctacctgctgttcgcgttgctcgcctgcctcatcggcggcggcctcggcctgatcgccggcttccttggcattcctgcgttcctgctggtcgtattgcaaggcatgtatgtgatgcccggtctgcgattggaatacgactggctgtacggctcgctcggcatcgcgctgttcgtggtcggcgtgctcgccgccaccatctacgcgtgcgtgcaggaaatgaggcagacgcccgcctcgctgctgcgtccgaaagcgccgcgcgccggctcgcgcattctgctggaacggattcggccggtctggaatcgcatgggcttcctcggcaaagtgaccgcgcgcaacatcttccgcttcaagtcgcgcctcatcatgacggtcggcggtgtggccggctgcaccgcgctgatcgtctgcggcctggccatcaacgacaccgtcgcagacctcggcatcaagcaataccgcgacatctaccagtacgacctgatggtggtttccgacgattcgggcgcgtcggcgatgcgcacgaaagtcgcgtcagacgggcgcgtcacgtcatcgcttgacgtgcgcatagagtcgggcgatttgacggttgcgggcagtggcgacggtgacagcggcaaggccggcagcagcggcagcgaaagcatccagctggtcgcggtgccggaaaagcatctgtccgatttgggcgaaatggtcacgttgcagccggtctcgtccggcatactgggcacgtccggcgtcggcaaaaccggttcgctgaaactcgatgacgatggcgtgatcgtcgcgcaatcggcggcaagcgcgctgggcgtcaaggccggttccaaggtgcgactgaccaacggtgacggcgtgcaggcgacggcgaaggtgagcgcggtgaatcgcaacctcatcggctcggatgtgtatgtaagcgaaacctactacgccaagcttttcgactcgaaagacgcgaagaacaccaagaattccaagagttccgaggattccgaggctctgacgtggaacgccatgctcgccaagctttccggctccgacacttcgcaaaccgactatgcggaatcgctcgaagaggacagttcggtgatgaaggccgtaagttgcgcgcatatggccgacagcttcaaattcgacctcatgggcgcggtggtggcgctgatcgtggcgctcgccggcggtctggcgcttgtggtgctgttcacgctcgccaacacgaacgtgtcagaacgcgtgcgcgagatggccacgctcaaggtgcttggcttcttcgaccgcgaagtgcaccattacgtgaaccgtgagatgatgatcctcaccgtcatgggcgtgatactgggtctgccgctcggccggctcgtcggcggcatgctgacgatggcgctcaacatgccctcgttgtatttcgaggtggaggtcaagccgctgagctacgtgatcgcggccgtggcgaccatggccttcgcgctgctcgtgcagctgttcgtcaaccccgtcctcgaccgcatcgaccccatcagctccctcaagtccgtggagtagcgctcctccgaagccctctcagttcttcgggtagcggtagttgtgggggagttgggtggtgagctgcgggttcaggccgagttccttgagttggcggtcgatttcgaggcgcgcacgttccacaagttcggcgcgacggctgtccaaaccgttcagcccctcctgcttttccagcgattccaacgtctccgccatacgcttgagccggtcctgatggtgcagcagcgcgcgtacctgcgcatgttcgcgtacgatcgtccgccaatcggatggcgtgtgcgcgatctcccgaaccgcggtgaccggatgtacgtcggccacctgatatgtgatcgagccgagcagcggcatcaggaacaccgtgatcgcgccggctgcgaccagtgtcgacgcggtgtcgctttgcatggtgccgaccttcaccgccagcgacgtgacggcgacgatgatcggcagcgcggtcgtgcaatacagggctacggtgacgcggtgatgcgatgacagcggattcttgcgtttgtcgagcgatagcgcaagatatacgggcaccgcgcgaatcagcatgagcatgacgatgaacgcgacgagcagtgcgggccgtcctgccacggcgcgcacgttgatcgcggcgcctgacaccacgaagaacacaggaataaggaagccgtagccgacgccttccagtttcatttccagcgacttgctgccgtcggggatgatgtaacgcaggatgaagcctgcggcgaacgcgccgagcaccgcgtcaagttcgaacagtgcggaaatggtgacaaggaagatgagcaggaatgtggtcagtcgcatgagcgtttgcgatgacgtgttcgcgttttccgtaaggaaacggtacaggcgatggccggttttcagtgctttcgtaggtagcatcgcgcacagtaggcagatggcgaggaacgcgccgagcacgagcatggtctgccagccggttcgggtggatagcaggatggccatggcgaggattgggccgagttcgccccacgttccgtacgagatgatggcgtcgccgatgggggtgccttcgaggttgcgttccttgagaatcggcatgagcgtgccgagagcggtggtggtaagtgcgattaccgtggcgatgccgttgatgccttgcttggtgaagaacggaaggaatgtcacgaccagccaggcgaggcctagcgtgattccccatgtaagcagtccgactttgccttgatgtccggcgagtcgtttggggtcgatttcgtagccggcgagcaggaacaggaacgccatgccgagctcgttcaagagtttcacggcgtcgttcacttcgattatgcctagtccgtacgggccgagcgtggctccggcggcgagcagcagtacggtttgtggaatgaatcttcccggaatcagctgcgccacaatcgggctgacggccgccaccgccatgatgatagtcagggaaacaagctcttgcgtcataccgtcgagcctagtgagccattgtgaccggaggttgaagaatgtgatttccgctatctgtggcaggtttcttcggggaaaccgacctagggggcatgattcctacccccctaggtctggatttgctcaagggacctgccacacataacgcaaatcgttttcttgtgaagggcgaatctgccacatatagcacgtttcacgacattaagggggtcggtcgcgtttgcgaggcggccaacccccggttctcgtccgccgcgcgcaccgcccgcccgccaaatgctatctagcttatagatgacgggtggttcgccccatttgccagttcggggtataaatcatacccccgaaccgcctattctcgtctagcgcccgccatctataagcgaaatacctttccgcaaagccccaaatccgccatctataagccagatagacccatcagtttgaccatggatagactcggttagagatgctcttggcaaaaatgccaatttcggcctcctgcaagggttttgctggggctaacccgcgatttgcataaaacctaacccacgatttgcgtaagtcctaacccatgatttgcgtaaaacgtggttcgctcagagctgtggccggagaccgtccaagttcgaccgacattatcggaatcgtcagggaagaaggcacgcgggcggagtgcaatataatgttccctatggctggcagttcaagggggcaagactgatggcagtttttccgcatgggagcgcgcggcgggtcgagaagcgacggtccgcagcaaattaaggacttacgcgccgacgatttttatggcgattcgcacgatggcaacgacggctcgcgcggtccgcacgacaccacgcgcaacacctgcacctacaccctcccgactttcgcggaggcgaccgacgcgtccgaagcgatgcgcgagcgtcgcgcggatcgcaacaagtccattgccatgcgcgtgcttgcggcggtgctgattcttaccgcgctcggcattggcatgtttccgagagtgttgcaataccgttcggcgcgcgagctggcgagcacgtcggcgcgttccgaaaagcgcgtggcgggctggccatacccgcaggccgatgaggcgttcgccgcggccagggagtacaacaagcgacttgccaagtcggggcagccggtgattggcgaggcgaaggatccgctcgccgaactgtatgacgatccgcagaatgcagccaacaacgccagcgccgacggctcagacaactccagcgactccgccagcgccaaagacacggaatatcaaagcctgctcgactccggcgatggcgtgatgggggccatccgtattccgaagatttccgtgaacctgccggtttaccacggcacgtccgagctgacgcttgcgtccggcgcgggtcacctgtacggcagtagcctgccggtgggctcgactccgaaaccgccatcagcatcatcggacagcaggcccgccgcatcgacgaggtgcagcgcgaaaacgaagacctccgcgccaaactcgacgagctgaccgcctagcccgctcattcttcatcatgccggcttctgttcctcccaacagagccggcaagcgtcatctgtcagacaaaagcgggcgcattgggcggttcccgcggtagggtgtgaccattatgactttagggaatacgaataccgggaaggccggcacaaacacgcaagctgccgacgcgtctgacgcaacgcagaacgcgcaaagcacacaatcgcatatcaaatccgtcgaaagcctcgacaaagacaacgacatggaacgcggcctgaaaaatcgccatgtccaattcatcgccatcggcggaaccatcggcactggcctgttcctcggctccggcaaatcgattgcgctgaccggaccaagcatcatcttcgtgtacatcggcgtgggcctcatcatgttcctgctcatgcgcgccatcggcgaaatgatgtacagcgacccaagccagcacaccttcatcaacttcatcacccgctacctcggccgcgcgtggggcaaattcgccggctggacgtactggattgtgctcatcctgaccggcatgaccgaaatcacggccgtcagcacctatttcgtcacgttcttcggcacgttcggcattgacctcaacgcgtggaaatggcttatcgaactgtgcttccttgtggcgctcaccggcatcaatctcattgccgtgaaagtgttcggcgaggcggaattctggttctccatgatcaaaatcacgctgattgtgggtctgattgtcaccgccgtggtgatgctgttcctcggtttcagctacccggccacgcatatcgaaggcgtggacggcacggtttccggtgccactgtgagccttacgaacattgccgacggcttccagctcgcgccgaacggctggatgaacttcttcatgagcttccagatggtgttcttcgcctaccagctcatcgaattcgtgggtgtgaccgtgtccgaaacccagaacccgcgcaaagtgctgccgaaagccgtcaacgagctgatcatgcgcatcctcatcttctacgtgggcgcgctcgtggccatcatggcgatcgtgccgtggcgcaacttccaccagaacgcggacggctcgttcggctccccgttcatcatggtgtttaagtacgcgggcctcgactgggctgccgcgctcgtgttcttcgtggtgatcaccgcagccgcgtcagcgcttaactcgctgatctactcggctggacgccatctgtaccagctcgcgcaggattccgaatcgcccgccatgcagcgtctcggcgaagtgtcggaccgcaaggttccggcgaaggcgattatcgtgtccggctgcatgatcctgttctccccgctgatcaacgcgattccgggcgtttccggcgcgttcgtgctgttcgcctcggccgccagcgccgtcgtgatcttcatttacattctgacgatgcttgctcaccgccgctaccgtcaaagcgccgactttctgccggacggcttcgtgatgccggcctggcaggtgtgcgattggattgcggtcgcgttctacgtggtcgtgtatgtcacgttgttcctgtcttccgacacgctcggttccgcagtcgccggcctggtctggtttgtcgtgttcggtggctactgcctgctgcacgagcggttccagaaccgcgacctgaaggcggctctagggaagtagacgtattgcctgtcgctgcggtatgcgtggcatgcgcgtgttgcgctacgtgccgcgcatctgacgaaagagggtcggtggaaaccttgcgaaaatgtgcgtctccaccgaccctcgtcgtgtaatcgcaataaaacagtgcgaaacgttagtgcacgaatcgtacgaaaccgacgcgaatcagccgatgtagtcggcctcgttcgttgggctggacggcacggcatgatcttccgtaaccttgcccaagccagacaaatacgcttcacgaccagcttcgatcgccttcttgaacgcgcgtgccatcagcggaatattgccggcggaagcgatggccgtgtatgccatcaccgcgtccgcgcccatttccatggcttccgcagcctggctcggacggccaataccagcgtcgataatcaccggaacattggaattcttgataatcacttcaatgaaatcgcgtgcacgcagacccttattcgagccgatcatcgcgccaagcggcatcacgcaagccgcacctgcgtcttcaagacgcttcgccgcaatcggatcggggaacatgtacggcatgaccacgaagccttcttttgccagctgtttcgtggctttgatggtttcctcattgtcgggcagcagatacttcgcctcatgctcgatctccaccttcacgaagtccgtctggcacacttcgcgcgcgagacgggcaatacgcaccgcttcctctgcattgcgtgcgccggacgtgttcggcagcatggtgatgcccttcggaatgtagtcgagcaggttgttttcggtggtgcggcagcggcgcagcgccatggtgacgatctgcgtgcccgcgttctcgatggtcgccttgatgaggttcaggtcgtaacggccggaaccgaggatgaaacggctcgtgaacttgtgcccgccgaggatcagcgggtcggcgtcgccggtggcgatctcgtcgtacgcatgagcgtccggctccggcaggatcgccgtgttcgtggtggtgccgaccagctcgtcgagcgtggcgttcggtgcggccgcgacgtcggcggctgcggtggtgatggtgttttcggtgctcatcgtcggttcctttcgttggggtgtttgttgttgttgcgattgctgtgctgctgttgtgttgccgttgcgtcgctgttgtgttgtgtgcaacgtgcgtttgtaatcgcaataaaaatttcgattacggcagtggagtaacgtagcagtgcgtcaggcgtcttcctcgccgaggatcagtcgcgtgatcatgttcgcttcgtggcaggcgaccacgcccacgcgcggcgccatcaggccggcacccggtaccggagccgtctcgccatcgccacagaagtagaagttcttcgaaacgcgacgcgtgctcaccaggttggagctgcggaagccggccatgccggacgcgctgacgagcttcttgcccggcagattctccagcaccgcgttgacgagcatcgtcttgttttccggcacgtcgaacgcctcgcagatgatgtcctcgttttcgaacagcgtcggcacgttctcgtcggtcaccttgacggtgtcgatggtgatgtccgtgaacgggttgatttggcgcagattgctgcgcagcgcctccgtcttgtactggccgaggtccttcaggaaatactgctggcgattcaggttcgtcatatccacgcggtcgaagtcgatcaagtgcaggtggccgacgccgatgcgggtcagcgccaccgcgatggtggagccgaggccgccgcagccgcagatggccacgtgcgccgcgtcgagcttgtcctgtgtggcggccgtgtgacggtcgagcagggctgcgcggatctcctcgcggctgaccaaggtggccgggtcgggctggttgtcgaaagcgtgctggcgggcgtcgatctgcgcctgcgatgcggatggttcaaaagtcatggttgttctcgtattctcgtttccgttcgtatggtttgtttcgctgctgtgctcagccgccctgcacgaacgtgacgatttccaacgtgtcggtgcccttgagctgcgtctgcgcacgctgggcgcgcggcacgatctcgccgttgagctccacggccacgcggtcggcgcgcagaccgcgctgctccactagttcggccacggtgatcggcgtggcgacgtcctcttccttgccgttgatgatcatttcggttcccttctgtatgtcaggccccacgagtgccgttcccgccgaaacggacgttcagaactgctttgtgggcttccgagcgtctgcttccggtgaatcggacattcacggttggtacgaaaaaagggtcgccgaaggaaccgtaccctatgaggtggtgcgcccctccgtgaccctaatcacgcgatattcggttatcgcgaacggaagatgagatacgccttgcggcgcgaacaacccgtctccttacggcggcattacccgcatcaagtcctcggtcgaagctgtatgagctccctctcagcctttcggctcccgttcggttgtgcctttatcttcgcgcaggcgcccgacaagcttgcgccggttcacgttgggttagtcttgatgtgaacatgtgcgaatcggctgcgtgcttgcaaggaaggggaagatgatgatgaacggtgagttggcaggatttacgattcctcggctcggcatgggaacgatggctttggcgattgaggggcgtccggatcgcgatactgcgattcgtacgattcatgccggtttggacgcgggtgttcgctatttggatacggcttggtcgtattatctgccgagcgagcctggcactggcactgcgaaagatttggggtacggcgaaaagttggtgcgtgatgcgctcgcttcgtggaatggcccccgagatgaagtgctggtcgccacgaaaactggctatcgacgcaccatggagatccccgcttttgttgctcctgtgtccgattcgccagaatcggacactcaggggcgggattccgagggctgcagtcgtcggcctggcggggaacgccagcatttgcaggcggcgggcagtcaatacgggtggatggcggattcgcgccccgaaaccatgattcgtgacgccaaggaatccgcgctgcacttgggcgtcgatacgctcgacctgttgtattcgcacggaccggacccggaagtggcttatgaggaccaggtcggcgcgctgaagcagctgcttaacgagggcgtgatccggtacgcgggcatttcccgcgtggacaacgcgcagatcgacatcgcccgcgagattctcggcgacaagctgatcgccgtgcagaaccagttctcgccctcgcaccccgaccctgagcatacgatggagcactgcgcggaacttggactcgcgttcgtgtgctggagccccctcggcggcttcctcgacgcgttcgaccagcgcgcgtacgacccgttccgcacggtcgccggcaaccacggctgctcctaccagcgcgtggtgctcgcctgggaactgagccgctacgagcggttgttcaccatccccagcgcccgcaatccgcaggaaatcaacgattccttcgccgccaccgaactgacgctcacgcaggatgagctggcgatgctgaacgcctccgtcgacgcccgtcgcggctgaattccgcgcaatacgtacgattggccgcgcccgattccgcacaataatcgcgattcgggccgcggcctttttcgtgccttctgtagcttgctcgctgcaaaatcgccctgggaataacttacactgtaaaatgtttacactgtaagatattatgacggcgattgcgacggaaggaggtgccgcgtgggctttgaagaggaactgttccacgaattggcgaccaacacatgggacaaacgctcgcgcatgcagcaggagatggtgaaaggcgcgaagggcgaacccttcgccgtgcaggaactctataggaaaggcccgctgacgccatcgcagctcgcctcttcaatgaaaaccaccaccggacgcgtgtctgcactgttgtccgcactggagaaaaaaggccagatcacgcgcgaatccgaccctgacgatcgccgtgtggtgcacgtgaaccttaccgaagccggcagggagcgcgccgaacgtcagcgcgaaagcatgcgcgaggcgatctgctggatcttctcgcaaatgggggagcgacgcgcgcgcgaattcgttgagctcaccgaggaattcaccacgtacatgtcgctgtgcatgcccggcaaaccgcgccccacggcggacgaggtcaaagccgcgttctcaggaaacgcacaggaagacgcgtagtatcttacgctgtaaataattcacagtgtaagtaatcgcaatccagtaatcgcaaaaaccgcgaaaaatcgcaaaaactaatcgtaagaaaacaagcaaaacacaaaacaagagaaggaaccaagcatgcttcgcatcgtacgatacctctccaaagcggagatcggtcagatgctcgtcgcgctggtcagcatcgtcggtcagatctggcttgacctgaccctgccggactacatggccgacatcacgcagctcgtcgaaacccccggcagcgaaatgcacgacatctgggtggccggcggcaaaatgctgctcgtctcgctcggatcggcggcctgcgccgtcgtcaccggcttcatcgccgcgcgcgtgggcgcctcgttcagccagcgcctgcgttcgcttgaattcaacaaggtggaaagcttcggaccggcggaaatgaaccgtttctccaccgcgtcgctcatcacccgctccacgaacgacatcacgcagatccagatgttcatcaccatgggcctcatgatgatcgtcaaagcgccgatcatggccgtgtgggccgtgtgcaagatcgcaggaaagggcttcgattggacgctcgcaaccggcatcgccgtggccatcctgctggtggtcatcgccgtgctcatgcacttcgtcatgccgaagttcaaggccatgcagcgcctgaccgacaacatcaacctcgtggcgcgcgagaacctcaccggcctgcgcgtggtgcgcgcgtacaacgccgaggactatcaggaagccaagttcaccgaagccaacaaggaactcaccgaaacccagctgttcaccaaccgtgccatggccatcatgatgccgttgatgaacaccatcatgaacggcctgatgctcgccgtctactggatcggcgcgtacctcatcgacgctgccgaagccgtcgacaagctcaccaccttctccaacatggtggtgttctccagctactccatccaggtcatcatgagcttcctgctgctgagcatggtgttcgtgctctggccgcgcgccgacgtgtccgcgcagcgcgtgctcgaagtcatcgacaccgagccgatggtcaccgacggcacgcaggacgcgggcaagccgggcgaggaaggcgaaatcgaattccgcaatgtgagcttcgcctaccccgactcgcgtcacgccatgctcgaaggcgtcaatttcaaggcgaagaagggtcagacggtggcgttcatcggctcgaccggctccggcaaatcgtccctcatcaacctcgtgccgcgtttctacgacgccacgcaaggcgaggtgctcgtcgacggcgtcaacgtgcgcgactacaagctgaaggcgttgcgcgacaagatcggctacgtgccgcagcagtcgttcctgttcaagggaacgatcgccagcaacgtcgcgtacggagatacggaccgcgacgacgacaccgtgcgccgcgcatgcgacgtcgcgcaggcgacggaattcatcgacaaaaagcagaagaagtacgattccggcatttcgcagggcggttccaacgtttcgggcgggcagaagcagcgtctgtcgatcgcacgcgccgtctaccgtcatccggaaatcctgatcttcgacgattccttctccgcgctcgacttcaaaaccgaccgtgccgtacgtgacgcgctcgaaaaggaagcgaaggattccacgaaactcatcgtcgcgcagcgcatcggcaccatcatgaatgccgaccgcatcatcgtgctcgacgacggcaaagtggtcggccagggcacgcacgaggaactgctcgacacgtgcgaagtgtatcggcagatcgccgaatcgcagttgagcgaagacgaactgaagcgctgaaagggggagacatgccaagaggaatgggacgcggccgtggggccgtggaaaagccgaaggacttcggcggagtgatgaagaagctcgtgaaattctgcagccggtacattccggtgatgattctcgcgctggttctgggcgctgccggcacggtgtgccagatcatcggcccggacaagctcaaggacatgaccaacgagatcacgaagggtctgccggccatggtgcacggcaagcccgtcatgaattcgatcgatatggacgcggtgtcgcgcatcgcatggctgctcgtcgcgctgtacgtcgggtacgcgctgctgagctacctgcaaagctggctgatggccaacgtcacgcaacgcacggcacagcagctgcgtgaggcgatcagccagaaaatcaatcgcctgccgctgaaatatttcgacaaagtcagctacggcgacgtgctgagccgcatcaccaacgacgtcgacgcgatcggacagacgctcggccagtcggtcggctcgctgatcacttcgatcacgctgttcttcggcgcgctcatcatgatgttctacaacaacgtgaccatgacgctgtgcgccatcggctccgcgctgctcggcctgatcatcatgggcgtgatcatgaaggtgtcgcagaagtacttcacccgccagcaggtggcgctcggcgacgtcaacggccacgtcgaggaaatgtacaccggccacaccgtggtcaaggcgttctgcggcgaggaacgctccatcgagcagttcgagaagtacaacaacgacctgtacgtgtccggctggaaaagccagttcctgtccggcctgatgatgccgattatgaacttcgtcggcaacttcggctacgtggtggtgtgcgtggtcggcgcggcgctcgccatggacggcaatatcgaattcggcgtgatcgtggcgttcatgatgtatatccgcctgttcacgcagccgctgtcccagttcgcgcaggcgttccagaacctgcagcgctgcgcggccgcatccgaacgcgtcttcggcttccttgaggagccggaactgtccgacgaaaccggcaagcaggcgctgctcggcgtcggtgcggacggcaagccgcagccggtgcgcggcgacgtggaattcagccacgtgcgcttcggctacgatgcggacaagaccatcatcaacgacttctccgcgtccgtgaaggccggccagaaggtggccatcgtcggcccgaccggcgccggcaagaccacgatggtgaacctgctgatgcgcttctacgagatttccggtggcacgatttcgatcgacggcatcgacaccaagtccgtgccgcgttggaacgtgcacgaccagttctccatggtgctgcaggacacgtgggtgttccgtggaacagtgcgtgaaaacatcgcgtattcgaagaaggacgtcaccgacgagcagatcgtggccgcatgcaaggccgtcggcctgcaccactacatcatgtcgttgccgaacggctacgacaccgtgctcgacgacaaggcgtcgctttcccagggccagcgccagctgctgacgatcgcccgcgcgatggtggaggacgcgccgatcctgatcctcgacgaggccacctcctcggtcgatacacgcaccgaggagctgatccagaaggcgatggacgcgctgaccgtgggccgcacgagcttcgtgatcgcgcaccgcctgtccaccatccgcgacgccgacatgatcctggtgatgaacggcggcgacatcgtggaacgcggcacgcacgaggaactgctcgccaagggcggcttctacgccgacatctacaacagccagttcacgctggccgagtgaggttggtgtgctgactcgctaaaaaatccggagggaccacccctccggatttttgcgttttggcttcggcatttttattgtgttgcgctgacgggacggcggatttaccattgaggtgactgacgtcaatcgattgacgtatttgaaaatcacaaagaaagtgggcagtcatgaaaagcatcgaaatcggcaaatcggcagtggtcgcatcgcaggcggcgctcggcgtgatgcgcatggacgcgctggatgcggatgctgcggcagaagtcgtgcgtacggccgccgagcatggagtcaacttcttcgacacggcggacatctacggattcaacgtcaaccgcgaccatgccagctcgcgtgtgctcggccgcgcgtggaaggacgccgggctcaagcgcgaggacatcttcctgcagacgaagttcggtatcaacatcgacttcagcgacccgaacaacgtgcacgccacccgctacgacttctccgcgaagcacctcatcacgcgactcgacgaggaactggaagcgctcggcactgactacgtggacttcgcgctcctgcacaggcccgacaccctgatggaggccgaagaaatcgtcgaagcgttcaccaccctgcacaaggcgggcaaagtgcgccacttcggcgtgagcaacgtgaacccgtggcaggcggaactgctgcagtcctggctcggcgacgacccggccatgaggctcgaggcgagccagctgcagttcggcctgatgcacgcgcagatggtcagcgacgagctgatgaccaactccggcgccgaaggcatggtcgtggccaaccattcggacggcctgctgtcctactcgcgactgcgccacatgaccatccaggcgtggagcccgttccagtccggcacggaatacggcccgttcgtaggcaacgagcacttcccggagttgaacaaggcgctggacgaaaaggccgccaagtacggtgtgagcgccaacgccatcgccaccgcatgggtgctcaggcatccggcgaagatccagatcgtgctcggctcgatgaaccccacccggctgggcgaaatgctcgacggcgcggacatcgacctcgacaagcaggattggtgggacctgtacgtggccgccggcaacctcattccgtgagttttgcttgcgattggccggtttgcggtctgcgattggcgggccgccaaccggccaacctggcaatcagtgaccggtcggcaatcagaagaaacggccggggaaaccggcgctgatggtggcgtgacggtcggcgtccaacgtggcgcaatcgaaaacaaaaacgctgcgcagttcattcgggtccgcaacgaacagcgccgtagccaacccgtccgccaccgcagtcggatagtcgccaaatgacgcggattgcactgcaacccaggcggcttccgtttgttgcacgggcaggccgtcgatggcgttgagcaggtggtgaatcgccagatgcgtctgttcgttcaccgccacctcccaatggcgacggctgggcgcgctcgcacagaacgcgccatcgccgatcagtgcgacgccgaccgcgcaggacggatcatccggatcctcaagcgccacacggatcggcttgttcgtgcgcgccagcagatcgccgcccgcatcaatcacaaattccggggcagcgctttcgcgtttgctgtctgagatggaagattggcatgtcgggttggtcgtttcggctgacttgacatgcgatgtgcgcgaaagttctgaatcggtgagcaatccgcccagcgaatccaccagataacccttgccgcacgcgccgaaatccacatgaaccggactgcgtgtaaccaatgtcgtaccactcgaacgaaccacatcacgaccccatacggcccgtccgtgcagcgcgcccaggcgctcgccggcgtcggcttcaacggtgaaactcagcgcgggatcgtaaccgagacggatcaggtcctcgcccacgcacgggtcgatcgcaccgcgcgtggcggcgtgcagcgcgtcgtacaaatcgaatagcgggccggcccaatcgggaaaatcgaaatgcccgccatgcttcgcattgccgatgtgcgcaaccagcgaatcagcgcgaaaccgcgaaagcgcatgctcgtattcatcgatgaaccgttccatctcgccgcgcaattccgcagtgatcgggcgaggcgtcgaaatcagcaaccccgtgccgagcgccttggggaaagcggcggtgtacggcatgcgatgcgcgagcggtgcgagggaatccatacccacgatgctagcgcgtgcccggcttggcggagttcgtgcctgggcaacctgatatgcgctatatgtggcatgaggcatcgccttattttgatacccccgtagctttgtatagttacgattatactaatcgtgattatacagaccgacgctttggcatggagttcgcttcacgttttcgggcggacgggggtgttgcggaacggcggtgagcgtcacaatgtgagacgacacgcggaaaacgggaaaaataaaaacggcggaattccaacgtttttccatgcgcgatacaacaagaccaattaaaaatcaagactgttattcaaaaaagtttcgttctatcttggcttccgatgcgcgcttcgtacgtcgggtacgtcggggaaagcgcgccgaaaagatttgcggaaggaaggttcgacccatgtcatctcgcgtcgcgcagcgccatgcagccggttcctacgattcgtgcgattcgcgcgtctcggcttccggccgtcttgccgcgctcgtcgccgcgctgatgatcgcgctcgccacgctgttcgccggcaccgcgatgccgcagcaggcgtccgccgccgacgacagccaaacgaatttcgattcctggaccgccgctgcgcagaacatcgccaagcagctcgccaccgccgaaaaagactacaacgacggcgattacggccaggccggcaccggcttccagaccgcgcattggatcggctacgacgcctccaacttctcgaaggccgtcaacgacaccatttccgccgacaagcagcaggcgttgctcacacagttcaccgacttggaaggcctcgcctaccagcagggccagggcggcgcgatcgccggcaaaatcgatgcgctgaacgcggacctcaccgccaccgcgcagacgctcgatggcaacgcgaacctcgccgaccccaaaacctacgcgaagcagcgcgccgaacagaccgcagccgaacgtaagaagctcgacgcggccaaaaagaactcctccaaaggcaaaggcgaccgcacgtggggcgaagtcgccagcgaaatgaacgtcatcctcgacaaggcatacaaggccgccatctccggcaagggcgcggaaggctccagcctcgtcaacgacgcgtactaccagtactacgaaaagctcggcttcgaaaagaacgtcatgaacgccatctccggcgaccgcgtctcgcaggtcgaataccagttcaaaatgacccgcaaaaccatgcgcgacggcagttcagacaaggaaatcaagaagctcgtcgacgacctgaaaagctggctcgtcgaagacgcggccaccctcgacggtggcgcggccggcaacgtcaacgccttcaccaaagccatcaccagctccgccggacaggcgttcctcatcctgatccgcgagggtctcgaagcgctgctggtggtggccgccgtggtggcctacctcgtcaaatccggcaaccggcgcttcaccaagtggatctacctgggcgtgctcgccggtctcgccggttccggcctgatcgccgtgctcttcacgttcctgttcggcggctccggcccgattcaggaaatctccgaaggcgtgtgcgcgctgatcgccatgctcatgctgctgtggaccagcaattggatgctcaacaaaagttccgtggaagcgtggaaccgttacatccgcaccaaaaccgagtccgccgtggccgacgcgcaaaacaaagtcgccgccggcgaaggcgtgggcctgggtatggtcgtttcgctcgccatgctgagcttcctagccgtgttccgtgaaggcgccgaaaccgtcatcttctacgaatcgatctactcgatgagtcgcgacgcgcaaggcatgtggatcggcggcatcgccgcgggtgtggtgctgctcgtcatcttcctcgtgctgcgcttcacctccgtaaagattccgattggcccgttcttcctcgttacgtcgatcctgatggccgtgctggtcgttatcttcgccggcggtggcatccacgcgctcatcgaaggtgacctgatcgacggccactacctgtccagcgtgcccacaaacgactggatcggcctgtatccgtacgtcgaatgccttgcggcacaagcgatcgcggcgattgccgtactcgcgctgttcgccgtcggcttcgcacgcaaacgcaagttgcgcacgcctgacaatcgcaagtaatacgcaaattttccgagatttaccgatattttttccacatccaacaacaaaggaaagagaaatgaagaacaagaagatcgccgctctgctcggcatcctgctggccggctccatggccttctccctgtccgcatgcggcaattccagcgattccgccgcttcggacaagtccagcgcctccgcgtcggcttcgaaggccgacgactccagcaaggacgattccagcgattccgccggtttcgaagagatccaggtcgatgagaagcactccgaccaggaatgcggcccgctgaccgtcaacgccgtctacttccagccgatcgacatggaaccgtccggcatgggcctcaaggccgccgatgcgagcttccacctcgaagccgacatccatgccaaccagaagggcaccgaactcggctacggcaagggcgatttcgtgccggacctgaccgtcaactacgacatcatcgacaagacctccaacgcgtccgtcgcctccggaaccttcatgcagatgaacgcctccgacggcccgcactacggcgccaacgtcaagctcgacaaggccggcgcgtacaagctcgtgctgaagatcgaatccccggagaagaagggctggatgctgcacgtcgatccggagacgggtgtgaagggacgcttctggacggaaccgatcgaggtcaccttcccggactggaactatacgccgcaggagtggtgatctcctagcgtagcccgttcgcggtttcggtatgcattacccgacacactcaaggccgttcggtcaagcttacggtcgggcgatgcataccgaaaccgctctctcgcgtttagggggatggattcacctctgcgattgtggggggggtccgggaaatcctcgcattttaggggagggatgagaggggtgggactctttgggatggggcggaatgggaatcgttgggctctttgagttgggtttttggatgaaaggattttgggatgctgctgcagtttgtgacggtgttgcagggggtgttggcgccggcgctgctcgtcatggcgttgagcgtcatgctcaccgtcggtgaggggcgtgacaagcctctgagcgcgtactggcggctggccggtttcgttgttggattcgccggcgcagtcgtattcgccgcgctgcgcgccaccgccgtcatcacgcaacgcacgttcgtcaactatccgaccctgtggtgctgcgtgatcctcgacgtggccgtgttcgtcatcgtcctgttcgcctgccgcatcaccgccgactggcacaaccaccgcgcgctgctcgacatcgcgaatctcgttgcggcgcttgcgatcgcggccaccacctttcgtgcgctgcccgacgtgattctgcgactgacgatcttcgtcgagccgggcgatcccatcttcacttccgacatgctgttgcgcgcgctcggcttcgctttgggcgcggccgtcgcaatcatcgccgcgcttatcttccgcacgatgcgttccaccgccgtccgctggtcgttcacgacggcggtgctgctgttggtcgcgctgttgttcgcacagcatttcaccgaccttgcgcagatcctccaatccaaacgcatcgtcagcttcccgaccgccgccttcctcgcgctcgtgtggggcatcaaccatcagcgcagcctgaccatcgcaatggcgctcgtcttcgccattccggcaatcgccagcatcgtcatgggcttcaaagtcaagccgaccggcgccaacgaggcgatcgcacgcacgcatatcgcattccgccgccgcgcgaaagcggccggcgcgttcagcctggtcgccatgatctgcgtcaccgtggccctgacgtacggcgtcgcgcaaacgcagaaagtcgtcacgctgtcgccgccggaagactactcgctcgccgacggcgtggccaccatcaaattcagccagatttccgacggccatctgcaccgcttcgaataccgcgcgaaggacggcacctccatgcgattcatcatcatcaagaagaacggcggcgcgtacggcgtcggcctcgacgcgtgcgacaactgcggcgacgccggctactacgagaaggacggcaaaatcatctgcaagaagtgcgatgtggccatcaacctcgccaccatcggcttcaaaggcggctgcaacccgataccgttcgactaccaggtcaagccaggcaaaatcgtcatccaaacgtccacgctcgacgcgctgtcgagccatttccagtgagcgccgagaaaggtaagggggtgccatgttcttcctgaaaatgatctctcgctcgttcagccggcagttcaaacgccgtctgctcatcgccgtcaccgtgtgcctgtccgccaccgtcagcgtggccatgctcggcgtggtgttcgacgtgggcgacaagctcaacgcggagctgagcacgtatggttcgaatatcgtcgtgcagccgaagtccgacgctgtggtgagcgatttgtacaataccggcgattctgctggctcggcttcgggtagttcgtccggttcggacgggggttccacttccgacggctcggctgcggcggacagtgccgacccgaccgcgtttctgaaggagtcggacgcgcagaagatcaagaccatcttctgggcgttcaacatcaccaatttcgcgccggaattgaacatccacgcggatgcggggtgtgtcggttcgggggctagttcggctggctctgctggaacggctggtgcgtcaggtgcggctgcttccgcggcgaaatgcaaggcgaccaacgtgccgatcgtgggcacgtggttcgcgaaaaccctgcacatggactccggcgagtccaccgtggccggcatgaacggcatgcgctcatggtggaaaatcaacggaacctggccgaaagacgacagcgagcaggcgatggtcggcagcgcgctcgccgcgaaactgggcgtgaacgtcggtgacagcgttacgctcgacaagacgatcgccgtcggtgcggacgacaatacgaacggaggtaccgggaaaaccggcaaatcctccaccgaacgcaatcgcgtgaaagtgaaaatcgtcggcatcttcgattcgggcgattccgacaacagcgccatttatatgccgtccatcgccacgcaaacgcttgcgaatctgccgaattccatcgacaagattgaagtcaaggcgctcaccacgcccgacaacgacctcgcgcgcaaggcgtcgaagaatccgaacgcgctcacgcaggacgagtgggagacgtggtattgcaccgcgtatccgtcgtcgatcgcgtaccagatcgaagaggtgctgccgggcgcggtggccaagcaggtgcgccaggtggccgcgctgcagggcgatgtgctgaacaagacgcaggcggtgatggtgctgatgaccgtgctgttgctggttgccgccgcgatcgccgtggcgaacctgatggccgcgtcgattggcgaacgcggttcggaattggcgctgttgaaggcgatcggtgccacggacggcgcggtttcgcgccttatgctcgccgaaacggcggtgatttcgctggttggtgcgattgccggcgcgctgcttggctcgggcgttgcacagatcgtggggcacgtggtgttcggctcgggcatcaccatgcgtccgatggtgttcgtgttggttttcgtgttgctggcggtcactgtgctcgtggcctcgctttcgtcgattcgggcgattctgggcttgcgtccggcggaggtgctgcatggtaggtgagttgtgcttggctttcgtagggggtgtgcgatgacgaatcgcaagatgttcttcactatgctgtggggcgcggtgttccgccgtcgctcccgtgcgatgatggccgtgattgcgtcgctcgtcggcgcggccacgctgttctgccttgcatccgtgtgcgtcgcggtgccgcagcagatgaacgaggaaatgcgcgcgtacggcgcgaacctgatcgtcacgcccgcgtccgcaacgggcaaatcgcaaggcatcgataccgcaaccgtacgcaacgtgacggcgctcatcggcgccggacacagcgtgaaatcagccgcataccggtatgagagcgtgcgcatcaattccgcgccgtacaccatcgccggcgtggacgtgaaagccgtccgcgcgctcaatcgccattggaacgtgacgggcgactggcccggctcgggcaacgtgatggtcggccgcgacgttgccgacgcgctcggcgtgaaggtcggcagccgcgtcaccatcggctaccgcgccgccgacgcgtctgcttcagcgtcttcttccgcgtccgcaaaatccgattcggacgaatcaactgaaacggcagaatcgtccgcgcagggcacgcagagtacgcaaactacgcaaggcgaacagaccacgcaagccacggaaaacggccgcgtctcgtccgacatcatggataacaacggcaccgaattccgtatcgctggcatcgtcgataccggcggcaacgaggattccatcatctacgccactaccgcggacgtgtccaaacttgcgggccacgagcgcggcgccgacgtggtcgaatactcggtgaacgccatgggggatgagctgaacgccatcgtcaacagaatcaacaaaaatacaaacactgccgtcaaagcgcagaccgtcaccaaaatcacctcgtccgacacccgcatcatcgccatgctgcagaccctgttctggattgtctcgctcgtcgtgctcgtgctgacgctcgtcggagtgggcaccaccatcagctccatcgtgagccagcgtcgcaacgaaatcggcctgcgcaaagccctcggcgccgattcacgcgccatcggcgtcgaattctacgtggaatccggcatctacggcttgatcggcggtctgctcggcactgctatcggctatgtgctggcgcgtgtgctgtgcgccaccgtcttcggtcgcgcgatcggcttcgactggctgctcggcgccggatcgctgctgctgagcgtggcgatcgccgtcatcgcctccattccgccggtccgccgcgccacccgtatcgaccccaccatcgttttgagggaggaataatcatggacaacgaacatatgctgctggaactcgaccacatttccaagatttacggcgatctgcacgccgtcgacgacctgagtctgaccgttccgcaagggcaatggctggcgattgtcggctcgtccggttccggcaaaaccacgctgatgaacatgatcggctgcatggatacgccgtcgaagggttccgtcatgctcgaaggccgccggctggaggatctgaacgcccgccagctcgccgatgtgcgcaagaacatgatcggactcgtgttccagaagttttacctcgtgccgcatctgacggcggtggagaacgtgatggtggcgcaatactaccattccgtggtcgacgagaagcaggcgatggaagcgctggaacgagtggggttgaaggagcgtgcgcatcacctgcccggccagctgtccggcggtgagcagcagcgcgtgtgcatcgcccgcgcgctcatcaactgcccgaagctgattctcgccgacgagccgaccggcaatctcgatgagaggaatgagaagatcgtgctcgacctgttccgtcagctgcacgagcagggcactacgatcatcgtcgtgacgcacgatgcgctcgtcgcctcctgcgcgcaacgcgaaatcatgctcaaccacggcgtgctcgtcggcgaacagtggaacgacgaggatgcgaaacgcgcgtacgaagcggccggcggcaagcctgcgcacaccggttccgccgaggaaggcgcacagaacgggggtattgcgattttgttcgccgaccctacgaaggccgcaaaaaccggagatacggacgcggccaacgttgccgttgcggctggcgttgccgacgatacggacgtagagcccgacgtcatgaaaggggagcaggcatgagcaccgcacaatcgaacgcagtcaaagtcatcgcgctatccgcggcgagcatcgcgctgttgtcggcatgcggcgaaccgaaagccacgccgatggacgacgaatacgccggcaattccggcgaaagcgtgcaatcgcaggaaaataagtcgaaaaccgacggcaaggcggctgacaatacggccggcggcgacgccaccaccaaaaaccatgccgatgacgcgaattccacgacgtccagcaagcaggacaccggcaactacgcggatggcgactactcgatcaacggccagtacgggccggtcggcgaggacaccatcgacgtgcaactgaccgtcaaagaccagaacgtgacggccgtgaacatcgtcggccatccgttcacgtccatctccaaaaagcatcagaacgacttcgccaaagccgtgccggacgcggtggtcggcaagccgttgaaggaccttaaagtcgacaagctcgccggtgccagctggacctccgaagccttcaacaaggcgttggaagtggcgcgtcaggaagcgtcaatccaatagcccattccttctgaaaccgacacggcatgcccgtcttgcgtcggtgcggacggttttcctgtggttaccgtgcggattcggcgcatacgttcggccagagcaacgtggccatgttctcggcccaggaatcagacttgcgttccttgccggattgccgttcccctccggcttcctgccccgccaacgctttgcaagccagcatggaacccagcaccgtgctgaacaggaacgtgtagtccaaacggttttgaaacactccgtcggcgatgccacgttccatgaaccccacgaaccgttcttcggccggcgctagaacttgtgctgcgatcgccttcagcgtggcgttgtcggaagacagcaccacgcccacggctttcaatccgagttcgctgtcgaagcagttctggatgcgtcgcagcatggtggccagtccgctccgcgacggcttcaaatcgttgaaattcggtagtccggcaacttccggttggatgcgttgcaataaatcgtcggcgtttcggtagcgtcggtagattgtggtctttgctacccctgaacgtcgtgcgacctcttcgatggtcaccgctccgataccatcggaaatcactatccccaatgtggctttcatgattttgcggtcggtttgctcccgtaatcgctcacgtcggccacgtactgtgccgacgtcttcctgcgtggttttttgcaccgtcttccgcgtgccctcttgcgtggttccgcccatcatgccgcgatcactttcgtgctttccagcttgcttacgtaccaatggttgaacttgaccagtggaatgcgcagtagcagacctatcagcagcagcggcggaatgaacagcagtagcgcgccaatcgcaaaccagtaatcgttactgtagattccgccgatcgccgcgcgcattgctgtgattgaatgcgtcgcaggcaggaacgggctgatgccgctgatgattttcggcagcacggccagcggatatgcgccgttcgctccggagatctgcatgacgagaaacagcacgccgatggctttgccgacgttgccgaagctggccacgagcgtgtaggtgaagaacgagaacactaggctgctcacccagccggacagcatgaacagcagcggatgcaccgcctggacatggaggaacagcagactgcctcccaaggagaacgtgctctgcaatagtccgatcacgccgaacacaccgtaatgtccgagaaacagctgatgcggtttcgggtcgccgagttccttgcgcaccttacgcgagacggtggtcttgagcgtcactgccatgagcagcgaaccgacccacagtggcaggatcgtgtagaacggtgccatctgcgaaccgaaattcttgactgggaacaccgcgttgcgtttcacttttacaggggctgcaagcgcggcggccaacgagtcggtattatcgctgagcacatctttgacggcgctcatatcgccgctgttcagcgcatcggtcaatgttcctgtgaatgcgcccagttttttgcccgcgccggccagactatcggcggtggaatccaacacgctgctgatggcggtcagattcttatccgcggtcttggtggtgccgttcagattgcccagcgcgcctttcagatcggccgctgtggcattgagcgcggtggtggtgctggtaatggacgtggcgatatcgtcaagttgcggtttcagttggctctcatagtcggttttgatgccactgacggacgttgccgcctgctgcgccagtttcttgatctccgcacgttcggccgtggtatcgcttactttggcgtcgatgttgtcggcgctgccattcagcgccgatgctaggtcgttgagctgtgtgatggtggtgccgacgttggttttgagatggtcgatggcgttcctcaccgcttccggcagcttttcgtttgcgctgagcgcgtcgagcgaatcatagatctgctggtagctttgcgcctgcttgctgatgttcgtggcctggttgcgtaatgcgttggcggtgttgccggcctgcgtgcccgcattgccgaataggctgtccacatctgcttccatggctgtgaagctgttggcggaatcagtcagagccgtgcccagcgcggtggtgccggtcttcaacgcgcccgtcagatcctccacgccgctgccggcttgcttgagtgttgttcctgcgcttttcgcattgccgctgacattggcgatcagaccgtcggaggactcaagcagatgccgtgcgctttgtgtcagcgtgctgaacgtgcggagcgttccggaagcgtcggtgagcgtttccgcgaagtcgctgatattgccgttgaactgcgtgagttgttcctgcgcggctggcttgtcgagttggttggcgagttgcgatgccacactcagcgcggtgctggtcagtgtttcggagaacgtctcgttgacctgcgcgctgaccgtatcggcgccttggcctgtgatcttcggagccaaggcgttcttcttttcattgttgtagtaggcgatttcggcgtggtcgccatcggatgcgaagaacgtcatcatacgggtgctgaagttcttcggaatcaccacagctgcgtaatattcgccggatttggtgccgttgatggcttcttttttggtggtgaaggtccagtcgagctgatcgttggaacgcagcgtgttaaccacttggtcgccgatgttgatcttcactggaatgaggtcggaccggtatccgtcgtcctcattggctacggcgaatttcagattgccggtattggcgaacgggtcccagctggcggccacgttgaaccatgtgaagatgccggggatcacaacgagtccgatgacgatgatgatggagacgacgttgctggtgattcgccggatgtcgccgacgaacagtttccagatggttttcatgcgttgctcctttcctcggtgttttcggttgtctcggttgtctcggcggtctcggtagtctcggtggtgtccgtggcggcatcgttcgcggcggcgcttggaccggtcgtctgcattttctgcaccagtatggcgattccgtcatcttcattgtggttgacgcccgtcacgttttccgtcgtttctttgatgacgctggtattgcgattatcggatgtcgtgcgtttgccgctggtgcgtctccgcgttttgcgcagcagtctgttccgccgttcctgttgcgcccgctttttgcgacggatgcgtgccgcttggcgctccaccagcatggattggatcgattcatcgctcaaatggccgagctccacttgacggttcagattatcgcgcatgtattcgatgaccatgaggaagcccatgatgagcagaatccagacgacccacgtggccagtaccaccactttctctccgttggtgaacgagaacaccgccgccagagttaccggaactacgaatccgatcaccagagctccgcgcttgagtttcgggtacagttccgcgaaccgacttgcgcgttcctcgatcacctcgcggtaaccgcctttgtcggccagcacctgaatggcttgggacatgttgtatccgcgttccggaagctccacttcctcgccgataatcatgtcgctttccttgatttcgcgggcgaagagtcggttgaggttgaccaacagaggacggaccaccagaccgatgacgaacgccatggcggcaaacagcagcagcgtgccgatcgccttgatccaatggccgtcgtagaagccggcgatggtctcgcggaatgcgtctatcgaatagctgaatggcacgaacggatagaccatgcggaagaacttcggcatcatctcgatcggatacaggccggaagcgcctggaatctgcacgatcaccaacgccacgcacaggcccttgccgatgtgcatgaacgtggtggacagcgcgtacgtgatgctcagatataccagcgatgtgatcatgccggtcagtatgaacagtggcgcgcaagccgtctgtacgccgagtatcagatcgccaacggtgcagatcgcgccttgaatgacgcccatcgtgccgagcaacaggtatcgggccagatacttttcggttgcggtcggatcgagaccctcaagcccctcgtcgtccacctccactttgtagatcaccacaaaggcgaacgcgcccacccacagtgccagattggtcatcagcggagccatgccggagccgtaggagttgacgggatacacgttcttcgtgtcgattacggtcggggactccatgaacgaggcgatcttatccgcgtcaagcgaaccgctgccggtcaacgatgcgagcagatccgtagtgcccagcgccttcaggtcggtgctgacggtggtgagcttcgtctccatcttcgccagctgctggtcggtttgctcaaggccgatgcgggcgtctgacgccacttggtcgagttggtcgagcacgatgttggtttgcctgaccacgctgtcctggctggtcacggtgccggcaagtgttccggccgtcccagccagcgagcccagcgcggaattcagtcgcggcagtgcgcctgaattgatggcgttgcgcgccgtgcctgcgcttttgagcgagttctgcgtgcctatgttgaaatcggtggacagtttggatacgctgccggctgtgtcctgtgtgttctcgctcagggttttgaggtcggcgagtgttccggctgccgtgttgttggtattctccagtttgctgatgatttgctggtattgcgcgttgtcgctggcggatttgagcttctcgagcagtttcgcattgctgtcggtgatgttttgcatgccggtcaccgcctgctgcgccgatccacttgccgcggataccgccgacgagatctggttgatgctggctgtggattgcgccgtcgcttgggaaacaagtccggatccggtttccagcgcgctgttggcgttggacgaaagcgtgttgagctgggtttgcgctgtgccgatggcggtggatgcgcctgctagtcctctgcctgcgctcgccgcggccagctgcacgtcgttcagggcattgcgtgctgcttttgtctgctgtggcacattggctaactgggtgtcgaaatccgcgattgcggagcggatcgtgcctacgttccgcttggtgttgtcgagttcgccgatggtttcgttggcgatggcgttggtgttgccgctgatggtgccgttggccgagttgacggctttgacgagcacgtcgctgacggtggagacgaaggtgttgttgacggtgcggtcgaccacggtcgcgccttggtcggtgattttcggcgaaatcggactcgccttctcgttcacgtaatattcgagcgtggggcgatgcttgctgttggtgacgacgttggccagatcttcgctgaagtcggaagggatgacgattgcggcgtagcagtcgcccgactccaccgcttccatcgcattggctttgcccatgaactcccagccgagctggtcgttgctcttcagcgtgccttcgatttgatcgccgagattgactttgccaagcagcgcgttgtctgtgccttcgtccatgttggccacggccactttgatgctgtccgtgttgccatagggattccagaacccgtagatgttgaaccatgcgtatagcggggaatgagaatcaggccgatcataatcacccacgcggcgggtacggtgaccaatcgtttgaagtcacggcgcaggatctgcagtacgttgtgcattgtctctccggtttggcgaatcaattcccttatatggcgatacgtgttccgtagcgctacgcggttcgtatcgtataccgtgctcttggacaatcgccatcgcgtttcatggatgacggaaatcgggtcgagtactgcggcaaagcctcggcaaaaccatcgccggctgacgtagccccttccgctcacgtccgtgacaaatcgccatttctgtatgtccgtgagcgaaaggtggtaataaatcgctattttccgtccgtatttatacccccattcgctcacgatgcgctatacatcgccatttcttgcggacgtgagcgaaaggtggtgtgcgaatggcgattgcagccagctgacgtccccctcttttgctcgcgtccgccaataatcgcacctgaaccgcttttcttgcggcggatattgcctacgtttggtagcgtgggctgaaggaaggagcggcatatgagcgaaaccgcacaatctgaatcacgatccgaggattccgccgcgggcaagacggatggagaaatcaaggcgattgccgccgaaaccgaaatcgcggctatcgaagaaggcggaaagcagggcactggcgaagtcggcaatcccgctgaccgtcgtctgccgttaatcgttcgcatttacggcatcgtcatgcttattgaaggcgtggtgacgctgccgttcattgtgttggcgtgcctgtactcgattcgcgcggtgttttccggcaaagtggcgttcgatgcgctcagcctcaccgcgattctgtcggtggttcacgcggccgtgctgctggtcgtcaccgcgtgtctggcggtgttcggcgtgatgcttattatgaacaagcgtcggcatatcgcgcaatggacgtatctgatgattccgctcacccttgccgaaggcttgctgtcgctggcattgcagggacttggtgtgaatttgatcggcccggctatccagcttgtcgtgctcatagccctgcatgtcactgccgatccgtcgctgcgtgaggaacgtcgtctccagttcgcgttgcgacgtatggatgcccgtagcgcatacgaagacgccgcttcccagggtatggctggccgcgatttgaccggcaagggctatatttcgctggatttcttcaatttgttctggttgttcgccatcggttgtgtgttcggtttggtgatcgagaccatctaccatttcgtgctgttcggcgaataccaggatcgcgcaggcttcctgtgggggccgttctcgccgatttacggcttcggcgtggtgatcgtcaccgtgttgctcaaccatttgtggcagtcgaattggttgctgattttctgctcaagcgcggtgatcggtggcgcgttcgaatatttcaccagctggttcatgcaggccgcgttcggtattcgcgcatgggattacacggggcaatggctttcgattgacgggcgtacgtccggcaaatacatgttcttctggggtatcctcggcttgatttgggtcaagttgattctgccgcgattgttgcgattgatccagcgtattccgtggaagattcgctattcgttgacgctggtctgtttcatactcattttcgtcgatggcgtgatgacgctgatggcgcttgacgcttggtattcccgcatggctggggttgcgcagaattcgcccgtttcgcagttcttcgccacgtatttcaatgacgatttcatggcccaccgattccagaccatgaagatcgacccgtccactgccggtcgtatgtaggctggtttttgcgttttgcgggttttgctaagcggctggtcgggcgatgttccggctggccgctttgctttgggtggctgattttgaacgatttcggacgattgcagtggggttttgttgcgggttttgccgcgggggatttgattcttccggattattgccgtttgggattcgtgccttccggctgtctggatgcttgactgctgttgccgcgcctacgccgcgatgctttgcgccagctggcggatgaggtcggggcgatgtccgctccatgaggaattcggtgagatgacgaccggaatttgcttgaagccggcgtccttgatctgttcgaatgtggacggattctgcgtcaaatcgaccgccacgtaccgcactcccagtttggaaagctcttgttcggtggcctcgcattgaggattgttcggattggtgaagacggtcacggtcattacttttcctccctatgcaatcggcttcctttggtgcggaagatcttgtcggccacgtttttcgattttgcccggctgagcaggccgttcatcagtatacactacccgtagtggcgtttcgtgcgttcgcccactgtatatagtggggaatttcccgtaataccgaatctatgcgaacaaatgttcgatatattcgagtctatcattatcctcgattgcgccacgccggttgcatgcgtatggtccgtccgcgaatcgcccgcgggctgttcgctattcatttcggaacacatattgcgatttcgctcgttttcttacgattgtgagcgaaaggtggtgccgcatagtgcggtagggggtataaatcgccttattttccatacttttcggcgcacgtcgcgaaataatcgaccgaaattgcgattcgtgagcgaaagagggtgcgcgatatggtgcgttccgtattgaagtgctgagacctcatcccgaaacaaatgaaaaagtcctgagaaccatcggcttccaagacttcgaacctgtgccccccgtgggattcgaacccacaacccacgacttaaaaggacgctgctctaaccgttgagctagaggggcaacagcaacatagtatacagcatattcggaccaatcgccaccacgggcgtcggacgggcgtcgaaatggccttcggagtgttggtgtgcctacaatcgaaaccatgtcatgtaccacaattcttgtaggcaaaaaagcaagttacgacggttcgaccatcatcgcccgagatgacgactctggttcgggacgttacgatcccaagaaattcgtagtcgtcgcaccgcaggagcagccgcggcactaccgcagtgtgctgagccacgttgaaatcgaccttcccgacaatccatgccggtacagcatcgtaccgaacgtgcttccaaatcgtggaatccttgcggaagctggcgtcaacgaacgcaacgtggccatgagcgccaccgaaaccatcgccgtcaacgagcgcgtgctcggcgccgacccgctggtcgcactgcagccggccgacgaagccaatggtaagccggaaaccccaggcggcatcggcgaagaagacatcatcaccctcgtgctgccgtacgtcaacaccgcgcgcgaaggcgtgaaacgtctggccgaactgctcgaaacgtacggaacgtacgaatcgaacggcatcatcatttccgacgtggacgaaatctggtacgtcgaaaccatcggcggccaccactggatcgcccgccgcgtgccggacgacaaatgcgcgatcatccccaaccagcttggcatcgactatttcgattttgatgacgccttcagcgacgcacgtgaattcatgtgtagcgccgatctgcaggaattcatcgaaacgcactatcttgggcgcgcggcgggtacgcagggcggcatgaacggcggccactgcaacccgcgtatcgtattcggcaccgccaccgcgaaggaccacatctacaacacgccacgcgcctggtacatgtaccgctatctcgatccggccgacgcggaaaaccttacccctgaatcggacgatattccatggtgtctcgaaccggagaatgccgtgaccgtcgaggatgtcgacttcctgctcggttcgcacttcgaaggcaccccgtatgacccgtacggcacgcagggaactgaggaaagccgccatcgctaccgtccgatcggcatcaaccgcaccggacacatggtggccatgcagattcgcccgtacgcgcccgtcgaaagccgttcgatcatgtggatttcgtacggttccggcgcgttcaccacgtccgccccgttctatgcgaacgtcgacgacacccccgcctacctgcgcgacaccacgccggaagtctccacggactgcctgtattggacgaaccgcctgattgcaacgctcgccgacgcgcacttctacgagaccagcaacgcggtcgagggcttctcggaagatgtccgttccttcggccaccgtctggtggaacgtacggatgatgcgcttgcgactgccggcgcaacggacgccccgtccgtcaccgcccgtcttgcggcggccaatgacgagatggcggactacctgcggaagcgcaatacgaagctgctcggcgacgtgctatacacgtccagcaaccttatgcacaacagtttcgccatgtccgaccgctggaactgagcgtgattccgcgcgctgaagcgttcgataagcgttcaacacgcgttcggtaaacgttgaggggctatcgactcgtgccgatggcccctcaacgttatacgggaatcaaaacctgcgagaacttcgaaactcgcgcacgaagatcagttgaacccgaccacgtgctcggccaggaaataccccttgcggatcacgaatcggccggccgaaccgcgcaggttcaacgcacgcgacatcgccttcttacgcacgtccttgtaaatcgtcggcgaatatgcctcgatatccgcccacatggccttcttcttctcgtaattctccggctcgcgcgacaggatcatgaatacgctcgccacggagctttcaatcgcaagaaaatgaatcatatagcggtacagtccgtctggcaccgtaccacgttcggggtggcgtgcaccatgcattggttgacgagccgcagctggtccacgcgtcggatcatcacgtccgtctgcacgctctgcccgtcgcggccgatgaaatagtgatagaacggcgtgtccagatactgcagcgacttgacccacgggaacggctgatacgcgtagatgaagtccacgtagaacgtgtgctccggcagctgcatcttcgattcgcgtaccacggccgtgcggtagacaagcgcgtgcatgaggatgtattcggtcagtccgaaatgccctagatcgtcccaggtgagccgtttgccgggctccatagcgtgacggaagttcaccacgtgcttgttgcgcttgcccaccttgtcgtacacgtagttggtgacgagcatgtcgagcgggtcgtccttgccgacctcgtcgcgcagcacggccagaacctgttccagcgattcgggaccgacccaatcgtccgcgtccacgaccttcacgtacatgccgctcgccgccgcaatgccggtgttgaccgcgccgccgtggcctttgttctcttgatggatcgcgcggacgatccccggattgcgcgcctcgaacgtcttcgccatctccagcgtgccgtcggacgagccgtcatccacgatcagcacttcgatgtcgtcgttgcgcttcgacgcgatcaacgattcgacgcaccgttccaggtattccgtcatgttgtacgcgggcaccacgaaggtgagcgtcttcttctcctgcatattcttcctcggatcgggctcgtgtcgggccgtgcggctggccgaccgctccggccaaaagcataacgaaactaacgtagcaccatgtgcggttccggggcacggttttgcacacaaacggcaccctgaaatacgcaatctgcacctgaaatttcccctagggtcatttcgggtgacggtatgtcagttttcgtcaattgttgattgtttttgcgattcgtgcgggctttgcgggttttgcgattcgttcgtctcgtctgattcgtttgattcgtctgccgcttgcgatttgcctactgcttgcgatccgtccgtcacggttgtcccgtccgtcgcgtcatctcccgcagcaaccgccttctcctgcgatttcgcggccttcttgccctgcttctcctgcttggcgatcgccttcgcttcccgcgcggcctgcttttccgcctcgcgggcggccttttcgctttcgtagcgcagttccggcttggcttccatgcggctcagcccataccatgccaggttcacgatatgcgcggcgagctgctccttgctgagcttgcgttggtcggcccagtattggcaggtgtacacggtcatgccgatgagcatctgcgcgtaatacggcacgcttttggccggcagatgctggcgtttgaacgcgtcggtgagaatgtcctcgacgcgtacggcaatgtctccaagcagcgaattgaacgagttggacgggtcggttttcggcgaatcgcgcgtgagcacgcggaagccttcggcgttttcctccacgtaggtgagcagcgcaagcgcggtgcgttccacgatttggcgcggatgcgcctgcgggtcggacagcgcgttgatgagaacgtcggtgagcgcgcgcatttcgcggtccaccaccacggcgtacaggccttcctttcctccgaaatgttcgtagacgatgggtttcgacacttttgcggtcgaggcgatctcttccacgctcactgcttcgaatcccttcgacgcgaacagcgaacgaccaatttcgatgagctgctcgcgccgctgatacgacgtcattctggatgtgttagccatgctgtccagtttttcacgtcccgtggatagctccttgaccgtccgacccccacgtatcgtccgattctggtgaatcggacacgtgtgtcatattgacaatgcttcattgcagctttaatatatttaataaataataaattttattaaagggggtgatgtggaccgtctaccagaatggttggccaaccttgcggaggaggatttggccttcatcaagaacttcgtgctatcgtcaggatctctgaagcaaatgtcccagctgtatcaagtctcctacccgaccatgaggctccggcttgacaggcttatcgaaaaaatacggttgaacgacaacgagacggaggatccattcatcctcttggtgaagagtctcgccatcgacgatagatacgacgtcgacacggctcgaatactcatagacgagtacagaaagagaagggatgaatcatgagctggacatggatcgcattgttgattgagatcctaggcgtaatcgccgtattcgttctggtcttcctcatcgcgaggagcctgattcgctacgcaaattccctaaagaaaggaggcagtccttcaaagcaggcagcggaagacaaaaaaatcactcttcatgatttataaaaacgttaccagatatatcgaagtcaaaaatcgcattatcgatgccctgcatggcagagcaccttattcccctggcggatcggacattcgtggtgcgtccgcagggcggagccggagtgtccgttgcgctttttaggctggagccatggatacgaatgtgattattgcgattgtcgctgttgtcgttattgcggcaattctggtgatcggcggatggtgtctcggtaagacccgcaagaacgccgtcaacaagtccactgaggatgcgaaagcggctgctgatgcccgtcttgctgcggaagcaaagtcggctgcggctgatccttccacggtgaagccgtccgtcgattccaatgttgatgcagctgaaaaagctccggctgaaagtcagcagaagtcctcagctcaagcttcctcttccgaaacggcggctcctgcaccagccaccgaagccaagcccgaaccggttcatgaaacccccgaatccgccggcacgcgcatgcagcgtcttaaggcgcgcctgtcgaaatccggcaatccgttcggcaaggccctgttcaacatcctcgccaaggatcagctctccgaagctgactgggaggacgtcgaagacacccttctgcttgccgacgtgggcgcggaagccagcgaacagctcgtcgaggaactacgcaacgacgcccgaatcgcaggccagtccgacccggccgaagtgcgtgccgcgctgaaagacaagctgctgaagctcgtaggcactgacacggatcgccgcctcaatgccaataaggaaggcgcgaacaaaccgagcgtcatcatcatggtcggcgtgaacggcacgggcaagaccaccactgcgggcaagctttcccgcctgcttgtttccgaaggcaagcaggtcatgttgggagctgccgataccttccgcgctgcggccgccgaccagttggagacttggggtgcgaaggtgggcgttccggtcgtgcgttccgacaaggacggcgccgatcctgcgtccgtcgcattcgaggccagtgccaaggccaaggaagagaacgccgacgtgctcatcatcgacaccgccggccgcctgcagaacaaggcgaacctcatggacgagctcggcaagatccgccgcgttaccgaaaagaatcttccggtcgacgaggtgctgctcgtgctcgacgccaccaccggccagaatggcatgacgcaggccaaggtgttcgccgaagccatcggcattaccggtgtggtgctctccaagcttgacggttccgcaaagggcggcatcgtgatttccgtgcagaaggagcttggcgtgcccgtcaagctcgtcggcctcggcgaaggcccggacgatcttgccccgttcgatccggaaggcttcgtcgacggcatcctcgcctgacgttcccatattttccggatttgcgatttccgtagcgaaaacctcccgtcacgttccgtacgtggcgggaggttttcgtattgcgattactgctcagcgccagccgtaccggcagccgcagcccccactcccggcaccttccggatcgtcagcttcagcagcagcggcgcgaccagcgtcaccagcgaaatgatgaagatgatcgtcgaatagtattcgctgccgagcacatgctcgttgaagccgatttgcgcggtaatcaacgccatctcgccacgcggtaccatgcccgcgccgatcatcagcgccgaagcgccgccaaaaccggccatgcggccacccaaaccgcagccgacgaccttcgtgatcacgccgagaaccgtcatgatcgcaatgaacacaatcatcttcgtatcatccacgcctgtggtctgcaggccgatgcccacgaagaacaccggcacgaacaacgtgtctccaaccggctcgatataccggtccgcgtcctccgcgtaatcgctgttgcttaccgcgatgccggcgaaaaacgcgcccaccgcgtagctcaacccggccagattcgacgcccacgccatcgccaggcagatgatcacggccatcaccgcgatgccggacggcgccttcagcacgccagccagcgtcatcagcgccggcgccacccaaaccaccaccacggcggccgccacaaagaacagcacctgcttgagcagaatcaaacccagccctgccacgtccacgctgccggtgttgacgagcgtgcacatcacggacagcaggatcacgccgatcacatcgtcagccacggccgcgccgagaatcgacacgccttccttcgaatcaagcagtccggcttccttcagcaccgccacggaaatcgacacggacgtggcggagaacaccacgccgatgaacgcagccggaatcggcttgaagccaaacagcaggctcactccacccatcaccgccacggggaacaccacgcccatgcacgcgatgatgaccgccgccttcgaatatttcttcagcaactgcaggtcgcagccgacaccgcccaaaaacatgaggatgatgatgccgaggtcgctgaacaatgacagcgaatcgctcatgtgcatcacgcccagcagcgaagggcccacgagaatgccgacgaggatctgcccgatcacttccggcagctgcgctttgcggcagatcagcccggaaaccgtggtcagcatcaaaatggcgcacagtgaaatgatgaacgttgccatggtcctcgccgctctctcgttacgcgcgccatacgttcgccgcaccgcgcgttcggtgtacatgccacgcgctcgccgtacgcggcgttctcccgtcgcgtgccacgcgtgttccgtaagtttcagctacctaacttactccgtccgcagcgttgcccgccgcttccgtccaccgtcgcaatttcatattgcgattgccgggcgattatgccttccgtatttccgtaccgccagtttcgttggaattccgccatttttcggcgtaggttgacgttccgtgcggatggcgttacgttggcgtaacacgtcgtaacgttttcaaaacgcggccggcgttccatatcgttctgtcagccccacacgatggggacggaaatgttgaaccaaatatagagaaagaaagaggagggtgacatgggccagcttgattctggaaatgccgcgtggatattgacttccgcgtcccttgtgttcctcatgacgcctggtgtggcgttcttctatggtggcatggtccgcgccaaggccgtgctgaatatgatgatcatggaggcggccgcactgtccgtcacgatgatcatgtgggtgctgtggggttggtcgatcgcctacgccggcacctcggtcggcggcatcttcggcgacccggcaaccggcttcctgctgaaggacaccatggtttccgataagggcgtcttcacatcggccgcactgaacggcaacaactacccggtcagcgtcgacgtggccttccagtccgcgttcgccatgatcaccgtcgcgttgatctgcggcgccatcgccgaacgtgtgaagtactccacgtggatgattttcgtggcgctgtggatcacgttcgattacgctccgctcgctcacatggtgtggaacggcggcctgctgtccgctgacggcgccatttcccaggcgatcggcgcagccgcccacgatttcgcaggtggtacggtcgtccacatcaatgccgcagtcgccgctctggtcatcgtgctgatcatcggcaagcgtaagggcttcggcacgcagccgttccgcccgcacaatgttccgttcgtcatgctcggcgccttcctgctgtggttcggctggtttggcttcaacgccggttccgccttcgcagccaacggcaccgccggctacgcgtgggtttccacgtccgctgcaaccgctgcggcaatgctctcctggggcttcactgagaagatccgcaccggccactacaccgcaatgggtgccgcttccggcatcgtcgcgggcctcgtcgccatcaccccggccgccgatgtggtctccccgctgtgggccatcgtcctcggcgccatcgccggtgtgctcacctgcctggcctgcggtctgaagttcaagctcggctatgacgattccctcgacgtcgtcggcgtccacggcgttggcggcttcaccggcaccgtgctcatcggcttcttcggcgaaggcaccggcctgttcgcaggcggcgactggaggcagctggtcgtccagatcatcgtcgctctcgtggccatcgtctggtccgccgtcatcaccggcatcatcgccttcgctctggagaagacgatcggctggcgcgtcaccgaagcccaggaagtcggcggcatcgatcttgccgaccagggcgaacgtgcttacgattttgctggtaccgccagctccgtcctcaaggaggtgaagtgagatgaagctcattaccgctatcatccagccccataaactcgacgatgtcaaggaagccctcgcagccgcgggcgtgcacggcctgaccgtgtccgaggcaaacggttatggccgtcagcgcggccacaccgaggtctaccgtggcgctgaatacaccgtggatctcattccgaagatccgcatcgaggtgctgtccgacgacgccgatgccgaaaccctggttggcgtgatcgtcaagtccgccggctccggcaccatcggcgacggtaaggtctgggtggctccgcttgactcggtgacccgcgtgcgcaccggcgaaaccggttccgccgccatctgatccgtccggccttgtgatcgggccgattcggacaagatgaaataaagacccccgggcttgaagttcgggttatcaattacgacacatccccgtacgtgcctcgcgccgtgcggggattgtcataagtcgtcataggtttcataaggaacgtgcgttatgacttcagcagtcgatggtttcaaacaacggttcatggccatgagccagcccgacgccgacggcgtctaccgcaatggcgcggcgaaacgcaaagcccgcacggaattggccatgggcaatctcacacagttgtggaacgaagcctgcgaggcggtttccttcgatgttccggcaaccggcatcggtctcggcgcggtcggttcgctggcacgtggacaggtgggccccagctccgaccttgatctggcggtcatctacgagccgcacgcgctgaccgaccagcagctcaacgagctcgccaacaaactgtggtatccgatttgggattccggcctcgacctcgaccagtcggtacgtaccgtcgcgcaatgcgaggccgtcaccgaccgcgacctgcccgcagctatgggatggttggacgtggtgccgatcgcgggggacactggacttatcgaaagcacagccgtatccatattggaacgatggcgcaaggccgcgcgcaaacgtctgccggaactgctcggctccgccaaatcgcgcctcgacgaattcggccgcatggcctacatcaaccagccggacatcaaggaggcacgtggtggcctgcgcgactccgtattggtgtccgcgctcgccgcatcctggcttgccgaccgtccgcacggcacgtatgacgacgccgtcgaacggttgctggacgtgcgcgactgcatccatctggtcgccggcaaagatacgaacatgctgctatcgccctaccaagccaaagtcgcggcgatgctcggtctggccgatccgacgctgcccgatggcgaacgtgaggcgaagtcgatcgacgatctgcaaacgttgctggcacgcgtcggccggcagatcgcgttctcccttgattccaccgcgtcgcgcgccgagcattcgctgacgcacgacaagccgcgattcgccttcttccaagtgttccagccgcgcggtggcggcaaacgtcaggcaccgaccttcgatgtgattgcccccggcgtggccaagcatgaagaggaaatagtgctcgctccgggcgcggaaccggccgccgacccgaacctcgtgctgcgcgtggccgtcgcggccgcggaattcggcctgccgatcgccccgggaacgttgcggaatctcaaaaagtgccctatcggcgaccggaactggacggacgaatcgcgtgaactgttcatacgattgctggcttccggccccgcgctgctcaacgtgtgggaagacatcgatttcatcgacgtgcccggcaagctcatccccgaatggttgggcgtgcgcaaccggccaagcgcgtccgccgcgcaccgctatacgatcgaccggcacatggtggaggtcgtcacgcggctcggccgtgaaacacccagcggtgggcggtacgacgaccggcattacgaggcgctgctgctcgccggcatcctgcatgacatcggcaaacgaccgggggtggccaaccatgcggcggaaggcgctcggcatgcgaccgtggtcgtggaacgcatgggattcgaccgcgacatcgtccgctgggtcacgctgctggtacgcgagcatctgacattgtcggagttcgccacaggccgcaatcccaatgatcccaacgtcggcgatgatctggccggccggctcgaccataatcccgtgctgctcgacatgctgttcgacctgacccgcgccgacggctcctcgttgggggccacgtccggcgagaccatctccaaacagtacgggtggagcaaatggcgtgaaacgttggtgcgcaccatgtacaacgccacccgataccacatgtgagcgggtttctcgcatgcgccaagccgatatgcccccgtatttctcgtcgtttacggaaaagcggggtgcatatcaccttccgttcacttcggcaaatcgaaataagggaatcggggtacatgctttaggatgtccccaagttgtccactcagttatccccactctgtggataagtcgaaacgttttccacatggttatccccaatatgtggataactcggcttttttcgactttcttatccacaccaaagccattcgcgcgtgtcgttcggtggatgcggagattcatccataatctcaatgcaacaccggtcgtgacggcacgcacgtattatggttttcctcggtattgaacacattcgattgactgctgcggttggagggacatggcggagaacgactcttggaacaacggttcggcgcagaaccgcggattttcgaacgctggaaacggtgcgaacggcatgaacggccgatccggccaagccgtgcgcgacgccctgttcgaccgcgtgccgccgcatgacgacgccgccgaaatggcggtgttgggcggcatgctgatgagcaaggacgccatcggcgaagtatcgcagatgattgacgtgtccgacttctaccagccacgcaaccaaaccgtgtacgaagcggtcatcaaactgttctcggcctcccagccggtcgacgccgtgctggtggccaacgagctgctcgccgaaggcaatctggaaaaagtgggtggctccgactatctgcacagcctggtcgcatcggttccgaccgccgcaaacgccacgtattacgccgacatcgtgcatcagcgcgccatcctgcgtaatgtgatcgcggccggcaccaaaatcgcacagctcggctacaccgcagaaggctcgcaggccgaagacgtcgtcaacctggcgcaggccgaagtatatgagatgtccaccggcaaagtgcggcaggactacgcgccgatcggtaccgtcatcgccgatacgcttgaccagctcgaccgtctgcaaagcggcgaagtgtcccgaggcgtgccgacgggcttccgcgacatcgacgacgtgacgcagggcctgcagcccggccagatgatcgtcgtggcaggccgaccggccatgggcaagtccacactcggtgtggacttcgcccgttccgcggcactgcatcacggattgacgaccatcatcttcagcttggaaatgagcaaaaacgagttggcgcaacgtatcatctccgctgaatccaacattccgctcgccgccatgcgccgcgcggacgacatcacgccggaacgttgggccatcctgaacgagttgcagggcaagctgcagaacgcgcccctgttcatcgacgacagcccgaacatgagcctgatggaaatccgcgcgaaatgccgccgactgaagcagacgaacgatttgaaactcgtcgtcatcgactacctgcagctcatgacctccggcaaggccgtggaaagccgccagcaggaagtgtccgacttctcccgtgcgctgaagctgctcgccaaggagctggaagtgccggtggtggcactgagccagctgaaccgtggccccgaaatgcgtcaggacaagaagccgcagctgtccgacctgcgtgaatccggctctatcgaacaggacgccgacgtggtgttcctcgtgcaccgtccggacgcctacgacaaggaggaccgcccgggcgaggccgacatcatcatggcgaagcatcgtaacggtccgaccgacacgttcaatcttgcgttccttggcgcgtattcgaagttcaaggacatgccccaggattaccagtcccagcaggaggcggtgtgatatggcttggaattccttcgcgaccccgttgatcggcaaggccgtgcgcgcggcctcccgtttggcgcacggcggtggcagcgcgttccccggcaaaatcgtggaacgcatcgacccgcaattcctgtcgcgcacattggcgcaactgccgctcggcgtggtgctcgtctccggcacgaacggcaaaaccaccaccacacgcatggtggccagcatgctgcaatcgctcggattgaaggtgttcaccaacccgaccggctcgaacttcacccgtggcgtggtttcgtcgctgcttgcggaagtctcgctttccggcaaactcgacgccgacatcgcggtgctggaactcgacgaggcgtacgccgtgcatttcgtcaagcaggtgccgcccgactactgcctgctgctcaacgtgatgcgcgaccagcttgaccgtttcggcgagatcgacaacaccgcgcgactgctgtccaaagctgcggaagccaccaccggtaccgtcgtgctcaaccgtgaggacccgcgcatcgcccgtcttgctgacgtggcgcatacggaagacggcgtggaagtacgctacttcggccttgacgaatcgttgcgcggcttcttcccgtcggatgacgacatgagcaccactgttgacgcggaagcgcacgacagtgcggaacatggcggaaatattggcgattcgggcaatgccggcgatactgccgatgccgttgcggctgccgcgccggccacatcgcaaccgcaggacggtcccgacgcgctgcccgccgacgtgacgttgcgcgccgtgggcgaccaccgcgccaccttcgcgatcgacggcgaaacgtatgagacggccgtgaaactggaaggcgtatacaacctgtacaacgcggccgccgcgctcgccgtggtgcgcgccgtcgcagcggacgcgcaggcgatgttcctgccgttcgaagacgcgctcgccgacagtgtcgacgcggacggtcccgatgccggtaccgaaacggacggcaacggctcgcatgacgccatcgaccaggccgctgcggacgagattctgcgcgcggcaggcgtctcaccccgtatgatcgccttcgcgcacgccaccacgcaggccatgatcgacaccgccggcgaggtcacaccggcattcggccgaggcgaggtcatcaccgtgaacgacacccccgtggaactgctgctcgtcaaaaaccccatgggcttccgcctgtcgctggcctcgttcaagcccgaaggctgcgacaccatgatctgcatcaacgacgaatacgccgacggccgcgacatgagctggctgtgggacgtggacttcacctcgctgcgcggcaccggcgtcaaagccgtgtccggcgtacgcgcgtgggacatggccctgcgcctcgaatacgatcaggtgccggtcgaatcggtcagcaccgacctggaggaatcggtcgtgaacttcgtgaacgcgaattctggcacccccaaacacatctactgcacgtacacggccatgctgaaaacgcgtgccgcgctcgccaaaatcgccgacgtggccgacgccggcgtgggcaagtgagcgccgcgcgaaacgaaaccgcgcaatcgcaaagcaaaacagcggaaggaagacgaggagacgatatgagccaggtcatcgacatcgtgtcgctgtatccgaaggatatgaacatctacggcgattccggcaacgtgctcaccatccagcgccggctcgcgctgtacggctacgagccgcgcgtacacgcctacaaccagggctgcgactggcccgagcacgtggacatgattctgggtggcggcggccaggacaccggccagaagaagatcatcgacgacttcttccaacgcgccgacctgctgcgttcgctcgcggcggacggcgtgccgatgctgatgatctgcggcctgtaccagctgttcggcgagtatttcgaaacggtcgacggctcccgactcgacggcatcggcgtgatcggcgcgtacacggtcggccaggaaacacgcatgatcggcaatcttacggaaacctccgccgatttcggcaagatcatcggctacgaaaaccattccggacagacgttcctgcgtgacggcgtgcagccgctcggcaccgtcgaacaggacggcaccggcaacaacggcgaggaccatacggaaggcgcgcgcgtccacaacgtgatcggcacgtacatgcacggctcgctgctgccgaagaatcccgcgatcgccgatttcctgatccgcaccgccgtcgaacgccgttacggcacgttcgatccggccgccgccggacagacggacgcgcaacgggccgccctgcatcgcatcgacgaaatcgccgaccgtgctcgtcgcgtggccatgtcccgtccgcgctgacggctgccatgccggttcgccggcaatcgcaccgcctgcgctgaacgccggatatccgccactttttatgcgattgaccggtttcgctcggcgcagatgtgaagaaaatgcgatagagtggtaccaccatcacctaaaggaggacatcatggctgattttaattttggtgacggcctgcgcaaggtctttctcgccggcgtcggtgccttggcgaccactgttgagaagagccaggaaatcgttgacgatctcgtcaagaagggcgagctgaccgtcgagcagggcaaggtcctcaacgccgaactcaagcacaaggtcgaagaggctaaggaagcccctgaggccaaggatgcagccccggccgaaaccgaagacaaggccgagtagctccagtctttcgtatcgccgtctgccgcgcatgtgagcgcccggacggcgatttgctatgcccgcgcgacgccggcgaaacgttcgtctggcatcgcgggctttccagccgatttcccaactgtttgcgagcagtgacatgtctttgaaacacccatccgacaagccggacgcggcacgccccgaaagcgtggagcccgtcacgctgtccgacagggtcaacgcggtcatcgaccccacggccgacccttcgccggacgccgcctcccaagcaaacggactgacggatgagcttgcccacgaatccgcggacgatgccggcgaaacggacgataccggcaaagcggccggtgccaacgcgcaatcgtccgaaaccatcggcatcttcggagcgcgcaaagacacgttctccgcgcgctaccatctgacccgccgcggcaaactccggcgtcttgcgcaaatcgcgcagatcgccaacaaattcgacgtggttcacggactcacgcccgtcaaaatgcgtctcatgctcgaagcgctcggccccacgttcgtcaaggtcggacagatcctgtccatgcgctccgaaatcctgccgcaatcgttctgcgacgaactgtccaaactgcgcgccggcgccgaccccatgccatacagcacggtgctgcaggtgcttgaggacgaatacggccggcccgtggacgagatcttcgaccatatcgaccccaccccgctcggctcggccagccttgcgcaggtgcatcgtgcgaaactgctcaccggcgaggacgtggccatcaaagtgcaacgtccgggcgtgcgcgaaaccatggcgcaggacgtgtccatcatgcgcaccatcgcgggaatcgccaccaaaaccatgcgcagcgcgcaggtggtggacctgtccggcgtggtcgaggaactgtgggacaccttcgaatcggaaaccgacttcctcatcgaaacgcgcaatctggcggaattcaaacgattctgcgaacgctacaaatacatggactgcccgaagccgtacccggaactatgcaccgaacacgtggtggtcatggactacgtggaaggcatctccgtctcccatccggacgagctgcttgcagccggctacgacctgaaggaaatcggcaccaaactcgtggacaactacgccacgcaggtactcgacgaaggcttcttccacgcggacccgcaccccggcaacatcatggtgcgcggtgggcagatcgtgctgctcgacctgggcatgactggccggctcaacgccaaaacccgttccgtgctgaaggacatgatcttcgccgtggccgagcaggattcccccaagcttgccgacggtctgctgcgtttcgccggagctgaggccgatccggaggattatccggcattgctggccgatctggacgtgatcgtcaaggaattcggcacagtggacctggccgaactggacatcgccgccatgctgacggccctgacgcagatggcgcaacgccacggcatcgaagtgccgagcaccgtcaccacggtcggccgcgcgctggtcacgttggagggattgcttgacgaattcattcccgacgtgaacatgatccagatcatctccgaccacatcgcgtcgagcacgtcgaagaaggatttcgccaaggacgagacgaaatcgctggctctcgaaagccatcaggcgctgcacagtctgcttgccgccgccaacgagctgaaagtggcgtcccgcatgctcacgcgcggccagctgcgcgtcaatatggagatggtcggttcgcaggagccgatccacctgctcgccaacatggtgaacaggcttacgatggcgcttatcgtggtcggcctgttcatcggctcgtcgattgtgtattacgcgggcatcaagccggtgattttcggcattccgattgtcggtttcctcggctatgtgatcgcgttcatcctgtccgtctggattgtgttcgacatctacttcaagggacgcgattcgaagaagcggtagccgggcgtcttgcgttgcgggtggcttgtgttgcggcgcgctcgcattcgtgttggtgattgcgttcatatctgcgtttgcgattgcatttgcgttcccggattattcgataggacacggctttttgctgaataatcagacaggttgtcaatgatttcactccccctaatatggacccattgacggggtactgttttggtggcataatgctcaatgtcgacgatgacatcaccacccggttcccatggaggagaggacatgcaggccgggaaatcccagcgaagcgtgctcgcgctcgtgatcacctgtgccctgattcttggatttggtatcccccttattccccttgtcggagtggattccgccgaagggacggaggtttccgccgcttccgacgttgccaccgtctccgccgaaaacagcctgcagaacggcagtttcgaacagccggacgcgtaccagtaccgtgaaaccagcgatgttccgtattggaaatccaccacgacttcaggcaacatcgaaatcggcagtgtcttcaaaaacggcaacggagacaatgactccctgcacatgcgcaccggcgagaaagtggccgcggccgaaggcagccaattcggcaagccggccacgtcgaacggcaacgaccagtacgccgaactgaactccaaccaggcgagctcgctgtaccaggtggtcaacaccgtgcctgaatcgaaatacgattggggcctgtaccaccgcggcaggcagggcaaggacgccatggcgctggtggtcggcccgaaacagaacgtggcccccatgaagacgtccgccaccagcaacgaccagctgccagtccaaaaccgtgaacgagaccaaggattggcaatacgacgtgaccatccaggacacccgcacctccgccctgccgaccaccggtagcgttggcacggtgctgttcgccgtgctcggcatcgcgctgatggccggagcggtgtggctgtacgcccgtagcaagcgccagtccgccaagtaaacggctgataacggagaatcgcaaggaagggtccacggtatgaatcgcaagacggtgcaaagcatcgccatcatcgcgatcttcataacgggggcccttctgctgttctatccgcttgtcggcaactggtggaacgaacgccgctacgacatgctcgtatccggctacacacaacgtgtgcaggtcaatccgtccggcgaggactacgcagaattcaaacggatcgacgcgtacaacgccactgtgcccggcaaaggcgttcccgacgcgttcgccgtcaccacgcccgaagaggacgccgaatacgccagcttcctcaacgaggaccccaacggcgtgatggcatacatcaacatcccccgactcaaatccaccttgccgatctgccactacaccacaccggaatcgctgcagaaaggcgtcggccatctacgtggctccgccctgcccgtcggcggcaaaaacacgcacgccgtgctctccgcacaccgcggcctgccgacctcacgcctgttcaccgaccttgacaaggtgaggaaaggcgaccacttctacatcaccgtgctcaaccgcacgctcgcctacgaggtcgatcgaatcagcgtggtcaaacccgaccaaacgaaggaactcagcgtccagcccggcaagaacctcgtcacgctcgtcacctgcacgccgtacggcgtgaacacgcaacggctgctggtgcgcggccatcgcgtgccatacaacgcggcgcaagccaaacacgaggctgcggattccgcggtctcgtcattcaccgtctacggtttcgtcgcaacctacggcacgctcgccatcgcgcttgccggcatcgccgtgctccgccgcaacgcagcggcccgcacctcgcatcacgccgccgattggccgcatagcctcaccgtctcagtccgctaataaaaggcgattagccagtcttaccggctcggtaatcgcccttccgtattttgtcccgcgaaagtccgttcctggtaacaaaatgcgaaagggaaacgatcggcgatacccccttttgctcacgacttacgattttgcgtatctttggcgggatgtgcgtcaaaaaagacggaaaaacaggcgatttataccccctaccatgctttgccgcaccctctttcgctcacgactgtgccaaaccggcctaaatcgcaagtcgtgagcaacagggcgcaacctgccaggccccaccaccgactcggcaatcgcccttccatattttgtcccgcgaaagcctttcgaggccgacgtgggtgccgttagagcgtgggaatcgccatatgcaacgacgaaactgaataatcggtgaaatcgtgagcgaaaaccggcaaactgggctacgctcgtaacaagtggctcattgcgcgcgcaaatgcggtgagcagggtcaatcgcaagggaggatgcccatgtcaaagtcgtttctcaagaaagcgctgctcggtggtgcggtggcggcgggagccgcggtgtgggcgatcgccccgcgttccttctccgacaagcggcgcaactatgtgccggccgttccggatgtgtggtacgcgcaccgcggtctgcatgacgccggttccggcctgaccgcgcaatacgccaacgaaagcggcgaatacgtggcgctcgcccgccgcatggccatgaaagccgggtacggcagccctgatacacccggcgtgattgcccctgaaaactcgcttgccgcgttcgcagccgcctgtgaagccgggtacggtatcgaactggacctgcagatgacgcgcgatggcgaggtcgtggtggtgcatgacggcgacctgatgcgtgttgccggagatccgcgccgtatcgccgatctcacgtatgacgagctgactcgtattccgctgttcccgaccgacgctccgggcgcatgcaaggccgcgccgctgccgttggcattggaggaaccgccgctggtcaccacgccggacaacgcgccggaaggctactatcagcatgtgccgctattcgccgacgtgctcaaagtggtggctggtcgtgtgccgctgattgtggaatataagttcgatgacaactccaagtgggatccgcgcgacgtggagcttatggagaagggcgacgcgttgctgcaggcatactccggcaagtacgtaatcgaatcgttcaacccggccgccgtgaactggtacaaggaaaaccgtccggaagtgtgccgcggccagctgtcttggtggccgtacggcgaggacaagcccaccgatccggtggcgctcggcaaggaatacgcggccggcgcgctgttgtccgactggatttcccgtcctgatttcgtcgcctacgattggaagggcggcaacagcccgcaggtgaagctggcccgattcatgggtgcggtgccggtgtcgtggaccgtgcgcagccgcgacgaatacgcgcagtgctgcgaccagttcgaccgccacatcttcgaagcgttcgtgcccgacgaacagtagccgactgatagttgcccggcgagcgacagcagccgggcgctagtcgacggactatgatcgacaggcgacagccggttttatatggtttcggcctgccatcgcatgattggtgcggtagcaggccgaatttttattcgattgatttattccgattggcagctcagtcgatcacgccgtacagacggtcgccggcgtcacccaagcccggcacgatgtagcacttgtcgttgagcttctcatcgacggcgcacagcaccagcttgaacttgatggacgggtcgaggttttcctcaacgaacttcagaccttccggagcgcccagaatgcacactgcggtgatgtccttcgcaccgcgctcggccagatagtgggtggccgcaacgagcgtgccgccggtggcgagcatcgggtcgatcaggaagcactgacggccggtgagatcctccggcagacggttcgcgtacgtgatctgctgggtcgggttctcctcgtcgcgcttcatgccgaggaaaccgacttcagcggacggaatcatcttggtcatgccgtcgagcatgcccagacctgcgcgcagcaccggcacgataatcggagccggggcggcgatgtgcttgccgatcatcggagccaccggggtttcgatgggcttgtccacgacttcgatgtcgcgggtggcttcgtaggcctcgagcatcacgagttcggaaacgagctcgcggaacgtggaggacggagtgttcttgtcgcgaagaacggtgagcttgtggtccaccagcgggtggttcaaaacatgaatatccatggtttctaagcgtagtccatgtatcggctgttcggcaacgcgccggtaggtcggtcaaatgaaacccagatgagcgccgatcggatggcaatcgaaaatcgcaagaaagccagagaaaaatcaggaaaacatcaaaagaggagaaaagcgccgaaccacgaaagcgcctgtcggcgcaaaggccgctcgcagcggcaaaaaatggagcccggggctatgcatggcccggcgcgaattcctattgtacagtcgcgctcgacgcttcgcagcgccgtgtcgcgtggggtatgaaacgggggaaaattacggaaagcggcggtggaaagcagtagtggaaaacgacagtggaacggcctattccaatcgtccgcgccgccacagattcgccccgtggcggaaatccttggccgtggcgaacaggttgccggctgtgtgcatcagtttcgcagccttcgcgcgcgcccgcttctcaacggccgacgggcggctgccggccgcagcagacgtagcggaaccgtcggaaacatcagatgatccagcctcgctggaaccgctcagcgaagccagtttgcgcgcttcgatacgcaatcccaacgcaaccacgtcggtgaaggcggcggcccgctcaagtgccacggcgaaatcgcctgtaaacgcgccggccaaaatcgaatcggcggtacgtgcgatgtcgttttccgtcggtgcttggtccacgccggcaatcgcggaagcggtggtggcgacgggctcgccgacgcgccacagtcgcgcgatcgattcgcggttcttccgcatccacgtacgcagcagatacagtcgccacagaatgcccggcagcgagtcggggtcggcatggctccacagttcggcgatcacgtccacgccttcgcggtccaccagcgtcagcacgcgttccaccagttcggcgtcctgcgtgtggtgcacgcggtcaagcagcgccgcggccgacgcatggcacatttcgttgatttccgccggatcggcgtcgccggcgatattgtcggccatcatctggtcgagctggccggggcgtgccggacgcggcgaaccggtgttcgtgaaaccggcggaacggctgggaacgactgaaccggaaccgtagtgcatgttagtagacaatgggggagaccttctgaatgtcgatgatgctggggccttgcggtgtgtcgatgatgaacagcgacatggcggtgccggtaggcatgtatggcgattttgcgatgagctgcttggcaagctgcttacgcgcacacaggccgcgcaaatggtcgtacatgccgccgatgaccggccggtgcatgcagatggccgtggtttcgcggctgttgagcgtctgcgtgatctgctcgcggaacgccagccatgagaccgccggatgctcggcgaacgcgtcctccgtcaacgtgttgatgtgttccatcggccgttcggtctgccagctcagcacctgcaacgtctcctggcagcgcagccacggcgaggtggccagtcgcgtcgggttgaaacaggcgagctcgcggttgagggcaaacgccatcgccgcgcctttcggcgtgattggacggttcgcgtcggtgcccttccacgacttgcgcgattcagccttcgcatggcgtacgatcagcagattctgcgcggtcgcggcaccctcctgcacgcggtccacgaacactgccaacgtgtccttatcggtcgaatgggacagtattttgcgcgcctcacgtacggaaacccagacgatatcgttgatttcgcccacgtccgcgcggtgcaccgggccgaacgcgtccagcagatgttcggcgtcgtcggcggaaatcggctgcgccatccaatacaacgtgtgcttggtgtcggccgtgcaatcgtgcgaatgccgggtcttcttgccctcttcggacaacgggtattcgacttcgcacagatacggtccgagtttgaccggcgaccccgtctcttcgccgatttcacgcaccgccgcatgccgatgcgtctcgttctgctcgagtttgcctttcggccagctccaatcgtcatacttcggacggtgcacgatacatacttcaatgctgtcgagctgttcctgcgcggatttgctactggcgatcgcaggatcgttcgcgatatcgctgcccgccttccatcgccatacgatgccgccggcggcttccacgatgcgtctcatcttttcgctcatattgtcctattctaggctgggccgggctggcggcggcgcgtgacgtccgaacatacagaaaatggccgggcccgcaaggtgcggaaccggccattcgcctcgatcgatcagtgccttaccggtcgacgcgtgtgtttcttgatgaggtattcctggctgtcgaccagcggtcgaccttcctcatccttgcaatggcgcacataggtgccatcggcctgcatatgccaagacgcggtggaatcggccatctgcagatcgacgtacttgatgagctcgtcgatctgctccggagccacgatgcggaccagcgcttcgactcgacggtcgaggttgcggtgcatcagatcggcggaaccaatccacacttccggaccggccgcagggccttcgccgatctgcgggccatcggagttggcgaacgcgtaaatacggctgtgctcaaggaaacggccgaggatcgaacgcacgcggatgttctcggaaagtcccggaacgcccggcttgagcgcgcagatgccacgttcgacgatgtcgatcttcacgccggcctggcttgcacggtacagcgcgtcgatggtcttttcgtcaacgatggagttgaccttgatcttgatccacgcttccttgccggcgcgtgcggcgtcctcctcgcggcggatgcgctgaatcaagccggaacgcacggtgcgcggcgccaccagcagacggtggaagctcgacttcggcgcgtagccggacagctggttgaacaggcgggtcatatcctggccgaccaccggatcgcaggtcagcaggcccaggtcggtgtagatacgtgcggtcttcggattgtaattaccggtgcccacgtggcagtaacgacgcaggccgtcggcttcctgacgcaccacaaggctcagcttgcagtgggtcttcaggccgacgatgccgtacaccacgtgcacgcccgcgcgttccagcttgcgggcccacgcgatgttggcgtcctcgtcgaaacgcgccttgatctcgaccagcgccagcacctgcttgccggcatgcgcggcgtcgatcagcgcgtcgatgatcggcgaattgctggacgtacggtacagcgtctgcttgatggccagcaccttcggatcggccgcggcctgcgccaggaacgcctgcacggacgtcgagaaggaatcgtacgggtggtgcagcaggatgtcgcgctcgcggatggcggcgaaaatgtcctgcgcacgggacgattcgacttcggcgatctgacgattggtggtcggaatgaacggacggtacttgagatccggacggtcgatgccgccgagctcgaacagcacggtcgcgtcaagcggcgccggcaggcggtagacctcgtcggcgctcacgcgcagctggtcggcgagcagctgggacaggaacgggctggtctcgtcggagatctccaaacggatcggcggtccgaaacgacggcgcagcagctccttctccatggcgttgagcaggttctcggcgtcatcctcttccacgtcgatgtcctcgttacgggtgacgcggaaggagcgtgcctccttgatgatcatgcccgggaacagggattccaggtgggcgatgatcaggttctccatggtgatgaagccatagcgcacgttggtgttctcgtcttcggtcaggtcgtcgaccggcacgagacggttcaggttgtcaggaaccttcacgcgggcgaagtgcgacttgccggatgccggattctccaccagcacggcgaggttgagggaaccgccggaaatgtacgggaacgggtgggccggatccacggcaagcggagtcagaaccgggaacacctgctggcggtagtagcgcgacaggcgctcctgctcggccgcggtgagcttgtcccagctcagcagcacgatctgttccttcgccaggtcggggaggatgtggtcgatgatgtagtgcgcgtgctcgtcctgcaggcggtgggcctgctcgctgatggcgcgcagctgctgcctcgggctcagtccggaagcggccgtcacggcgatgccggtgtcgatgcggcgcttcaggccggccacgcggaccatgaagaactcgtcgaggttgttcgcgaagatcgcggcgaagctcgcgcgttcgatgaccggcaggtcctcatcctgtgcaagctcgaggacgcgcttgttgaacttcaaccagctcagctcacggtcgaagaaacggtcattcggcagcggttcctcgcctgcctgaagctcgcgcttatcgttcttatcggtctcagcgatatgctcagctatctggctgcgcaggatcgcctttgagggtgcgtcaaaaatctgtgccatagttatctactttatcctcaagtgcttggaatgtcttgcaaaactcaggaaaattaagcaggagttaacattcgttcgccgagttggtgaaatatgcttccgacacgccgttttttcggggcaaatgaacgtgaatgaacaagcaagcgttgcgattcgcacagcatggagcatttttgcgattcttgcgatcggaaagcaacagttgcgataaatacggaacatcgtcccgtttcggtttgcacttgccgcaatggcgagcataattacgaagtacaagaacaactgaagagcagagccccacaaggtgtgtatgaccgagataggttgttacgttgaacgggcattggatagacttaccgttacgacgatgttgttgtgcagcgattctgctccgaagattcttgcaggaaggcccgcttcggcgggtcttccttttttgttgcgctgcgccgtgctgcgttgcgtaatgtcttgcgatgtgccgaatcgcgttgcgatgtggataagtgtggatgacacgccgagggtgtggataacccacattctccgaccacaggtgccgtttcggcttgaacccatgtgcggtttcgtttttcaatcggcggtatgagcgatgcaatttcttcattacaggtccctccggtcccattgccgtcatacggaggccgtgacgtgcgcgtgacgtgttcgccgaaaatccggtcgcagccagcggccagagtgcggcagccgactcgatcccagcaaaccgttcggcgggaaacggtctcgccgcaacggttctatacgccgcagaacgccgtggacgcgcgaacgtcggcacgatgggccgggcctgccgtggcgggcggtttcatgggttcgccgttggaatcgtcgtccacacggctgaaacccgttgaagcgcaaccggaacctgctccacgcaacgtcgtggtggtcggatccgccgtcgccggagtcggtgccagcacgttggcggcgctgctggcccgcgaactgacggaacgtggatgcaaaagcgtgctggtagacgcagatctcaacggtggcggtcttgacgtgctgctcggtgtggaagacgaagacggttcacgcttcggagacatcagcgccccgctcggcaaagtggacggcaaagcgctgctgcgagaactgcccgtgtgggatggcgtgccgctgctggcctgcaatccctggcgaagcgaaaacccgcaatcctgggagatccaggcatgcatccgcgcgctcgcgcaggtgaaggacgcggtgatcgtggacgccgggcaatggcgtggactcgatgacattccggaactggcccaggccacacacatcaccgtggtcgaaatgacggtgctcggactggcccgagccaaagtggccatgcaatcgcgtggaacggcggaacggcagaaacatggccatatcgtcggcgttgaaccgcgcggcgtggcacgtggacgtggcgtgaccacgctggaagagacggaaaactatcttggccattccctcgcggcggttgtcaaaccggacgccaagctgtgcggcgaactgctggacggcctgggcctgcgcaggccgaaccgccaaaccgtcaaagccttggccgcgctcacggatgaactgcaggaatcgttggaaggcaagcgggtgaagcatggaactcggaccccttagcgccatcgcctcgcagccgggcgtcacggacatcgcggtgacctgcgacggcacggtttgggcggattgcggccaaggcatgcaggaagtatgtctgctgcgccgatgctttccgtcagcgcagtcgattcgtgaattcgcagcgcgattatgctcgcaacttggccgacggcttgatgacgcctgcccgatcgccgacgcctccaccgtggacggtctgcgcgtgcacgccgtcatcgcaccactggtgccgcagggcgcggccatcagcatacgattgcccgatgcggtctcgcccaatctggaatcgttggcgcgcaacggcatgtttccagccgaatggctgcccctgctggccggactggtgtcccgcaaggcaagcgtgctggtgacaggcggcaccggtgccggcaaaaccacgatgctcaaagccatgctgatgcgatgcccgccgaacgagcgcatcgtcaccgtcgaggaagtgcgcgaattgggcatgatccaacatgccaaccacgtgtctctggtcacacgcgaagccaacacggaaggtgccggcggcataggcctttccgaactgatctgcgcgacgctgcgcatgagaccggaccgcgtggtggtcggcgaatgccgtggcggtgaagtcgtggatctgctcagagccttgaattccgggcatcgaggcggcatgaccacattgcacgccaatcaagtggaggcggttccggcgcgattggtctcattgggtttgctggccggattggagccacgcgccacggcggcgctcgccgaggatgcgttcgacgtggtgcttcatgtggaacgtatcgccggcagacggcgcattgcgcaggtcggcagattggaagcggtggaagggcgattgcatgggcgtctgctggccgcctgggatggccgtacggtccgtgccggccaacgttgggatggattcatgagccgatggagcgcatgatgcgtgatgcgtgtggttgggaatattgcgccgcatggctggcgtcgatggccgtctggctgtggctgaatcggaacgtggaatgggcgggattgcggcgattacagcgtgtgctggttcgcttcgggcttcgttcggctgacgatagcggcggggccgatggagatggaacttgtgatgatgaatccgacgggcatggcagaacagtccggaacgatggggaaaaccgggatgcatcgccacggatgccgaccatcggcgctgccgcatgcgtggccgcgctgcgggcgtccgtacgcagcggagccaccttggtccaagcgttcgaggaattacagggcgctcctttcgcagtgcctgaactgacccgtttccgtattgacatggccgtacgaagccgctgctcgcttcaggaacaacacaagcatgtggatcagcttggtgcggaacttcatgcggcctgcacgttgagtctgcagttgggctgcgagatgagccgatgcctggaggccgtcgcggcgtcgttgaagcggcgacggctgctcgacgacttgcgtgccaacgcttttgccatgccgcaggccacggtgaagctgctgatggcattgccgttgctgacggtgatgctaggggaatgcatgggagcccatcccttgcgattccttgtggaagacgtgaaaggatggatgtgcctcggcttcgccggctgctgttatgccgtcggctggtattggattcgcaggctgatgcggcaggagcatgtgcgatgagcttggcatggccgatgctggcagcggtgggcgccgctggcgcgacatggctgtatgaatggtcgccagccagaaatccgcccgattccgacgtgcggtcatgcaatctgccattgcccttgatattggaaatgttgagcgtggcgatacgtcaaggagcgtccattccacgcgcgctgattacggtcggaaacattgtggaaggcgagttcggcggtggattgcgctcggctggagaacggctgaatagtggcatgccatggaatgaggcatggcctgacgatgatgattgcgccgtggtccgtgacgcgttctcctcatcatggtcgagcggctcctcgccggtgaatcggttggcaaccgcaatcgagcagctggattgggatgaacggtcgcggattgaacagtcggcggcgaaactgtcgattcggttgttgctaccgaccggcctgtgcatgctgccggcctttgtcgccattggcgtgattccggcggtgatgtcgtttctgtagcggccgattcgccatggggtagtgcgggttggtgcgaattggctcaaatttgctcgaatcggaccgcggtcggaatgacggatgatgcgcggtccgttccgtcatgccctaatcgcttgtggataagtgtggatgacacgccgagggtgtggataacccacgttcttcgaccacaacccacgaaaaccatgccatcgccgatgccaatacctgacactgagcgtacccggtcaatcggccgggattagccgaatgaaaggagcgtcatgaacgacgcaatgtcaatcaatgtcgatggttcgccgggtctgatgggtcgcgtcggccagaagttatgcgcggccaaggaacgtgccaataaggcggtctgcctattggacgcgcgcatgcgcctgctgaccgccgagccggagaagggcgcggtcaccgccgaatacgcggtggtgctggtggcggccacggcattcgccgcggttctgatcgccatcgtgaaatcggatgtcgtgaaaacgctgctgaccggcctcatcaagaaagcgttgagcgtggggtaaccatgcttgcgcgatggtggagacgccatgcccgtgacgccgattgcggaaccgtcaccgccgaattcgcggtggtgcttccctgcgtggccgcggtggcgattctggtgctgtgtttggggcgtgcctccatagtgtccatgaactgtcaggacgctgcggccgccggtgcgagggccatggcgattgacgccggcggcgaagcgaaagcccgcgccgcggcgcaaaccattgccggtggcggttccacggtgtcgttcgccgccaatgcgaacagcgtcaccgttgtggtgcgttgcccggttgcggcggatccgaccggcgtgctgcccgccagcgtcgtgggcaaggcaactcggtatttctgattgcgatgttcatgacagcgtgctgtccgtaacggtttttgaaaggcttccaatgcgcggcaagaaaggaacgacttccgtgaaacatgacgtgaaacagtatgtgcgacgagtgttgcatgtgctgaaaggcgcggacgaaggttccggaaccatatcgggagtcgcgctgatcgcaatcgtcgcggccatgctcggtgcggtcgccatggcaggcaatctgctgctgtgcgtgcatcgcgcgcagaatacggccgacctggcgtcggtggccgccgcgcagtcgctgcgtgacggtgccgccgacccgtgcgcggccgcatcgcgtacaacgtcgggcaatggaacccggctcgaatcctgtgccattgaaggcgaggatgcggtggtcgccgtgcaggcggccacgcaggtaccgttcgcaccgtgggtcgtccggcagtcacgtgcggggcctattgcctgtgattaggagattgccggacagtcgttgcatgacgacacggaatgttcagctgaaggtaatgggcaatctggcgcttgacgtgaaacatggttatcgtacaagtatgagcaagacgtcacatgcgaatacgaccgttgccgtggtctgcaatccgacatcgaacaaaggcaagggcgcccaagtgggcggtcatgtcattgatctgctgcgcggagccggacgcaagcacggcttcgacgtaatcgatgtgaccggcacaagcttcgacgattccctggccaacgcccgccgccgcggcgacgaatacgattatctggtcgcggtcggaggcgacggcatggtcgcgttaggcgccaacgcagtcggctgctccggcaaaccactcggcatcgtggccatcggctccggcaatgatttcgcacgcggactggatttgccggtcaatcgcgtcgaaaccgccgttgaaggcattgtcggtgcgattgtgcgcggcacgcatatcgacgtggacatgggcttggtgacttcgttgcctgacggtcatgccatcgattcgaccgacggaaccgatgtttcacagtcgcgctcgccgatcgaccgctattatgcgggcatgctgtcgtgcggtttggacgcaagcatcaacgaccgcgccaatcattcgcatctgccgaatggctcgctgcggtatttcgccgcggtcatcgtggagctgacacacatgaaaagctacggataccacatcaaggccacgctggccgacggttcggtggaggagcgggatatcatctcgccactgctcaccgtggccaattcccgccatatcggcggcggcatcgaggtgtccccgtattcacggttcgcggacggactgcttgatctggtgtggcttgaccatgtgccgaatttccgggagtgcgtggacgcggtggcacgcgcctaccacggccgactgctgggcagccatgctttcggatggaagcgggtgcgcgacattgaaatcacccgcgccaccgaaggggatgagccttcggtgttgatggccgatggcgaatacgtgggccatttgccggtgaaggtcttagccaaggacagtgcgctgcgtgtgctggtgccgccggccgtggcggaagcgcaggcggccgacagcgaggaacgggtgttggaaaccatcaaacgtgacggtcgcgaccctcttaccggtagattcctcgcctgacgtcgttttccgtcagccagccggtgccgctcgatgcccctccggacgttgaacggccgttatatgttgcttgccggcggaaatgacgcgtgtgggagcaccgtcacagatattcgtccaaatgcagcgtctgtgccgccacctgcctgacaatgtcatcgtcaatgtcaggatgcagtctgatcagcgagatcaagccgacgatcagcgtgtagaaggtctcatgctcgttgcggatcggcatgccgtgcttttcctcgaattcacgtaccgtggaaccgcacaggtattcggaaatgcggtccgcggcccggtcgatgaacctcagatacagtgcagcgttgccatcctcgatgagacgttggctgaacgggccttcatcggcgatgagcgaacgggtcagccgcaccacatcgtcaagcgccttcgagatgttgccggcctcgcgatgctcgttccactcttccaggcgggcgatgacttcgctgatgacatcgtcgagcacggcatccgcaacctggtctttgtcttggaaatagtggtagaaaagcgatctggtcatgccgacccgttcggcgatatcgctgatcgtgatcttcgaaaaccctttttccaagcagatctcacgtgccgcctgcacgatctgcaagcgacgcgcgtctccaatggtgctggtggacgcttccggtttcccggtcatggctctctcctcccaatcgcgtggcaacgccttgtgcggcatggtggtgacgcacgggttttaggcgcgcaacagtcagcgttcgtgaccgacggtacgccgatcacacggttcatgtctgatttccagagtaccggctgcgccggttgtagatcagacagacacgcgatggacttgcggagatggtcggcctcggcgcttcccgattggcgaacgtgtcgtaattcatcgatactctagaacactacggcggaaggaatttgcgatggcactggcactgtatagaaggtatcgtcccgacacgttcgatggcgtgatcggacaggatcaggtcacggttccgctgatgcgtgcgcttgacgagaacaagctcacgcacgcctatctgttctccggaccgcgcggctgcggtaaaacgagttccgcgcgtattctggcccgttgcgtcaactgcgccaaaggtccgacctcgcatccgtgcggtgaatgcgccagctgccgtgaccttgccaccggcggccccggctccatcgacgtggtggaaatcgacgccgcctcccataacggtgtggacgatgcccgtgaactgcgtgaacgtgccggattcgccccggcccgcgatcgctataaaatcttcatcctcgacgaggcccacatggtcacgccgcagggcttcaacgcgctcctgaaaatcgtggaggagccgccggagcatgtcatgttcatcttcgccaccaccgaaccggacaaggtgatcggcaccattcgctcccgcacccaccactatccgttccgtctggtgccacaggaggtcatgggcccgtatcttgagcagatctgcgccgacgagcatatcgaggccgaagcgggtgtgctgcgcttggccatgcgtgccggcggcggatccgtacgtgacacgctgtccgtgctcgaccagctgatggtcggtgccgtcgacggcaagattccttacgattccgcggtcgcgctgcttggtttcacgccggacgcgcttatcggcgaggcaatcgacgccgtcgccgacaagaacggcgaggcgctgtatggcgtcattcaaaaggtcgtggtcggcggattcgacccccgacgtttcgttgaggacctactggcacgcgtgcgcgacctgctggtgctcaccttgggcggtgagcgtgcggaaagcgtgctgtctgacgacaccgcgaccgagaacatggacgatctgcatcgccaggcggcttcgttgggattggccgcgcttacgcagatggcggatacgatcaacgccacgctggccaacatgaccggtgcgatttcgccgcgcatgcgcctggaactgctcgccgcccgccttcttgccggtcgtgagacaggcgtggtcgcgcaagccgccgcaccatcgtccggcatgccggaagctggacatgcgggcggtgccgcagcgtctgaatcgcagcgtccgtccggttcccgtaggtacgccgcgcaatcggcacgtggaaggcatgccgtggaaccgtccgcggctcccacgaatccagccgatgccgtcgtttccggagcggcctccgtattggcggaagtccagcaggcgatgggtggacctctgtcggaaggcagcgagccggccgcttcagccgagtccaagccggttgaaacgcagtctgcgccatccaaactatccaatgccgaaccatccgctcccacccagtccgtgactcagtccgcgccccagcctgcggcaacggacgatcgcactcccgaccagaagtgggacgcgatcgttgccggcctgcctgaggatgtccgtcgctacgtggaccgcgagaaagtgccccgcgtgctgctggacggggtcaaaggccgactgtggattaaattcgacaagtcgttgagcaaatacgcgttcgccaaggccgtggccaaggaagcggtcgacggcaccaccaatgtggtgcagatcgtgcgcggcgaagtgcataaggtgttcggccctgatgtcactctcgcgccggccaagaagcttgccgacggttccaccgcggtgccgtggagcaagctcagcccggaagagcagagcaagatcaacgcgcagctggtgcaggaacagctgaaggccgccacattgctgaccgcgaacctcggcaaggaggttgccaaggagccggaagacgacgatccgtggaacaccccaattccgcagacgcccatcgccgaaggcaacgccaacgacgtacagccgccggaacaccacgtaaaacatgtggacgtgccggatgtgagcgatgacgtcgatccgtgggccacgccactgcccacgccgcagacggacgatcgggagcaaggccaaccgaatgggccggagcagccgcggcaaaaccagccggaacagcacagcgaacgacatagcgcacggcaaagcgcccgcgaaatgcaatcgcaacaggcccagcagccggcgtcatcgccggcaggattcgcggatgacccatggggagcccccatgccggtgcaggcgggaccgccggagcctgaagtcgccccggaagacgacgaatactccatgagcgacgaatcgatcggcgcatcgaacgctttggacatgaacgacctgaacagggtgttcgaagtgaagaaagtcgaggaattcagctcggacgatccgcataatccgcgcaacatgcaggtgaagaaaacacttgacgactgacaccggccaccgcacgtcgcatgtcgcttatcgtacggcgagtaccgggcgctggccatcagacgtcagttgtccggaacgtggctgcggcaaccagtcaacgaaaggtatgaaccatggctttggcctatgacggcgccatccaacgactcatcgacgcgttcgccaacctgcccggcatcgggccgaaaggcgcgcaacgcatcgccttctacctgctcaacgcgcccgatgaggaatcgcaggcactgatcgacgccatcacggaagtcaaggaaaaagtacggttctgcgatatctgcggcaacgtgtgcgaaaccagcccatgcccggtatgcgccgacccacgccgcgaccacagcgtgatctgcgtggtcgaagagccgaaggacgtgatgagcatcgaacgcacccgcgaataccgaggcatgtaccatgtgctgggcggcgtcatcaacccgatggccaacgtgcagccaagcgacctcaacatcgccaaactcatcgaacggcttaaggacagcgaagtcaaggaggtgatcctcgcgctcaacccgaacgtggaaggcgaggccaccaccagcttcctttcgcagctgctgagccagaccgacatcaaggtgacgcgccttgccagcggcctgccggtgggcggcgacctcgaatacgccgacgagatcaccctgggccgtgcgctcgccggccgtcgcgccgtctgaacgggtcccgaatgttccgtatgttgggcgcgtccggacttgacaaatcaggtttttcctataatgaacttcacttgccgaatcaggcaggtgatacgttgaagaagattggataagttgtggctctcatcgtgcagaagtttggcggctcttccgtagccgacccagaatcgattaagcgcgtggcccgacgcatcatcgaaacgaagaacgccggcaatgacgtggccgtcgtggtctccgccatgggagacaccaccgacgacctgatcgatcaggcgctcagcatcgattccaacccgccggcgcgcgagatggacatgctgatgaccgcaggcgagcgtatttcgatgagtttgctcgctatggcgattcatgcggccggttctcatgcatactcgttcaccggttcccaggctggtttcatgaccgacgcgcagttcggcaccgcgcatatcaaggccgtgaagcccgatcgcgtgcgtcgtgcattggataagggttccgtggcgatcgtggccggcttccaaggcgtgaacgaaggcggcgacgcaaccacgctcggccgtggcggttccgatacttccgcagtcgcgctcgccgtggcgctggacgccgacatctgcgaaatctacaccgacgtcgatggcgtgttcaccgccgatccgcgtatcgtgccgaccgcccgtcgcattcccgtcatcgactacgaatcgatgctggaaatgtcgtcctgcggttccaaggtgctggcattgcgttgcgtggaatacgcgcagcgattcggcatgccgttgcacgtgcgcagctccttctcccaccgtcgcggcacgctgatcgtgccggaaggcgtcgatccgcgcaccctgccgaacatctgaacggcagccgggcagcgtaatcgcaggcaatcgcaaataattgcaagacaacgcgaaaacgaaaataagactttacaaacaaaggtaagaacatgagcgaagacaacaaccagtccatgggcgacctgttccccgacctggggccggaagtgccgatcatctccggcgtcgcgcacgacagcaccgagtcgctggccaccgtgcgccgcgtgccgaacgagccgggcatggcggcgaaggtgttcaccatgctggccgaggccggcgtgaacgtggacatgatcgtgcaggcctccgcctccaccggcaccgccgacatctccttcaccgtgccgggcaccgccgcggccaaggtccaggaagtgctgcaggagaagcagggcgagctgggcttccagtccttcgacgtcgacccgaacgtcggcaaggtggccgtggtcggcgtgggcatgaagacccattccggtctggccgcgaagttcttcaacgcgctgagcgacaagggcgtgaacgtgctgatgatctccacgtccgaaatccgcatcgccgcgcttgtaccgctcgagcagctcaacgacgccgtcaaggcgctgcacaccgcctacggtctggacgccgaccaggtggaagccgtggtgtacggcggcaccggccgctgatagtgctggcttcagtttcccagtatttttaaagggcatggttttgcgaccgtgcccttttcgtttgctttttacgattcacgccgtacgttgcataccgtgccaagcagtccccaaacaagcaaaaggccggctccgaagagtcggccttttgcttggctatggctcgtttatgcggcttacggtttagctacccaagccgcataaacgtcgcatcacttcttggtgatgtaacccaacgccttaagcatttctgcgctttccagcgcgccaccggcggcgccacgcagggtattgtgcgccaatcccacgaacttccaatcgaaaatggaatcctcacgcagacggccgatggaaacacccataccaccctcgtaatccacatccttgagcacctgcggacggtcatcctcggtcaggtactggatgaaatgcttcggagcgtgcggcaggccaagctcggcggccttgctggtgtagttgaccagacggtcgatcagctcgtccttggtcgggttcttaccgaagttgatgaacacggtggcggtgtggccgttgagcacgggcacgcggatgcactgcgaggtgatgcgcagcggaccgtcgaacggcacaatctcgcccttggcctcgtccacatggccgaagaccttcagcggctccttctcggacttcgcttcctcgccggagatgaacggaatgatgttgcccaccatttccggccaatccttgaacgtcttgcccgcgccggaaatggcctggtacgtgctcacgatgacctcgtgcggctcgaattccttccacgcggccaaagccggagtataggcctggatggagcagttcggcttgacggcaatgaaaccgtgcgtggtgcccaggcgcttcttctgatgttcgatgacctcatagtgctccggattgatctccggcaccaccatcggcacgtccggagtccagcggtgggcgctgttgttggacacgaccggggtctcggtcttcgcgtattcctcttcgatggcgcggatctcgtccttcggcatgttcaccgcggagaacacgaagtcgacgtccttgaccacgtcctcgacgtcggccacgttcttgacgaccatgtgcttgacgaactccggcatcggggtttccatcttccagcggctgccgatggcctcctcgtaggtcttgccggcgctgtgcgcggacgcggcaagggtgaccagttcgaaccacggatggttttcgagcagcgtcacgaagcgctgtccgaccatgcccgtagctccgagaatgccaaccttaatcttttcggacataacaacctttcgcttatgctggaacggttttccaagttttgcaagtttgattttgcttacgcttgaggtcgaccagccggcccaaaacgacgtcgcgggcggccacacgcgttgttcaatcttacgaaaacccgccgtcatgtccgccgagctatccgtatgctggtcggtaaacgcgctcgcgtacactggtagacatgtcgaaggcatcagaagaagcgcagaagcagctggatcgtatcgtggcgttggggtatccggatgtggccgatatgtcggcagccgcgttccgctcgcttgcgcgcccgcttatccgcgcgcttgaggattgcgatggttccgccgatttgggtacgcagatcctgttggtgcccacgcgcgaactggtgacgcccgaatcgctgatcgcccgaacctccatcaaccgcatggcggggttcaccaccatgccgccgcgcgatatcgccagcttcctgccgcaggatggtttcgaaccgccggaaggcccgttctatctggtgatcgaaccgcacaccggcacctgctatatcaaccgcgagccggacgtggcacgcaagctgatcgattccgacgagcgattgccgttgactttggaagaggggcttgcgatcgccacacagcatccggaatggctgctggaaaagaacggtttcaacctgctgggctcgcgttccgctgacggccgcgtaccgagtatctggatgagccagaatgctccgcgattgggcgcggtgtggccgaattcccgtcatacgtggctgggtaacgcctactgcatggcccgtcgaggcgtgagcctgttccggtagtctttcggcttaccgcgccggctccctataatcgatttcagagaagaaactgaagcaggggagaagccatgttctgtacgcaatgcggttcgaagaacgctccggagtcgaagttctgcacgaactgcggcaatccgttggtctccgttccggtgcagcctgatgccggacaagcacggatttcggatgatttttccgtcgattccacggtggcggaaacccctgcatcgcagctcgcaccgcagtctgcggagcaacccgaggaacagtctgcggcacagcacgaggaacgccctgcagaacagctcgcttcgcagccggcagacgcgattccgccggtcccgttgccgggcggcggcacgctgcccgtagcgcagtccgcgacttcggctgcatcgcaatccgttccgtcggtgtcggaaactcctgagccaaaaagcgacggaactgtgcgtgacgcttccccgaatcgcaagctcatcatcggcattgcggtggccgcgatgctgctggtcgccgctgtggtggccggcatcgtgacatacaacatggagttgtggggtggcaagtcgttgccggacgtggcggtggcgtctcccaaggactcgtcgaagactccggatgcgaaggtcgtggtcaggcagcttgaaggcaagggtctcaaagtcaagcgcgtcaaggaattctccggcgtgaaaagcggcaagttccttggctatcagggaattcagtccggtgaccgcgtaagagcgggcagtgtggtgacagtgcgcgaatcggccggccctggcgtgccggaaggtacggtcggcaagaaagctgaaagcgtggtgacaacgttctcgcagatgggcgtgccggtgcattacaagcaggtgatcgtgtcggacaccagcaaaaccaccgagggaagcgtgatcagcacgtaccccgcgcaaggccaaggcgtgaaggatgataagaaaggcatctacatcggcgtggctacgaaaagcgacggcggcctgccgtcggacatcgtcggccaggaaatttccgacgtgaaatcaagccttgaatccaaaggctacgacgtgaaagtggagaaacgtctctcatcgaaacagtacatcggcaaggtctccggctccgaacctgggccgggcagccagctgaacgaaggccagaccatcaccctgtatcagggtgtggatgccaagggtgccaagcagacgttcattgaccacagcggaaccggtggagatgggttgctgatgggcacgagtgacgttgcttctggccagtggtgcaataaggccggcgactgcatcacgctaggacaggatgacagttattccagcggagacatcgttttcctgaaagtgaaagatggtgctgcgaacacgaagtacagcatgaccggtgagtctttgatttcctgcgatgcggtgcaacagccgtattgcagcagcaagaaagccgactatctgttgactggaaactctggagcatttgaattgttcccacacaaagcgttcgaaacgtattggtgtggcgattccgccttgggtggggaaggcgatatgcggagttgtgttgccggaaaggtccatgacattgattccgactcttcggatgcgtccgattatgagccggacggcagcggtaaattccatatgatggatttgttcgcggtgttcccagtcggctctgatgtggaatcagtagagaaaattggctattttgacgcgtctgcactcgcggctgcccaaaagcaaaaacctgtcgatacggaccgtccgttcttgatgtatcgtgacgtgaaccagtacaagaacggcgagaaggaatcaacctatacaagggactggttcgatccattcatgccttacaacggctacaacggctccaaggatgacaccgtcaaaatgaagcccgcccccagcgacgaaaccgcctactatctggtggaggacgtccagcccgactgggattccctcgaagacgccaacatcaagggcgtgtccgccaagagtcagaaatctaacggcaaaaatgcaagcaggaacgcagacaccaagaaatctgattcgcaatcggatgccgccactcggtctttgatgaagtccatcgccggaaagtacggtttcgcttccggttccggcggttggagcaccactatgacggtggcgtccgatggcacgttcagcggaacatatcatgattccgacatgggcattacgggagatgactatccgaacggatcggtcaccatttcgaatttcaaaggccgtttcaaggatgccaagaagaacgcggacggcagctatacgatgcaatgcgacaaatcggcgctgaaaatcgatggcaatataggagacacgtatatcaaaaacggtagtaaatatacggttgccgacccctacggcattgccccctgcggtgcattcacggtatatccggcgggatacgacagttcgcagctcagcgaagcgatcgtcggctggagccatgcgtggtatgacagcatgcccgccaagctggaaacgccgattatcgtgaatgccgaggacacgaatctcggtagcgaatcacagcaagacgccttcttccaatcgaaatatcttgagtgatattcgataaggtcgcgttgtcggcggtgctgccgccgagtcgctgtcgattattgcgattgccacgagcatcgcattactgcgatttgcgcaacagcccccgaaccgcgtatccgatcgcgccgcacgtcaccgcgcccgcccctagcagcgtggcgctgacctgcggcctgcgcagctcgttgcgcacgccgatcaggtccgtcacgcaatggtcctcgaagaacacgcgtaattcgttgctggaataacggccgaccagatcgccccacgtcagcatgcgcgtcacgtacgccatcggattgtcttcgcggaattcaaacagccggatgccgcggaaccgcgatttcgggccgtagcattcaaaaccacaggtcggcgcgtaccccaaatcgatgtcgtgcacatgcccgacgaacgaattcttgtggtcatgcccgcagaacagcgcgaaatagccgcccgcctcacgcagcgcgtccacttcgcccacgttcacgtcggcgcagccaatcgcctcgcccagccgcgaaccgggtcggcacacatcgcggtcgagcacatagcaatgtcctgcgaattcgcgcgcgccctccacggcgttcggcgtgtaggcgggcacttcgcgcaggcaatcgtagaattcctgcggcggaatgtgctggaaggcgatcgccggcaccgcctgcccgtcgccattgcgcctgcccaactcgcgttgcacgcgcttcagccattcgacggcttccggcgagggggtgccgtagccgtcggagtcggccaaatcccagccgcgcgaattcgccgcgtatttcgcgtattcggtgaccgactgccgtccgttgccgtcacccgcgtctgccgtgtcggcgtaatcgcccgaattgaccatcatcacgctcattgtgatgcgccccgaaccgtcggacgcttcgatcggcaacgcgaacgtgcccggttcgagcgccaacggcgacgagccggcgacgggattcatacagccggcaaactcgcggtaaagatcgtcctgttcgtcggcgaggatgccgcattggaaatcatggttgccgtacgtcgcagcgaaggggatacgcgattccaacgccggccccaaaaacgcggcgaacgtgtcgcgcactttctgccgtgtctcgtcgagcagcgacgccgcggtggcgcgattgatggcttccgcccacgattccagcttgctggcagaaccgttgcgacctgcgcttttcaccagtttcggcgaatcggtgccgatgccgtcgatcatccaccgttcgtcggagggctgcgatttggtcagtgttttggcgatcggatgacgtttgatgccgcggattttcgcttcgatttcggtgaccgcgcgcacgtgcgtaccgggctgttcgccacggcgacgtagaaacgtatcgatatatgccggatcgtagccgcggatctgatcgccggtgagcacgatgaggtcgggatgtgccttcctgatagcgccttcgatcagccgaatcgtgtcttcgcgcacgtccggaccatcctgaatatcagccatttgcagcacccggaacgtaccgtcgctgttgaatcgcaagctcatgatgcccactgtactgcggcaaatctggatatggggtgaaataagggcgcgaaaatcgcaaaccatgccgtcatatcgcggaataccggcaaaatatgggattggttgtcgctagtatgggcggcagtgcaggtaggtaacatgcacgtaacaatgtggattggcagaaggccgatccgactttacagataaggaggagtgatgggtcaggatcaatcgtcagtgtttgatctcgcggcagtcgccgcggcgtccaacggagggaacaacgacccgctgctgcctccggcgcgttacattggagctccgcaaaagcccagcaagatgccgtacaacaagtacgtcgcatacgataagcaggtgccgtttgatttcccggagcgtacgtggccgggcaagcgactgcagcgtgcaccgcgttggtgctccgtcgatcttcgcgacggcaaccaggccctcgtcaacccgatggattccgagcgcaagctgcgtttctggaatctgctcgtgtcgatgggcttcaaggagatcgaggtcggcttcccgtcggcttccgaaaccgattatgacttcatccgcatgctgatcgagcgtgagctcattcctgacgatgtcaccatcgtcgtgctcacccaggcccgcgagcatctgattcgcaagacctacgagtgcctgaagggcgccaagcgcgccatcgtgcacttctacaattccgtgtccgtgctgcagcgcgaggtcgtgttccgcaaggacaaggccggcatcaagaagcttgccaccgacgccgcggcgctgtgcaaggagcttgagggcgaggccaagggcatcgacctgtactacgagtattctccggaatccttcaccggcaccgagccggagtacgcagtcgaggtgtgcaacgcggtgatcgacgtcatcaagccgacgccggaacatccgatgatcatcaacctgccggcaaccgtggaaatgaccacgccgaacgtcttcgccgacgaggtcgagtatgtgtccaaccacctcgtaccgcgtgacgccgtggtgctctccctgcatccgcacaacgatgagggcatgggcgttgccgccaccgagctggccgtgctggccggtgccgaccgcgttgaaggctgcctgctgggcaacggcgagcgtaccggcaacgtcgatttggtcacccttggcctgaacttcctgacccagggcatcgatccgcagatcgactactccaacgttccggaaatccgcaagaccgtcgaatactgcaaccagatcaagatctccgagcgccacccgtacgccggcaacttcgtgttcaccgcgttctccggctcccatcaggacgccatcaagaagggtcttgaggcccgtcaggtggccgccgaccgtgctggcgccgatctggacagcttcgtgtggctcgtgccgtacctgccgatcgacccgaaggacatcggccgttcctacgaggccatcatccgcgtgaactcccagtctggcaagggcggcatggcctacctgctcaagaccaaccacaaccttgatctgccgaagcgtctgcaggtcgagttcgagaaggtcgtgcagaactacgccgatgagaccaagaaggaagtcaaggacgaggacatctggcgtctgttcaaggacgagtacctgccggtcgaggaatccggcgccaccgcggctggtgtcgtggtcggagacagcaaggacgagaccctcgagcagtggggccgtctgaagctgctgaaggtgtccgtctcctccggcgaggatggttccgacaccgtgctcaaggccaggattctcgaccgcggcgtgaacgttggtgtcgacgagccggtggagcgtgaggtctccggcatcggcaacggtccgatcgccgccttcctcaacgccgtgagcaacttcggcatcgaagcgtccgtcatggattacgtggagcacaccatgtccgtcggcaccgatgccatggccgcttcctatgtggaatgccagatcggcgaggaagacaacacgagcatcgtgtggggcgtcggcatcgatacctctatcgtcaccagctcgctgaaggccatcatctcggccatcaaccgttccgagcgctgattgcgctgattgcacggacgcgttgagcaaacgcgccggatatgattcgaggggcttcccagggtaaccgggaagcccctcgtcgttgtcatgtgccatgcgatgcgcccgctcacaagtgcgacaagcgcgttccatgatgcttcctctccgcggatgaagggtgtcgcaatgccgccacaccaagttgtacaacgatgtaaaacacggtatagtacatcgttgtaaaacctgtatctgcttactgaaggatcttccatgtcggccaattattccctgctgtgctatacacgcgaagccaccggacgcgaagaggcgaacaacgaggacatcgcctacagcatgcatttggcgctacgttccggcgatgacgccgagtggcagccgctgaacgaaaactatggcatcttcttcgcggccggtgtgccgatcgccgccgcgaccgcggaatcccgccacgcgtgcacggccgcggcgcacttcgccgccgaccggttcgacgcgcctcgccccgccaccgacgccgtcgcccatggcgtggtcatgcccggtatggatatcacgctgaaatcgctgaagaatccgttcctgttccgcctcgcggacggacgattcgccatcgccgcgacccgtaccgcccgcggcggtgagccggatggttccgaacggtcggcattcctgctcgccatcagcgatgatctgacggcgttcgaccagcgggggctggtgctgttgcgcaccaccggtggggtcaatcacccgtccgtctctttcgacgccgcggacgcgtgctacgtcgtctcctggaccggtgacgatggcaaggcacgcaccgcgcggacggccgatatcgtagccgccgccggttcgggcaggccgcttgatgtcgtggaatcggcgtcgtcgcagccgttgcgtcagaccggggattgcggcattccgaacgccgtcgtcggcaacagcatcgccatcagtgagccggaggccgagcgcctgatagagcgcttcggccgcatccgcaataccggaacgtccgtgcccgcccagcgaatcgatgcgggcctgcatggtgaggatgcccggaatgcggttctggccttggccgcaacccgtgcggaactgtcatacagcgacggttcgcaggccacgcgcgcagtggattggaacatggcccagcttgaggccatcgcccaggaagcctccgagggaacgctcaaggccggccagacccgtaccgtcgaaggcgtgatccgccagagcgtctatccggtgccgttcgcggtggaacgcgccgacccgtcggtgttgtctttcgtcaaataaatctgcgtgtcgtcaccagttaatctgaacaccatcggcgttcaaaatggacaccgtcaccggcggccgggttggttccgctcttttcgtttatttcatcagggagtggctgttgcggtatgactcgccacggaacctgacgatccttccgtggtgcacgatgcggtcgatgaccgcggcggccatgtcgccgtctccgaacacctcgccccaccgtccgaactccaggttcgtggtgaacaccacgctccgcttctcgtaggaatccgcgacgacctggaacaggagcctggccccgtcgatgtcgatcggcaggtagcccagctcgtcgatgaccagcagcctggcgcggcctatcgcgcgcagttccgcgtcgagccggttctcgtccctcgcccgccgcaaacgcatcaccagcgacgacgcggtgaagaacctcaccggcatgcccctctcgcacgccagcatgcccgtggcgatcgccatgtgcgtcttgccgcatcccacgtcgccgtagagcacgaggtcctcggcccggtccacgaaaccgaggtccatgagctgctcgcgcccccagtcggcggggaacgacgccatgccccagtcgtatccgtcgaagcccttgacgcacgggaatcccgcgttcctgatcagcctggcgcgcctggattccgtccggctggcgttctcggccctgaacaggtcggccagcacgccgagctggccgggcgtggcgcccgcgaccacggaacgcagcacgctcctggtcaacggcagcccgcatgcgagctccatgacctcgtccggggtggacttgctcacggtccgcccgcccctgcgtccgcccgccgcggcgtccgtcgactcactcatcgccgtcctccctcatgaacctgctgtacgtgtcgagcctggccctcgattcgggaccgtcgccctgcgcgatccgcctggccgtctggtcgatcgcggccctgtcgggccttctgcccgcggcgacgatctcgacgacggccatgacggccgcacggaagccactcaccacggccgcgtggcggatgtcgtcgaccagcaggccgcgttcgcgcggctccatccggtcgagcagcacgcgcgtctcctccgggaagtcggagcgtatgggactctcgccccacgaacgcggcttgcgtgcgatgatggcgagcagcgacagcgggtccatcgcggtgtcggggctgcgcccccacctgcgctccaacgtgacgatcggctcgccgtccatggaacgcagctcgacccgcagggcccgcacgccggccatgagacgcatggaatgccatttcgggcccgcgaggtagcggttcgagtcgatcgtgaccgttccggtcctgtcggccttcaccccgcgccagtcgcacgcgtcgaacatggacggcggcagcgggagcatgtggtcgaggtccgtctcgaacaggtcccggatcggcacgtcctcgcggtagtggacgccgcgcgcgatctcgtcgcagcgttccaaccacgcgtccgtgagccggtcccatccctccgcggacggcgtcggcaccatcaggttgcggcgcaggaaaccgaccgcgttctccgtgcttcccttctcccagccggaataggggttgcagaacctcgtctcgaagccgtagtgcgcgcagaacagcgagaacagcctcgtctgggtgacggtcccgtcggccctgcggtggccgaccccggtggcgttgtcgaacactagcacgcgggggaccatgccggcatgggagaacaccttgttcagaccatggcacacgcattccgcggtctctcccggcagcgcggccacgtatctcatgttcgagtacgggaacgagaccaccaggaaatgcacggtccgttccacgccggcgaccacggccagggcctggccgaaatcgacctgcgcgctgcccggcgcccattccagctcactgaacccctcggcctcgccgcggtggcgttggcgccagcgcttgacccatcgctgcaccgacgaataactgccctcgaagccgcattcctccacgagccgctcgtgtacgcgccgggcggtgtgccgctgtttgcgtggcatgcgccggtcggcctcgagccattcgtcggccttgcgcgcgtactcgcccgcgaccagggaacggctcgcagttcccccggtcggcggaacgggcgaataatcgcgggtcgcgtacttgaccacggtcgtccgcgaaacgcccagttccctagctatctgcgtatgcgtcaggcctttcgtctcgagctgcctgatactctgttgaatacgcaccggtgtcgtcattcctttcctcccgaggaccatgtgttggttgttagcactcgggaatctatcaggaaccgtacggcaccggcgcttttcttccgccgatgccatttccgtccgccgtccgtgtccaatatgaacgcttatgccgttcagatttggtggtgacgccgtacacgtttatttgaccataaacacggtgttcgcgtggaagttcaacggcaagccgatgttcatgttcatcgccaccgatgacaccgacggcaattgcgtggatccgaacgacggcaggacccatatgccgctgcgcatcgccgactccatcgaagcgctttccgacgccgcgggcggacaggccaaggagatcgatctgctcgcatgcggcgatctcaatagcgaagatcgtccgatgaccggctgcttctgggctccggaactgcatgtgatcggcggcaagctgtcggtcctgttcatgccctgcttcgatgggccgcgcgtcaatcccgacggcacccccaacgatcgtgccggcaaaccggacatgtggaccggcagctgccacatcatgcagctcaagcagcattccgacggcacggattttgatccgcgcgagccggagaactggacggtgcccgagcctatcctcgacccggatggcgagacgctcaatccaatccagcgcatttcgcttgacatgaccgtgctgtgcgattcgggccgctggtactacgcatggcagcaggtcggcagcatctggatcgccagctttgacccggctcgtccggcgaggctcaccagcaagccgaagcagatcgtcgtgccggaattcgcatgggacaacatgatcgccgaaggaccgaacgccatcgtgcatgacggaacgattttcctgatctactcgggctcgctggtcggcatcgactacacgaccggcctggtcaccgccccggccggacagggagccgatctgaccgacgccagcgtatggacgaagctcgattatccgctgcagaagtccggcatgtacaacgggcgttggcagctcggcaccggccacggcatgtggtcgcatgacgaggacggcaacctcatctacgtgttccacaacgccgaatacgagcacggccgctatggtggccgcgacgcccaagtgcgccgcgtgcattggtccaaggagggcatgcccattctggatatgcaaacggcggaggagcttgaccccgactatgctggtgtaacaatggaggttggtttcttcgatgccgactgagtccgctgaatgacaaaaggggtatatatgccgaagcgaacggggggaaacggcgagcatgtcgtgaccatgcgtgaggtggccaaggcggccggagtgtcgatcaaaaccgtctccaacgtggtcaacgactacgaattcgtctcgcaggccacgcgcgacaaggtcaacaaagccatcgcggaactgggatacacggtgaacgtatcggcgcgcaacctgcgccgagggcagaccggcatcatcggcttggccattcccgatctgcagatgccgtatttcgcgcagctgtcgtcgctggtcatcgaagaggcgaagaaagtcggtttgcgcgtgattgtggagccgacgcaatattcgcgcgatggcgagttggaagcgctgcacgggtcccagcagatgatgatcgacggcctgatctacagcccgttggagcttgggcaggatgacgtcgagcagctgaaggtcgattatccgctcgtgctggtcggcgaacgcatcttcaccgatcaggtggaccacatcgccaccgagaacgtcgaaggcgcgaagcgtgccacgcagtatctgctgacgaccggttgccgccgcgtggccgtggtcggcgttcatccgggggagaaagtcggttccgccgcactgcgctaccaagggtatcttgaggcgctggaggaggccggcgtcgaattcgacgatcggctggtcgtcgaatcaggcatgtggcatcgtagtgacggcgtgagggccatgaacgcgttgttggattccggcgtcgaagtcgatggcgtcgtcgcgctgaacgacatgctggcttccggcgtgatgcacgcgatccagatgcacggcttgcacattcccgacgacatctccgtggttggtttcgacaattccgacgattcacagtacctgtcgccggcgctgacgtcgatcgcgccgggacttgaagcggtcgcccgtctgtcggtgaaagtgctcaaggagcgcatcgacggccgtgacccgaatgccgacaggccgggggagaaggtcttccgcaaggtcgcatcatcgctggtcgtgcgccaatccaccaaactccccatcgattccctcgtcctctgagctttcgcttgccttccggcaagtttctcccagcgtgcgtacccattgagtcggctcttccccaaggtgccgccgccgggcatgggcgctcggccgtaagcttggccgaacggccttgagtgtgtcgagcacccatgaccgacggcggcaccgacattggcatgaatggcgcaaacgatggacgcccatgcccagcggcagcaccgcatccaagcatcttccgacaatgacgcgcccaagttgttacaacgatgtaagaatgatatattcaacgttgtaaatactggaacaacggattgagaaggactaaacatggttgtttacaacaatccgatcgtgcttcagcgcgcagacccctgggtgctcaaggttgacggcgagtattatttcaccgcctccgatccggaatacaactgcatcgccattcgtcacgcgtcgaatatcaacgatctgcagaaggctcccgagacggtggtgtggcgcaagcacgaatccggcccggcgagcatctacatctgggcccctgaactacatcgcatcaatggcgcatggtatatctatttcgcaggcgccgcaacggatttcgaagcatccggcctgccgacgcaccgcatgttcgtgctggagaacaccgacgacgatccgacttccgacaactgggtggagaggggccagatcatcaccccgatcgactccttcgcacttgacgccaccaccgaagtgattgatggcgtgcagtatttggtatgggcgcagaaggatcccgccatcgaaggcaactccaacctgtatatcgccaagatggccaatccgtggacgctgggcagtgatcccgtcatgctgaccaagccggaatacgactgggaatgcatcgacttcctggtcaacgaaggaccggccttcctgttccatgggaacaagatctacatcacgtattccgcctccggcaccggcgttccgtacgccgtgggactgttgaccgccgagtgcggcagcgatctgctggacaaggcctcctggactaagagcccggtgccggtgtttaagacctgcgccgagaacggtcagtatggtccgggccacaattcattcaccaagtccgaggacggcaccgaggacctgatgatctaccactgccgcaactacacggaaattaagggcgatccgctgttcgacccgaatcgccacgcgcgcgtcggtgtggtcaagtggaccgccgacggtccggatttcggcgtgccggaacccgacaatctgtggacccctaccaccacggacgtgctgccggccgatggcggtccgctcgcgggaactccgtgtgtgttaagtgccgcaagtacaggtttgcatggctcttctatcggtgtgtcataaagttgtacaacgatagaaaaagttgtataatcaaaattacaacgttgaaaatattgtttaatccaacgaggtgatgttgccaacaaagaagtcggttaattttattgtggcgttgagggaatctctgaatgccgaaaaaggaggagggtctataactacatgtttttgacttgattgagcattatgtacttccatcgtgccgctaatgaatgattttggcggtcgcgaaggggtgcgggctatgaaaaataagaagctgttacagaggcgtagcggcaaatcggataaaggagaaaaaatatgaataagggaatcagggcagctgcgttagttgtagctgctgcatccgtgatttctcttggagcatgtggtggcggctcaaaggccgcaggctccaatggcggagtgacagagcttagtgtatggagcggttttactgagaatgatgggaaagtagttcaatctattgctgacgatttcaataaatcgcaaagcaatgtgaaggtgacaattgaacagaatccttggaatgtaattaatgataaacttctgtcttcaatttctgctggtaatggtccggatgtggtgacttatcagccagatggtgcaaaaggcttcatcaagcagggggctattgtctctacggatgatttctattccgattcttctaatgagacaagtcattaccgtaagaatgttgtcaaagatggagaagtggacggtaaacattatggagtgccaatgggccatgctccatattccgtctatttcaacaaggctatttttgatgcggctggaatcacggaggatcaatatcctaagacgtgggatgatcttgctgctcttgcgtcaaagttgaccgttgataaggatggagatggtactcctgaccagtatgggattgctcttgctgataaggacgctggatatcttccgatatttttacagggagccggaacagatttagttgttgacgggaaggctaacctgacttctaagaaatctaaggatacacttacttggattcgtgataatttctatgcgaagaagtcctcgccgagcaatctttcgcttgtggatgctcagacgttgttctgctccggtaaggcggcgatgttctggatcgggccttggattgttaatgctgccaaagagaaaggaattgaaaccggcacatttgaaatgccgaaggggccggagaagcaggtcacagaagttgcggctaactattggtatacgacttcacaggtcgacggtaatgatgctaagaagaaggctgcttatgcttggatgaagttctttaataataaaaagaatcagattacttgggcggttaaggcaaactacccacccaatcgtacggatgttactgctgacgatatgaagagcaacaatttcgtttctcaaattagcccttatatggatcattccagtctgcttcttggaagtgttccgtctgggtttgcagatgttcagtctgaactaaatgctcttggcccaaagatttctgaatctacgggtgacttgacggatattctacaaaaatctaacgataaaattcaaggatatattgaggaatgaattaatttaagctgaagagagggtgcgagtatcaattgatttgcagctggggctcgcacccctttttgaagctgggagggaaagtagatgcgtgcatcatcaagtggatacaagccaccacgctcattggtcacaagtgattctcctgtccgtcggaatgaaatgaagcgggctcagacacgaatgggttggttattcagtgctgctgcaattgtgattatcggggcattcgttttttatcctgctttttatgcgctgtggatgagttttaccaatgcgacgggatttaataagcctcaatttattggagtgaaaaactatacggatttattctccaatcaagatgctgtacatgctcttttgaatacgctgatatatacggttatttatatgccgctactaattatcgtagctttggctgttgcgatgcttcttaaccgtgatgatttacctttgagagggtttttccggtccgccatcttcctcccgtttgttatttctatggctgttgccgcaatggcgtggcagttcattcttgacccaaatttaggcttcctgccatattggttatccaagattggcattcatatgggtgatgtactcggtagcactacatgggcccttcctacggttactgtggttggtgtatggaagaattttggttattttatggtcatctttcttgcaggattgcaaggggtttcgcatgagctatatgaagcggcggagcttgatggttgcggtgcgtggagaaagtttacttctgttacgcttccggggcttcgtagcactatgacttatgtcgtcataatggctttgatccagtctttccaggcgtttgatcagatttatgtcatgacgtctggtggtcctgatcatatgactgagacggttgtttatcgaatctatactgaaggcttccgtaatttccatcttggcgcagcttcggctcttagctatgttttgctggttttcaccttcattgtgggggttatccagcttgtccttaataaccgttatgaaaaggagtccatgtgatgaaaaaaggatcagtggtttctgcatctcacaattcatcgcggtacattactccacgagtattattgggccgcgtcggagtatatatacttctaattctaacttcattaattactgtttttccgttctttgtttgcttggttacatcatttgcgccgagcaaagaagtcaatgcctggcctccgaagctgattccgtcttctttaacgctggataattatgtacaattattcaaccgaattcctgtaggaacacagttcagaaattctgtgatttttgccggtttcgttacgctgttttctgtagcgtttgacgcattggccgcatacgcattgtccagactcgatttccgaggacggaatgtgttgttgttcgtgctaattgcgagcatgatggtaccataccaagcgctccttattccaacgtataagatgctctcttccatggggcttatcggtaattacaacatggttgccatgattttgcctcgtgccgctgatgttgcaggtatttttctactccgacaattttttatttcattgcctcgagatcttgacaatgctgctcgcattgacggggcgaatgagtttcgcgtcttttggtcgattgtgttgccgaatgcaaaacaggggctgtttacattagctttattcaattttatgaacaactggaatgatttgctttggccattaattatgacatctaagtctgatgatcgcacattgatcgcgggactttctctgcttaatggctccgttggaggagcgattccgtatggaatcatgatggctggcgcagttattgccgctattccgctggtaatcatattcgcctttgtccaaaagcaatttgtcgaaggcgttgccatgagtggtatgaaaggataatgaaatcatggttaatcaaaaagtctcgcctgtaaaaaagtggtttgagaataaagaaaaactcaatttttcattaggaattgaagatacttttattcctcagactcgtccaggtatgcgtgccttagatgaatatgagctaactaagcattatgaatgctggtacgacgatattggtcttatatcggagactggggcgaatcaaacaagatggggcataccttggtatttggtaaaccctgcgcctggcaaattccgttttgattggcttgaccgggttgtagaccgtttcgaagaaatcggtgttgatgtcatagtcgatcttatgcattatggaacaccgttatggcttgataatggttttttaaatactgattatccaaagtatgttgccgagtatgcggcaacagtggcgcagcgttatcagaaccggctcaatatttggactccgttgaatgagccattgttgaatatgatgtactgcggccaatatggctattggccaccgtatcttgttggtgatgatgggtttgttaagttgttccggcagattactaaagggatgattttaactcagcaagcgattagcgaggtgtcgccagaatctacattcgtgaatgttgaagcatcattccgattcgctggtgatgtggatgcatactctgatgaggtaggtttcctaaaacaacgcaggttccttgtggaagacacaattatgggtcggatgaattcgaatcatcctctctacggttggttatccaagcatggtattcaggatgatgacttccagtggtatctcgataattcaataaaaccggatgtaattggcgttaattactatcctcaggtgtccacagtgaagtatgtggcaggagatccgcatgatggttcgccatatgatccactgccattccaaaatgatggtgtcgaggggctcaaagatgtactgactttgttctcggaaagatacgaattgccagtatatttgactgaaacgtgttctcctggtcctgtcgaggaaagaatccgttggttgcatgaatcggtagcggctgtggatgaattgcgtgcagagggtatgaatcttattggctatacttggtggtctttgttcgatatgatgtattgggtttatcgagatgaggacaaacctgccgaacagtatcttgctcaaatgggattgtgggatctacgagcaaatgatcatctttcgtttgatcgtattcgtactgcagcagttgatgagtaccgtcgtttagtggaagcccatcgtaagtgaaaaggttgtaatttgcgtatgcacttgaagtaatatcgtgcttaaacacgatgaaaagatgccgcaggagttcttcgcagcggcatctttccatatctagtaattgagatatcagaactctgttgcaaactgttaatcgccaaccaccacaacaacggtggcgcggacgacgaatggtacttgttcgtggacgtgattccgtcgatcggataccgtccgatggtcagccgcgatctcgatcagggctgggtgccgttgcaggcggacgattacttcctcaccgcgcatacgaagcacggtggcgtcgcctcgctgacgcgcgccgaatacgaccgtcttgcccagcatgtgcatgcattctgacaaacgacgttgacgaccatgcgcccgcgtgtgcacgcggcaaaaccaagggggcttcccggaataaccgggaagcccccttgcgtatttgctgaccgcgacggcaatcgcagtcagcgactgctattgctgcgatgtatcgccattggcgccgttattaccggaattatcgtcactggttcctccgccattgccaccgttggtgtcgttaccgtcgccgttagcggggataccgccgctattaccgccgtcgccaccgccctgaccggtattctgcgtttcctcggtctgattcggcgtggtctgttgggtgttctcctcggtgcgcggagtcacggtggtctgctgctttctagtccaggtcttctgcgcgccggtgccccacgtaccgtccggtccgccgaccttgccgttatcggtggcgtcggggaacgtttcgttcggagtgtcggcaagggcctgcttcatgtattcggtgaacagatgcacggggtagtcgctgccgccggtccatcggccgaacgaagggatctgctgcggattgccgttggcgtccggataccacatcgccacagaagtcagcatggacggcgtatagccgatgaagctcgctgcgttggaatcgtttgcggtgcctgacttgccggcaatggtgtgcccagtggcacgcgcctcggtggcggtgcctcgctggaccacgccggtaagcgccttcgtcacgagattcgcgttgttcgcttcgaacgtctgctccgccgaggtcggcgcgttgtacaggtcggtgccgttcgccgtctgcacttgggcaacgatatgcagcgtcggcttgttgccttggttggccagtgtggcgtatccctgcgtcatgtccttgagggtcaggccgttgttgccgagcacggtgaacgggttggaaccatccaaagacgaatcgtcaacgccggcctgccgtgcggtttcggcgattttctgcgcgccgagcttggtttgcagatccatgtacacggtgttcgaggattgttccgtcgccgtgtacaggttcacgtatcccagattctcgccgccgtagttgctcaccgtttcggtgatgcccgggaacgtccggtacgagttgccgttgaagtacgtgttgaggctgacgccttcgttgacggcggccagcaatgcgaacggcttcatggtggagccgacttcgtacgttgcctgggtgacgttgttgagctgcttggtcaggtagtcgtctcctgcgtacagcgagatgatggaaccgtccttggggttcaccgacagcgcgccgaactgcatgccgtcgggcacgatgccttgcatgccgttttgggagggactgatggtggagaacatcaggtcctgcttcgatttgtcaatggtggtgacgattttgtagccgccggtttccaggtcctgcttgctgaacgccttggtgttgacgagttcgttctgcaccatcgtcagcaggtatccgttcggtccggacatctggttgttttgttggatttcgatggtttgcgggaatttcgcggctttcttctcgtccggcgtgatgtagccgtcttcgtccatgatgttcagcacgcgcttgtaacgtttttcagcttgcttgggattcacgtcgggggtccatacgctcggcgcgggaatgatgccggcaagcatggccgcttcggagagcgtcatatccttcgcgtccttgccgaagtacgctttggccgctgcctggatgccgtatgcgccacggccgagatagatggtgttcatgtagttgcacaacacctggctcttgtcctgtgcttgggcgattttgaccgccaggaacgcctcacgcagtttgcccacgtacgaggtggtttcgcccagataatagcgttccgcatactgctgggtgatggtggaaccgccctgcctgctaccggtggtcaggttgttgtagaacgcgcgtgcgatgccgattggatcgatgcccttattggtatagaaggagcggtcttccgatgccacgatcgcgttgccgacgtagtcgggcaggtctgcgcagctgatgatttcgcgattctgctccgcatagctgccgatcggcgtggtgccgtcgttgtagtacacggtcgtcttttcggccagcgcgaacttttccggctgtgggatttccgtggtgatgtacatgtaggcgaacaggccgatacctgccgcgatgagcgccgcgaagatgccgagcacccatttgagcacgagatgcttgtgttttctggtctttttgggtgcgcgatgcgaagtgtgcttcggcccctggggcggcttgctcagcacttctccatggaccccgtaggtggtgcccacccgtggcgtcgtggacgttgcgctgccgctgcgggcgctttttgagcgtgagctgacacttcgtgttcgtgaaaccatggtttccaccgtagccgaacgacctgaaaaacaagggtgtagatagtgctgtccgactggaaaaacatgtttttgcgcagcttttttacaaatcgacaatctgttgacgactgccgtaatatggccgtttttcagtgatttttcagtttacaatgcggtttgtgggtatgcttggggattggtatacctgcgaaacgcataacagaggagtcgttttcagatgagcattcgagtggctatcgccggcgtgggcaattgcgcctcgtcgctggtgcagggcgttgagtattacaaggacaccaaggacgaggataagattcccggcctgatgcacaacaatttcggtggctaccgcgtgcgtgacatcgaattcgtcaccgcgttcgacgtcgatgcgctgaaggtgggcaaggacctgtccgaggcgattggcgcttctcagaacaacaccatcaagttcgcggacgtgccgaatctgggcgtggaggtgctgcgtggcccgactaacgacggcttgggcgaatactaccgccagatgatcgaagagtcggacgccgaaccggtggacgtggcccaggtgctgcgtgacaagaaggtcgacgtgctggtttcctacctgccggttggttccgagaaggcggacaaggcttacgctcaggccgctatggacgctggctgcgcgttcgtgaactgcctgccggtgttcatcgcctccgatccggagtgggcgcagaagttccgtgacgctggtgtgccgattgtcggcgacgatatcaagtcgcaggtcggcgccaccatcacgcaccgcgtgctggcccgtctgttcgaggatcgcggcgtgcgtctggatcgtacgtaccagcttaacgtcggcggcaacatggacttcatgaacatgctgcagcgttcccgcctggaatccaagaagatctccaagacccgcgctgtcacttccgtggtgccgcacgagatggatccgcacaacgtgcatatcggcccgtccgattacgtggcttggcttgacgaccgcaagttcgccttcgtgcgtcttgagggcaccacgttcggcgatgtgccgctgaacctcgaatacaagctcgaggtgtgggattccccgaattccgccggtattgtgatcgacgccgtgcgtgcggcgaagatcgcgctcgatcgtcatctggccggtccggttctggctccgagctcctacttcatgaagtctccggccgtgcagcacgaggatggcgaggcccgccgcttggtggaggaattcatcaagggtgaggtcgaaggcaccgaagagcagcttgacgccgatgtggcggccgcgaaggccgccggcaaggatgtgtggcgcgcatagcgtgcgttgctgacggcagacccgcgatggcaatggcaaccatctcgtaggtctcgacccactcgcctgattcgtaggcagaatcagcatataatgaaaatccctatggcctggggtaatgccatagggatttttgttgtcccggaaacgctgcggcggtggcggccaatggtcgtgcgccgtcgcagcgtgaacgggaatcatatattgcgcaatgtatatcgcgtcactttttgaggagtggttcgacctgttcctcgtacgcggtcaacgcggtgtcgatcacgttgtgcatgtcgtaatacttgtacgtgcccaaacggccgccgaacacggtcctcggctcggccttcgcgagctcctcgtacctcgcgtacaacgccttgtcggcctccgtgttgatcggataatacggctcgtccccgcgctcggcgaaacggctgtactcctcccacaccacggtcctgtccgggttctgcgaagccctgcgctccgggttgaagttcttgaactcgatcgcgcgcgtgtacggcacgtccgggtcggagaagttcatcaccgggcatccgaaatggtcgccctcgtcgtaacgcacctccctgaagtccaccgtacgccacttcagctcgcccagcgagtagtcgaagtagcggtccaccggacccgtgtacaccaccggcacgcccgccgcggccagcgccttcctgttgtacggctgggactcgtcgaagaagtcggtcctgagggtcacgtggatgcgcggatcgtcgatcatgcgctccatccaggcggtgtagccgtccgtgggcaggccctcccacgtgtccctgaaataccggttgtcgtagttgaagcgcaccggcaggcggttgatgatgcccgcgggcaggtccttcggatcggtctgccactgcttgcccgtgtagttcttgatgaacgcctcgtacagcgggcggccgatcagcgaaatgcccttgtcgttgaggttcttcgggtccgtgcccgccaattcgccggcctgctcgtcgaccagggccttcgcctcggccggcgtgtagtgcgcgtggaagaactggttgatggtcccgaggttgatcggcaggggatacacctcgccgtcgtgcgtggcgtacacgcggtgcacgtagtccgtgaagcttgtgaaacggttcacatagtcccagaccctcttgttggacgtgtggaacaggtgcgcgccgtacttgtggatctccgcgccggtctcctcgtccatgtagctgtacgcgttgccgccgatatggtcgcgcacgtcgatgatctcgaccctcacgcccaggtgctcgacggcctgctgggccacggtcaggccgaacaggcccgcgcccacgaccaccagatcgggatactccaccgcatcagtcataacaaaacaaccttccaaacgttatcgatgcttatcgcagccacgcaaacgcacaggggcggcgtgcgattccttctcaagtgtacccgtgcgtctagtcggtgcggcgaggtccgggcatggtgtaatatggcaagagcctccgcgtggcggtatgtcacccaactcccccagggcaggaatgcagcaagggtaagtggcctcttccgggtgcgtggaggtttttctatatcttctccgattcgttccccacagtaggggcgatgccgtattctcggtgactatgaccaacgaattcaagccacttgtccgagatccacagcagcctgtgaacatgcttcagcagcccacggcagcaacgcctgcggaaccgttggaatcgttgtcgttccctgatatgcgcgaagtcgaggcggtgctttctccgcaggatgtcaacaaaggcttggctcaggtggatccgctgacccgccatccgcgcgtgtccagcatcgtgctgtgcgtggtgttcggtctgctgatgcttgccgcttccgccggcgtctggtggcttggcgtgcgtaccatggacggccaaagctatgaggatatcgtctggtcgaaattcgatgccgcgttgccgggttggctggcgccggtcgtgcacgtcttcgccatttccgcagtggtcatcaccgtcagcgtcatcatgggggcaatcgcgtttgccgtgctgatcgtgcgcaaacggtggctgtcgatcgcgcagctcgctgtattcggaggcctgtgtttcgccgcggccgaactgttgaagccgctgctgccacgcccgtatcttattaatttggaatcgaatcctaataattccgcgtcttccgggcatgtcatccttgccgctgcggcaagcgtgatgctgctgtgcgccgtgccgcgcgtgctgcgtgcgctggtggcggtgattggttgggcgtatacggtgctggtcggattgtcggtgatcgcggcgcaatggcatcgtccgaccgacgtgattatggcgctgctgatcgtcggcggactggcgttgctggcgcttgccaccacgttcgccagcggcatggatgagccgggcacgcgcgtctcgtcggcaagcgtgcagatcgtcggcagtgtgatgctgacgattggcgtattgggcatcctgtacggcgcgtatatcatctggcagattcagccgggactcgccatgagcgccgaatggacgaatgccggcgcgtacgtttccacggcgctgctgacggccgccgtttccgcgctggtgcttggcataacgctcgccatgcgtcagctgaccgcctcgccgttgacgaaactgggtttggtgggagcgccgcccgcaccgccgaagcgctgaaaacagccggttccgggcatgctgccgtccatacgccacacgggcggtttgccatttctccgtattcagtgagtattattgcgttgcaatcactagtaataaggagtggctatggctaccggcagcaagctcgttattgtggagtctcctaccaaggcgaagaagattggcggatacttgggctccggatacacggtcatggcatcggtcggccatatccgcgaccttgcccagcccagccaggtgccggcggccgagaaagccaaatacggcaagttcggcgtggatatcgaagacgggttcaagccgtattacatcgtggacggcaacaagaagaaaaccgttgccgacctgaaaagcgcgctgaagaaggcagacaccctctacctcgccactgatgaggatcgcgaaggtgaggcgatcgcatggcatcttgtgcagacgctgaagccgaaggtgcccgtcaagcgcatggtgttccacgagatcacgccggaagcgatcaaggcgtcgctgaacaacacgcgtgatgtggacgccgccatggtggacgcccaggaaacccgtcgtattctggaccgtctgtacggctatgagctgtccccggtgctgtggcgcaaggtcggtccgggcctatccgcgggccgcgtgcagtccgtggccacccgtctgatcgtggaacgtgagcgtgagcgcatggcgttcgtgcgtgccccctattgggatgtcaccgccacgctggaagcgcccgacgccgacggcaacaatgttgcgttcgattctcgcatggtgtcgcttggcggccgtcgtttggccggttccaaggatttcggcgatgatggccagctgaccgccgccggcgtcaaagacaacgtcgtgcagctggacgaaacgcacgcgaatgcgatcgcgcgatcgctggaatatgcgacgttcaccgtctcgtcgatggaaaccaagccgtaccgtcgccgtccggtgccgccgttcaccacgtccacgctgcagcagacggccggcaatcgccttggcatgagctcgcgccagaccatgcgtgccgcgcaggggctgtacgaaaacggtttcatcacgtatatgcgtaccgattcggtgacgctgtcgcaggaggcgatcgcggccgcccgtgaagcggtgtcgcggcacttcggcgaaaagtacttgtccgatgcgcccaagcagtacgccacgaagacggcgggcgcgcaggaagcccatgaatgtatccgaccggcgggcgcgcatttccgcgatccggctgaaatcgccaccaaagtgccggccgaccagctcaagctgtacaccctgatctggcagcgcacgctggcctgccagatggccgatgcgaccggttccaccgccaccgtgcgtctgtcctcgccgaccgaagccgacggcgaggccatgttccaggcgtccggcaccgtcatcgaattccccggcttcatgaaggccaccggcgagggccgccgtagcgttgtcgacgcgaagaagagcgccgaggcggcgggcgtgaagattggcgataaggccgaaaagtctgcgaaggcttcgaagaaaaccgatgacaacgtttccctgccgccgatgcagccgggcgacgagcttgccgccgtggacgttgccgcggacggccacgagacccagccgccggcgcgctacaccgaagcgtcgctcgtcaaaacgttagaacagaaggaaatcggccgtccgtccacgtatgcgagcatcatctccacgatcatcgaccgcgggtacgtgtacgagcgtggccgtgcgctgattccgtcctggctggcgttctccgtcaccaaactgcttgaaacgaagttcccgaagtatgtggattacgagttcaccgccgatatggaaaccggcctcgaccagattgctggtggccatgagaccggcaaggcgtggctgacccgcttctacttcggttccggcgatggtgcggcccagtccgccgacgaggcgcatgagggcctgcagcagcaggtggcgcagcttggcgagattgatgcgcgtgagatcaacaccatcgatatcggcgatggcctgcacgtgcgcgtcggccgttatggcccgtatcttgaggacatgaagcatctggatgcggaaggcaatccgaagcgcgcctcgctgccggatacgctcgctccggatgagctgaccgtcgaggtcggccacgatctgattgaaaaccattccggtgggccgcgtgaactgggcaaggacccggtgtccggcggcaccgtcgaggtacgcaatggccggttcggcccgtacgtggcgttggtcatgccgagcgcggaagatgccggcgataccgctgccgagtccgccgcaggcaaggcgggcaagacgaagcgttccggcggtaagaaggcggcttccgaccgtccgaagatggcgtcgctgttcaagacgatgagtcccgaatcgctgacgttggaagacgcgctgaaactgctgagcctgccgcgcgaagtcggctcctacgatgaggcgaacgccgaaaccggcgaaatgcaaacggttacggtcatggccaacaatggccgttacggcccgtacctgaccaagaccggtgccgacggcaagtccgacacgcgttcgctggcttccgaagacgagatcttcaccgtcgacttggagaaggccaaggaactgttcgcgcagccgaagtacggacgcggtcgtggacgtggcgcggccaagccgccgctgcgcgacttgggcaccgatccggaaacccagaagcacgtgaccatcaaggacggcttctacggcgcgtacatcaccgacggcgagacaaaccgtacactgccgaagcagtatgcgcccgaatcgatcgaaccggccgaggcgttccgcctgctggcggagaagcgcgcgcaggggccgtcgaagcgtcgtggccgcaagacggctgcgaagggagccaagaagggcgctgccaaaggagcgaaatccgcgaagaaggtgagcgcgaccgaacaggcgcgtgccgaccgccgtgccaaggtgcgtgaactggccgacaagggttgggcgaatacgcgtatagcgaaggagatcggctccaccgcgtccaccgtgaaggctgacgtcgactggctgaccgccaacgaaggctacgcgcgtcctgaagtcgttcccgcacgctgacgttatgcggcgcgcgaaacgtcgcacgatctgatgttccgcaagacaatcggcatcgtgcgacaccaagccgtgggccgaatggccgggcacggcaggggcgcacggtacagtgaaaggcatgcagggcacttttatctcgtttgaaggcgttgacggcgtgggcaagaccacgcaggtcgaacggttgcgcgcatatgttgaatctcagggccgcgaatgcgtggtcacgcgcgagccgggcggcaccgcattgggcgtggcgattcgcaaaatgctgttgcacggcgtggatacgggggatgagaacgattgtgccgacatcgccccgcgtacggaggcgctgttgttcgccgccgaccgcgcgcagcacgtcgcggaagtgattctgcccgctctgcaacgcggcgcggtggtcatcaccgaccggtatctcgattcctctttggcgtaccaggcgggcggccgcgagctgacggccgcggaaatccgaaacctgagcatgtgggccacgaacggtctgctgccggaacgcacgtatctgctggatatggatccggcgcaatcgcatgcgcggctgcagcatgccgaagaccgcatggaggcggccggcaacgacttccagcgtcgcacacgcgtcgcgttcctcgacttggctgaacgtgagccggaacggttccacgtcattgacgcaagccagtccatcgaagacgtgtgggcgcgtatcaaagccgatttcgacaccgtgagcaccgctgacgggggtatcgcatgagcgtgtggaactccatagtaggccaagcgcaggtggtcgaacagctgaaggccatcgccagcggcgacccgaaggccatcgcgcagtcgtggctgatttgcggccctcccggatcgggccgttccaacgttgcccgcgcgttcgccgccgcgctcgaaagccccgatcatggcctgaacgatgagccgaccaaaaccaccgagcaggtgcttgccggcacccaccccgacgtgagcgtgctggccaccaacaaagtgaccatcggcatcggcgaggtgcgtgacatcatcaccacatccgagcagatgcccggcaccgcgccgtggcgcatcatcatcatcgaagacgtcgaccgcatgatggaacgcaccaccaacgtgctgctgaaggaaatcgaagagccgagcccgcacaccatctggctgctgtgcgcgcccagcgcccaagacgtgctgccgaccatccgctcgcgcacgcgcatcgtcaacttggccgtaccgtccaaccaggcggtggcgaaattcttggaatcgcaaggtttcgagccgaatatcgcggcgcgtgcggcacgattgtcggaggggcacatcggcatcgcgagcctgtatgccaaggacgaacgcgtcatgacggaccgcgacgagctcatcgtcggcgtgctcggcttgcatcgcgcgtcggatgccgtgctattggccggcaacctcatcgacaacgcgaaggcgcaggccgaagcggaagtcaacgtcaaagcgtccgaagcggaagccgatttccgccgcatcaacggactcggacccaaagaccgcatacccccgaaactgcgtggcgcatacaatgcgatcgccaaaaaagacgagctcaaacgacgtgccaccagactcacgcgtgacgtgctcgaccgtgcgctcaattcggtcgccagcatctaccgtgacgtggcggtgctgcagaacaacgccgaggacgcggtggggctcatcaacctcgaaaaccgttccgccatcacggaattgtcggtacggctcgaccgtgccggagccgtgcgccggctggagaacatcgccaccgcgcgccgcaggctcaacggcaacggcaatccggttttggtgttcgaagcgctgttctgcgcgccgattccgtgattttcgtaatttccagtaattaccggcgattcgattcgcgattcaccggcggaacaccgaggaatcccgcacaataagctgcggggcaagcatgactcggggcgcgcgcacgctgccgcctggcgcagcagccgtctccgccgcgcctccggcaggaccggaagccagcaatcgtaagcattccgacacaatacgctcaaacggcgcacgcaccgacgtcagccgaggcatggtggtacgcgcgatggcggaatcatggtagccgaccaccagcacgtcctccggcacgcggattcccaacgcgtcgaacgccaccatcacgccgaacgcgatcgcatcgtcggcgcagaccacggcttccggctgtacgagcggcccgttgaacagccgcatggcgcaatcgaaaccgcgctgcacggtacgttcgccgaactggttccagttttcgctggtgacaagcccgtaagtgcgcatatgcgtgtggaatgtggcgaacagttccgccgattcgaaagacagctcgtcaccggccatatacgcggcggacgcgatgccctgctcggccagatgtttgacaatcgcctccatcgcggcgttttcgtcgatgcctaccacggacacgcgcggcgcggtctgccgtccgcagatctgcacgatcggcagcgtgttcgcgtactggttcaacgttccggcaaggtccgcgccggccgcgggcaccacgatcagcccgtccacatggcggttgaccagcgattcgatgcgttccgcctgcgcttcctgcgtggctccgatgcccagcagcagctgttgcgattcggtgtcgatggtcggctcgatctcgtcgagcagttgcgcggagaacggttccgtggcgctcggaatgaccagaccgatggttttcgttacgtcgctgcgcagcgcgctcgccgcgtagttgacggaatagccgagttgtttggcggcttcgcgcacgcggcgggcgatatcgtcgtccttgccgcgtttgccggacagcacgcgtgagacggtggcgatggacacgccggccgtcgccgcgacgttggtgattgagctgccgctgtcggttctgcctgccatgcgctgtcctttccgtcgtgtccggcttgcgtttgccggctccctaagtgtttttcaaaatgccctaaagggtgccctgaacccctgtgtgcttctcggtcaaaggtctggtctgatgaaccggttcgagccgcgaagagcttattaagaatagaacgaccgcccgtcgaatatggcgggcggtcgaaacgttcgtacgtcagtgcgtcagtgcgttatgcggtgcgtcactcggcgttgacgaggatgttggccaggttgtcggccacggcctcggcgttgtcgccttcgacgttgatgaccacggtgtcgccctgcttgatgcccagacccatgatggacaggatggagccggccggaacggcgttgccgccttccttggcgatggtcacggtctggccggaagcggtgacggcctgtgcgaacatggcggccggacgggcgtgaatgccgaccggatcgttgatgacgagattgcgggttgccataatggtctcctttgttgtggttggtggttggtttgcttacgttgggttgtctcgatatttacacgtcgatgtatatcgatttttgcatatcgattgcattatgcggcttttgccggcatctgcatttcttgcgattatcatagcacagtttttacgaaacacagaaaacgtttaccggttttgttttgcgggaatttcgtgtatactaatcgcaggctgaaaatgatttaccggcaaagacggtggggatcattgcagtaactcacctatgcaaggcaggcataatcctgcaatcgtttgcgtatccatattttttccaaggaaacaggaaaaggagttctcatgaacattaagggtgttggtatcggtcgtggcgtcgcagtcggcccggtcattcgcatggccgctccgctgccggaaccgtcggacgctccgcgcgccgaaaacatctccgcggaaaccgaaatcgcccgcgtcgaaaagtcgctcgccctcgtcaacgccgacctgaaccgtcgcgccgaagaggccgccaacggcgacgaaggcgccaagcaggccgccccgatcctgcaggccatcgccatgttcgcctccgatccgtcccttgcgcagtccatcaaggacctcatcaaccagggcaagaccgccgagcgcgccgtgctggaaggcttcggcgcggtcgaagacatgttccgcgccatcggcggctaccaggccgagcgtgcagccgacctgcatgacgtcggccagcgcgtgatcgccgacctcatgggcgctcccgctccgggactgccggtcagcgaaaccccgttcgtgctcgtcgccgaagacctgtccccggccgacaccgccgcgctcgacatgagcaagaccctggccatcgtcacttcccagggcggtccgacctcccacaccgccattctggcgcgcgcccgtggcatcgtcgcggtcgtctccgccgccgaagccgccgaacttgagaacggcaccaacgtcatcgtcaacgcagccaagggtgagatcgtggtgaacccgagcgaagacgagattgccgccgccgaagccgccaagtcccgtgccgccgcagccaaggaactgcgtggcaagccgggcgccaccaaggacggccatctgattccgctgctcgccaacgtcggcaagccgtccgatgccgcgaaggcgctggaatacggcgccgaaggcgttggcctgttccgtaccgaattcctgttcatcggcaactccgagccgccgagcgtcgaagagcagaccaaggcctacaccgagctgctcagccagttcccgggcaagaaggtcgtgatccgcatgctcgacgccggcgccgacaagccgctgccgttcctgactccggaagacgagccgaacccggccctcggcctgcgtggcctgcgtaccctgcgcgcccacatggacgtgctcgaaggccagctcaaggcgctcgccgccgccgacgccgcaaccgacgcgaacctgtgggtcatggccccgatggtcgccgaccagcatgaggccgactacttcgtcaagctcggcaagagcttcggtctgaagttcgtgggcgcgatggccgaagtgccgtcgatcgccctgatggccgacaaggtggctgacgtggccgacttcgtgtccatcggcactaacgacctgacccagtacacccttgccgccgaccgtaccctcggctccgtggccaactatcagaccgcatggcatccggcggtgctgcgcgccatcaagatgatctgcgacgcgggcaacgccaagggcatgccggtgggcgtgtgcggcgaggccgcggccgatccggatctggcggtcgtgctggccggtctcggcgtcaactcgctgtccatgaccccggtggcgctggacgatgtgcgcgcctccctcgccgaagtcaccttcgaagaggccaaggccaaggcggccgcagccctcaatggcgacttctacaagccggccgagtgatttcccttctttccttcactcggctattccggactttgcggctgcgtcatcgcggccgcagggttccgccactgcaaatgtgcctatgagagcgattcggttctgatgggccctgtttcccggaatgaccccgtttcgtgcgatcgccgcgcggacggggtcgtttcggttgcgggttgtgtcgattgctgcgattgcgtcgattgcgccaccggcgtagacgcgtcatacggccgcgtcgcgtcacgcgcatgcgcgatactggaagcatgaagatttccgcagatttcaccgtcattcccgacgcgttcgccaaggcggcgccgcctgagaactgcatcgacggcactccgattgtttccttccccttctatatcgacgagctcgacccgtccgtgcagtttctgcattgggaattcgtcgatcccgattccattccggtgtgcggtttccagtggaaccattggtcgctcgccaatctgcccgtggacgcgctgatgtacgatttcaacgattcacatgcattggcgattccggccgatttttcccgcacggtttccgcgatgattcccgagacggtgcagggacgcacgtccgccgcatcgccgttgttgaaaggccgtagcgacgatcccgccgtcaccatgcgttacaacggtccgtatccgcctgatcgggatcacgaatactacctgcacgtatggggcaccaccgcgcctctcaatggtctcaatcaaggcttctggctcaacgagatggaacgcgcgttgcgtaattccggtgcgatcgcggaccaaggcgctatcttcctgaccggcaaggcgtgaccggcgaaaccggcgagaacagccggcaaggcgcaaaccgcgtaatcgcaagataataccaaagaataccgcaaacgtaaacaaaacaaacgaaaggaacctacatatatggcatgcaccacgattctggtcggcaaggacgcaagctatgacggatcgaccatcatcgcccgcaatgaggacagcgcgaacggcgaattctgcccgaagcgcttcatcgtcgtcaagccggacgagcagccgcgccactataagagcgtgctgtcccatgtggaagtggatctgccggacgagccgttgcagtacacggccgtgccgaacgcggatctgaaggaaggcatttggggcgaagccggcgtcaatgaggcgaatgtggccatgagcgccaccgaaaccctcaccaccaacgagcgcgtgctcggcgccgacccgttcgtggaactcaccccagccaaaggcaagaaaggcgaagacggctacgagccggaagtgcccggcggtatcggcgaagaggacttccttaccctcgtgctgccgtatgtcaagaccgcccgcgaaggtgtaacccgtctcggcgcgctgctcgaacagtacggcacctacgagatgaacggtgtcgccttctccgatgtggatgagatctggtggcttgaaaccgtcggcggccaccactggattgccaagcgcgtgccggacgaagcatacgtgaccatgccgaaccagctcggcatcgacgaattcgaccttgacgatgccctcggcgaccaggaggagcatatgtgctccgcggacctcggtgaattcatcgaacgcaaccacctcgacctggccgtggagaacgtcaccccgttcaatccgcgtgacgcgttcggctcccactctgattccgaccatgtttacaacaccccgcgcgcttggtacatgcagcgcttcctcaacccgtacgacgagcagtgggacggtcgggacgccgaccaccagccgacttcggacgacattccgtgggctcgccagcccgatcgcaagatcaccatcgaagacgtgaagtacgtgttgagctcccactatcagggcaccccgtacgatccgtacggcaagctcggcgaccagcattcgcgccacatgttccgtccgatcggcatcaaccgtcagagccagctgtccgtcatgcagatccgcccgtaccgcccgcaggtcaaccgtgccgtgcagtggatcgcctacggctccaacccgtttaacacgctcgtgccgttcttcccgaacgtcgactccacgccgaagtaccttgaggacaccaccacgcgcgtcacctccgagaacttctactgggagaaccgcatcatcgcggccctgtgcgacgccagcttcgccgacaccgccaacgcggtggaacgctaccaggagaagaccggcggcatgggccaccgcatggtagccgccaccgacgggcagatcgaccgtctggtggaagacgtcatcgacgaattcgacgcggacgacgagactggcgacgtgcagccgatggaaccggacgaaatcatcgaagccgtccgcaacggcgaggcgcgcgaagtgctcgccaccgccaacgagaccatggccgcgcagcttaaggcggaaaccgacaagctgctcgactccgtgctctacaccaccagcatgaatatgaagaacggcttccacatgtccgacttctgatcgttccctgatgggatggccggtatttttccgcgattgcatatcgttgcataacgccggaaataccgccaagatcaacggctcccgcactgcgctcgccaccgtccgttccgtatgacggccggacggcgtccgctgtatgggagccgttttctattgctgacgctcgttcactagaatgttgcttatctgtgttgttccggccatgttcggcgctcgacgccgcctggcggaaggcttcaagaaaggactccagtgaccagcattgaggatttcatcagccaatacggtctggtgcagaagattgatgcgttcggctatctcgattatctgaagagcaatccggatgcgccgcgcaagcatggcaaggtcgtcctcgtcaccgccgacaccccgttgaaggcgtcccgcggtgagggcaagaccaccaccacgattgcgttgatcgatgcgcttcgtgagcgtggcatcgacgcggcagccgtgctgcgccagccgagcatgggcatcaccgcagccggttccaagggtggcgcgtcgggcggcggcaaggcctccctgacccacccggagctgatcgactggggtctgtgcggtgaaatgggagccatcgaggccgcccagaacctgttggtctcctttgcggagaaggctgttgacgacggcaagctggacaccatcctcgtaccgcgcgtctccgaagtgccgtcccgttccctgcgccagatcgcagtggaccgtggaaagggcgacgtggctgagcgtgtggtgctcaccccgacctgcgagctcatgcagatcgttgtgctgtcgcgttccatggatgagatctccgagcgcgttgccaagatggtcgccggcacgaaggatggcaaggccgtgaccttcggcgaattcgttgacctgtggcgtatcaccggcatcctcggcgacgccgtgaagccagccaagacggagaccgtgaacggctctccggtgtacgtgcacggcggcccgttcgccaacgtgtccatcggcattccgacgctggtttccgtggaaatggcgtgcgcgctgcatgacgtggtcatcgtcgaagccggttatggtaccgacgcaggcgcgcagaagtggcttgacatagcctgccgcgaatacgacgcgcagtggccgtccgcagccatcgtcgtgacccgcgcttccacgtggcgtgacgatccggatctggcatggcgctacccgttccacgtccagcgcctcgaaggtcttgatattcctacgttcccgctcatcaacctgtgggatggcgaggacgaccagattccggcgctcaaggccacggccaaggagctggaattccgcgacccgatcatcggcaacctgtaccgcgacggtggcgacgcgctcgccccgcagctcgatgcgttcgtcgatgccgtgacgaacggttctatgccggccgaaccgcacagccacaagggcatggctctggtggagaacgtgcgttgggtcgccgagaacgcgtatggcgttccggccgaccgtgtgattctgaaggacggtttcgccgagtcgttgcaggccgccgagggtctgtgcgccagcgcgggcatcgatttcggctcgcttgctctggtcgcggtgaagtctccggccaccatgaccgacaacgaccgcgctccggaagccgagcgcaccgtcacgctgaagaaggtcgaagtgcattccggcgcgggcctggtgcacgtgaacctcaccacgtcgctgaccaccccgatgccgaagatcgtctgattttcttgcgattgcgccgcgtggcggtacgtcccgtaccgtcgagggcgctcgctaatcgttgattcggcgtaaatacaaagccgctggtcccgttcgggccggcggcttttttcgtgggtgatacctttacgttgtccgtttgtgggtgcgggcgtgcttgcatgtgcgcccccttttgctcacgagttgcggaatggggcgatttttctctcttatgagcaaaagggggtatgattactgacgattttgctggttttcataccccttttcgctcacgtcccgtagaaaaggcccgtttctcgcttttgtgagcggtcgggggtgctgatattgcgatttccctgccgtagtcaggcgagcttcctagacgtgcttcccgtaggtgaggtgagaggtttgcaatatgggcaaacctcgaaggaacggtggaacttcgttaagaagccgagatcagaagttgccgccgttccaaccccagtcggtcgtggcggtgtagcggatgtaagtgcggtcggccggaatgcccagttccttgcccagcgcggccatgatctgctccgtcagcttctcccaggcggaacccggcacggaacggccgaacacattcacttccacgtatgcggccggcttggaatcgtcaccgccgaaataaatcggcatattgtcttcgaacgggcacatcagccagccttcagacttgccgggaacggcagaaatcgccttgccgtaggccgtcttcagcgcctcgcgctgcccaggggtggtggatacggaaacgtgcgtgtggatgactggcattgctgctccttgcaatcgttgaaatatattgttcttcgttacccaagtttaggtggtctgcgcgcgagtgttaaatatcccgtgtgagaaaactgattgaacagcttatgaaattcggcattgtgggtgtgatcgccttcatcatcgactggggtattctaaacattctcgtcggcgccttccacatgcacaacgtgctcgccgccaccatctcgtttatcatctcgttgatcttcaactatgtcgccagcatgaagatggtgttcaagcaccgtgaggacatggctcgctggatggagatcgtcatcttcgtggtcggcgcggtgatcggcctgtttatgaacgacgccatcatctggatttccacgtacggcatgaaccatgatgcgtatgtctctcaaagcgccgaatatctgatccgtaccaacgtgggcaagcttatcgccaccgccgtggtgatggtgtggaacttcgtgacacgcaagtggttgttggacgatacgcataccaacgccacgaaccgtctgaagaagaaggaaaaccgcctgagcccggaggagctggaggccaagtgggagaacagtttctcgcacaagctgggcgtgtggtcgctggaacatacgccgaagggctggccgaagtagctggcggcgtttcgtatacggcatacgaaaaggcgcgtccgaatcggatttttattgcgattcggacgcgcctttctgcggttggcgtacgtttcctgggattgccggctcggttatacggttcacgcactcacgttggtaagcgtcggctgttcggtggattctttgatctgcttgaatccaagcatggcgatcgccagcgacgtcaacgccaacgccgtcaccacaatgaaaccgccccgcgagcccatgcggtcgatgaactgtccggcgatcgcggaaccgaccgaaccgccgatcgaattcattgcgcccatccaagccataccctccgtgaaacgtgtgggcggaaccaggtgcagcatcagctggttgccgttcacccacgtcggagcctggcagacgccgatgcacaggtagatgatcatgatcacccataaatgcttggcgaacatgaacgaaccgattccaagattcaccaccgcaagacagaagtagaaacgcttccacagtggaatcgtccaatttttcgcaccatacacgagcgcgccgatcagagagctgaacgagaagcaggcgaatacgaaaccggtgaactgcttcatatgcgcctctgtggcgaacgcgacgatcgaaatgcctgcggccgactggaacgcgcccaaaccgaaccacgtcacgcacaccgcaatcaggcccggaccccaaatcgattccttgctgcctgccgcaatatccgtggcggccttctgcatcgcggccttcacctcagcggccgtcttgccttccgcacgagccttgtcgcgcgcgtattctactgccgcttcggtctgcaaagccttggaacgggccgtttcgcgctcacggtactccttacgcgtcataccggcctcgcgtgccagctgcgtctgcgacttcggttcggtggttagctccgtcaggaacatcaacgcgccgaccaccacgcatatgccggtgaatgagaacgccagcagacctgaaattacggccaaggtggatgccagcggattgccgatcacccacatgcattcgtcgaatacgcctgatagggacagcgcgcggttcgttttttccgcatcccctttgagcaatgtggtccaacgttgacggctcatcgcgccccacggcggaatcgccgccatgaacggcacgatgcagaacaggatccatgacggtacgcgggcggtgatgcaggataccagcgaaatcgcggcgaccatccacacgatgattgtcggaatcgacacctgccgttggccgaacttgtctaccagcttgccgagcaccgggctggtcacggccagcgcgatcgcctgcactgcggtcagcgcgccggcaagcgaataattgccgtagtagtgctgcacggaaatcgtgatcgtcatgccgaccatcgggaacggcatgcaggcgatcaccgagccgacggagaatcgtgcggtgtgcggtatgcgaagcagctccgcataccctccgaaaagacgttggccgatgtttttgacgccgacgaggacattgttggtcatgcttgccgctcctttccgctcacggtttcgctcgtgacgtccgcagctttgcgtcgcgtgcggactgatggtggtggttcccctgaattattggttaaccgcttccgataccagctcgctgccccagccgtccgaacacgtcaatcgattgacatgtttgacatgccgcacacggggagaaaggtgggatggtgcgtgttgtttgtgtgtctttgttgaccaaggcaactttatgcgcaggtaccgtcgtgacacgcggtacattagggcaggaaccaatattcgaatcgacgaattttttcacagggccggcgaccggcgaaacgtgctgagccagcacgtggccggcaggtccgaaacgcaagaaaggcggccaatatgccggcgacaaccatccatttcgtgcgccacggcaaagtggagaaccccgggcacctgctgtacgagcggctgcccggtttccacctgtccgacgtgggcgtgcgcatggcgcaggccaccgcgcattacatcgcggtcagcccgcagctgaacaccgtatccgccgtctactcgtcgccgctggaacgcacgcgcgaaacggcgggggagatcctcgaatcgctgaattcggtacgtggactgcgcggcgaggaaccgctggagctgcagacggacgaacgcctcatcgaagcgcgcaacgaatttcgcggcaagcgtatcggcttcggcgaaggcgcgctgtggaagaacggcaactggaagctggtacgcaacctgtggaagccgagctggggcgaaagctaccagtcgatcgcgcatcgcatgcaggacttcgccttggagaaagtggcggaatatcccggcaaacagatcgtggtggtcagccacgaatcgccgatttggagctaccggcacatgctggaaacggggcaccccgaacacaacatgctgttgcgccacaccgcgctcgcttctatcacctccatcacttacgattgcaataccgggaaaataatgtccattacgtacgccgatccggcggcggacgtcgaataatgtgaaccaaaacatgcggtggctcaatcgcggtcggggatgactgcggttcgggccggccgcacgatatacaaggagaaagtatgtcttttgtatacgaccagaaggtcgtcgactcgatgtacggctcgcacgtggtctccatggcagttgactacggtgtcgatctggtcaagatgtggccgttgcaaacgaaccaggaactggaaaacgacgtcaaatatgcggagaacctgcaggtgatgttctccggcatgatgacgcaggtgccgctgaaacgctccgaagaagtcgaccagtcggttgcggaagccgtatacgaaggcatggatgtgcttcccggcgtcgatccggaaatcatccgcacgctgatggacgccaaccacgcctatgacgtgatggcctcctaccacggggtcgacggcatcgaactgttcatggaaaccgccagaatactcggcatcgacgtggagacccgaatcgaaaaggaaatccaagacctcatggagaacctctcacgcactatgcgcagcgcctccggattcgaagtcgacgatgacgtggcggaaaacgtcggcatctgccagtcggccacggtggaccgcaacgaattcgcaagacgctacctcgcctcgatgacggttctcgacgcgctgataaacctcatgtgctatggcaccgacgattcgcaggagcaggccatccgcgtgctgccggtgctgctgttcgtcaacgccatgcgcaaccagctgtcgattccgcccactttcatcaacgccgaacagctcatcaacctgtttggtctgcgtgacaccgcccgccagttcggacggccccagtcggtgttcgacagctcgttcaacccgctgacgttctccaccaccgtcaagtacctcgctttcttcgcggggcaggaatggctgcggcatatgaggttcctggagtgggacccgaagcaggccgaacaggacgccaaagacgaggacgagcgcaaaagcagggaagcgctcgcaaagaaatacaatttgacgagcgatggcgataacgcggcttccgacgcggatttggattcgtctgcagactcgaatttgtctgaggattcggactcgtcggaagaggccggttcggagccgaccgaggaataagtgttgcgggcggtcgtgtgacgtctgacggtgaaggctttgcgtgtacttgcgtggcgtgcgcttgtgcttgcgctcgaattgcgcgtggctgtcgcctatcccacgcgttacatccgcaacgacgtcactacccgtaacgaatgatctgaaacgaataatcccggtatcctgcgattgcacaggataccgggattattcgttattcgttatggtgtgccacgttttgtgtggcgataaggcggggatcagagcgaaatcagagctgctgatcggtgccgttcgccggatcattcggtactgccggagcgtccgaatccgccggagcgtcggtattcggctgctcgtgcggatgctggaactgggccggcacttccggcatcggcggaatggacggtgtcggaggcatggtcggaacagccggcatcggaggcatagacggtacggacggagcctccgccagcggattctgctgaggtgcggcgtattgcggcgcggcgtgctgctgcgcggcgtcatactgcggtgccggagctgtgtacgaatcggtcggagtcgctggtgccgtgtacggcgcggccggtgccgcagccgccggattggtcggcagcgggacgttgccgtacgaggtggcctgcgccgcatacgggtctgccggagcctcgcccgtggcgggagcccatgcgttggaagccgtaggagcgtcgaaacgcgcgccttccggattggaatcgcgggccatcagcacaaagtagaacacaccgctggcaatgaaggccagcacgccgaggatcagcaggacaacgccgccgatgctgacgctgttgcccgcctccaacgacctgaacgaaagactgctgccgatgatgaggatcagaccgatggcgaagaagattccggcggccgcctgtaccgcgtagatgatggccagcacggtgccacgcatgttgatgtcatgcagacgacgtacgccaagcgcgatggtcggcacaagcacgacgagtccccaaatggaggagaacgagtctccgacggtggcgatcacgccggaatcggtgaggttcctcaacgtgcggaatacgagactcaacacgaaagtgacgacggtataggtgaggaaccaccaccagaactcgctacgcgaggcgcggcccttgaacaccgcgtacttcttgaagaaacggacgatcgcctcgcccaggttgcagccatatgcgggcatgtcaagcggcgcggtcaatgcgaagaagctattgcccgactgcggttgcggtgccggctgcccgtaattcgcggctggagcctggccgtactgaggggcctgtccatattgaggggcctgagcgtactgcggagcctggttgtattgcggttgcggtgcttggccgtactgcggagcctgaccatactgaggtgcctggttgtagttcggggcggcgtactggggcgcctgcgcctgcccgtaatccggcgtgccgtactgcggtgccgtctggccgtagtcgggggcaggagcctgaccatactgcgctgccggctgcggcacctgcggattgtattggttggggtccgtcattagagtgccctttcacaaaacggtgactaaagaataaagaaagtcgcttcatacattactcctttgccgatgtgaagatagggaaaaatattgcagtatggaacgctgcggaagaaaaacggcgattgggtcgtggcacgtccggtttgcgcggcacaatggagcctatgactgaagttgaaaataccagaccggaacttcctgaaaacgttcgtgtgcgtttctgcccgtccccgaccggcattccgcacgtcggcatggttcgcaccgcactgttcaactgggctgaggcccgccacaccaagggcacgttcgtgttccgtatcgaggatacggacgcccagcgcgactccgaggaaagctacaaccagatcatcgaggccctgaattggctgggcatcgactgggatgaaggcatcaacgtgggtggcccggacggcccgtaccgccagtccgagcgtggcgacatctataaggacgtcgcagccaagctgctcgaagccggctacgcctacgaatccttctccactcctgaggagatcgaggcccgcaacgtggccgccggccgtccgaaggctttcggctatgacggctacgatcgcaacctcaccgaagagcagaaggccgcgttccgcgcggaaggccgcaagccggccctgcgtatccgcatgcccgacgaggacgtcgctttcgacgaccttatccgtggtcgcatcgaattcaaggccggttccgtgccggattacgtgatcgtgcgtccgaacggcgacccgctgtacacgctgaccaacccggtcgacgacgccatgatgcgcatcaacgtggtgctgcgcggcgaggatctgctgagctccaccccgcgtcagatcgtgctgtaccgttacctgatcgagctgggcgtggccaaggaaatgccgctgttcggccacatgccgtacgtcatgggccagggcaacaagaagctgtccaagcgcgatccggaatccaacctgttcctgcaccgtgacaacggcttcatccgtgagggcctgctgaactacctggcgctgctgggctggtccatcgcccccgaccgcgacgtgttctccatggacgagatgatcgagaagttcgacgtgcgtgatgtcaaggccaacccggcccgcttcgacgtcgacaaggccatctccatcaacgccgagcacatccgcatgctcgaaccgcaggacttcctgaaccgttccgtgccttacctgcaccgcgacggcgtggtctccgccgattcctgggatgcgctgaccgaccgcgagcgtgaggtgctcaccgccgccgctccgctggtccagccgcgcgtgcgcctgctgggcgaagtggccggcatggtcggctccctgctgtccaccgaaggctacatcgagccggacgccgacgccaagaagcagctgaaggattccgctccggccgtgctcgacgctgcgatcgcggcgctggacgccgttgctgagggtgattggaagaccgactccctgcacgagacgctgaacaaggcgctggtcgaagacggcggctacaagccgcgtctggctttcggcccggtgcgcgtggccatgagcggccgccgcgtgtccccgccgctgttcgaatccatggaaatcgtcggcaaggacgttgccatggctcgactcaagggcctgcgcgagcacctgtgagccgttgagctgctgactgttagctgaatgatggaaacccgccggagtgattcggcgggttttcgtttatgcggaaggctggtgcggaatggcggaaaatagcgcgacacgccgtaagttgcgcgactgtgctgtttcgcgtatatttatcactcgttgcggttcacagcctagttgagaatcacagcgataactcaagcccccgtcgtctagcggtctaggactacgccctctcacggcgccaacaccggttcaaatccggtcgggggtacgacggacaacttttcgaagttgccacgcctgccaaattgggatgtggtgtaattggcaacacagctgattctggttcagccattcttggttcgagtccaggcatcccagccaatgagccctcgcagatgcgagggttttttgtttttcgcacctgtctgttcacgccgctttgggcggtgggttgatggattttgccggatgcgatgtggcagcgcaatctgctgacgccctgcgtgaatcgcacatgtaatcgcccaatgttgcattaccctagaagtatgaccgaattgcagcatgccgccaaagccacgcgcccgcgcatccaaccagcggaagagggggaccgtcgaccgctttccgtatccgcacggctcggccgcctgcaattccaccagtccggcaaattccgcgtattgcaattcgccgacatccaagacgggccgaaagtcagcaaagacaccatcagcctcatcgaggcctcgcttgacgccacacgccccgatcttgttattttcaacggcaatcagatcgccggatatgattccgcatacgcgctgacctcccgcaagcgtcgctgggacgcgcgtccggcatccgcatcgtccgaagcgtccggggaacgctatgcggccgcattggaacacacccgcgaattggtgcgagccaccatcgaacaactggtccacccgcttgccgaccgcggcgtgccgtgggctgtgacgttcggcaaccatgacttccagtgcgggctcgacaatgccgagatcgaaagcatctgccgcgaattcccagggtgtatcaatccggaacgcgctgccgacggcacgacgggcatcgccgtgaaacatggtgtgaaacatgatgtcggcgatatggaacaggacttcggattgccggaacagcccgtgatcgcgtgcgcgcccggcacattcgcgttgtcggtgacggacgtcgatcgcacgtatggcgtgttgggcttggtcctgctggattcgggcgattacgcgcgttccggcggctacggaagcccgtcggaagccgcgctgcgcttcctggcggatgcgccggggctgatggcggcgcaatcgcagcagctgcaacaagaccggcaagatgaacaggactcgccgcgcgaaccgcgcaagacgccgtccacgctgccatgcatggtgttccagcatttcccgatcgaacagtattatcgcctgctcaagccggtcgcggccaccgctgcgcgcgcgattgaaggataccgcaacttcgcggggcggcatttcgtgctcaacgaagacaaaacgcagcccggaagctatctgggggagggcgtcagctgcccggatgccgacagcggcgaattcgcaatccttgacaaggcgggatattttgcgatttccgccgggcacgaccaccgcaacgccttcgtcggttccgtgccggtcggaaccgacggtgaccggcagatgatgatggtcgcctcgccgaccagcggttttggctcatacggcccggtgccggccaagcgtgccgctcgactgttcgaattcgacatccgccacccgtacgagccgcgcacgcagctgttggaatacgacgagctggtgggcaaacccagcgcgggcaaggcctacgcctacggcatgaccagcgaatcgaagcccgattcggaaggcatggacctgctccacaggccgacgtggtggagcaagacgtggaacaagctggtctcgctgttccgccggtgactgttctggtttccggcatccaactttggaatgaatacaaaaaagctgacgatgggaactttccatcgtcagctttttacgttaacgtatgcgactggtcgcggacctgtcagcggccggaagacgccttgatcagcgcgtcggtcagatacttgccggcggccatgaccagcggcgcgtaacggcggccggggttggcgcccatacggccattcgggccggaaattgaaatagcggcgatcacctggccggacgcgttgcgaatcggcgcggaaatcgaacacacgccctcatcgcgttcattgatcgactcggcccagccgcgcttgcggacggcggtgagcttggccgcagtgaacttggcgtggcgaagaccctgatgcagacgttcggaatcctcccaagccagcagaatctgggctgcggaaccggcttccatggacagcatcgcaccaaccggaatggaatctcgcaggccggacgcgcgctccacggctgcgatgcagacgcgctgatcgccctgacggcggtaaatctgcgcggattcgccggtgcggtcgagcagggtctgcagaatcggcgcggcggcggtcaacaggcggtcctcgccggctgcggccgcaagttccgcgaatcgcgatccgagcacgaaacgaccgtgctggtcgcgcaaaacgaaacggtgacgttccagcgcgatcgcaagacgatgcgcggtcggacgagccagaccggtcgcggaaaccagctgtccgagtgtggctgggccggattcaagagcgtcgagaatcttgactgtcttgtcgagcacgccgaccccggaatgaatttcgttgctttgcggggtggctgcgtaattgccgtttgcctcgttcgtggcgttcatggcctgcgttttgggcatggcgttgctcgtattcgaagaagaagtcatacgctgaattatgccatctcacatattgaaatgcaaaatgtatgtggttcgcgactggggtaaagcagattatttaccttgcttccaccggctggcgaagctgggaaaatgctgaagtttcaacgattgcgcatatgccgtaagaagacgggaagtaacttttccgcgtttgccgcgctcgtccctcgttcatatctcatataccggcatgaaggacctcgaacccgtttcaagcccataggcttatagcacgaagaatgcggcaaggcaatagccgcgaggaaattagtgaggaaaaatctgaggaggtcccacaatgggaactacattggccgagaaggtctgggccgatcatttggtacgcaagggtagcgatggggctcccgacctgctgtacatcgacctgatgctcatgcacgaagtgaccagcccgcaggcgttcgaaggtctgcgtctggcgggacgcaagccgcgtcacgtcgaccagctgattgccacggaagaccacaacacgccgaccgtcgacatcgaccgtccgaatccggacgagacttcggcgctgcagctgagcacgctggaaaagaactgcaaggatttcggcgtgcgtctgtgcccgctcggcgacgctgaccagggcgtggtccacgcgttcgctccggtgctgggtctgacccagccgggcatgaccatcgtgtgcggcgactcgcacacctccactcacggcgcgttcggtgctatggccatcggcatcggcacctccgaagtggagcacgtcatggccacgcagaccctgagcctgaagccgttcaagaccatggccgtgaacatcgaaggcgacctgccgaagggcgtcaccgccaaggatattattctggccatcatcgcgaagatcggcaccggcggcggccagggccacgttatcgaataccgtggcgaagccatcaagaagctgtcgatggacgcccgcatgaccatctgcaacatgtccatcgaagccggcgctcgcgcaggcatgatcgccccggacgaggtgactttcgaatacctgaagggccgtccgcacgcgccggaaggtgagatgtgggacaaggccgtcgaatattggaagacgctgaagaccgatgacgatgccgtgttcgacaaggaagtgaccatcaacgccgaagacctcgagccgtacgtcacgtggggcaccaacccgggccagggcgtgaagatctccggcgtggtgccggatccagcctccttcaacgacgagactgagcgttccgccgccgagcgtgccatcgcctacatgggactgaagccgggcatgcgcatcaaggacatcgccgtggacaccgtgttcatcggctcctgcaccaacggccgtcttgaggacctgcgcgtggccgcctccatcatgaagggccaccacaaggccgacaacatccaccgcgtgctcgtggtgccggcatcctcccgcgtgcgcctgcaggcggaaaaggaaggcctcgacaagattttcaaggacttcggcgccgaatggcgtaacgccggctgctccatgtgcctgggcatgaacccggacaagatggtggcccgcgaacgttccatctccacctcgaaccgcaacttcgaaggccgtcagggcaagggttcgcgcacgcatctggcgtcgccggccgttgccgccgcgaccgccatccgcggcaccatctgctcgccggccgacctgtgaacctgctgcgagcggaagctgcgaacgcaatcgtaagtaatcgaaatatcgaaatcgaatatcgataggcaatcgaaggatttgttgacatggaaaaactgactacccttaccggcgtggccgtgccgcttcgccgttccaacgttgataccgaccagatcattccggccgtgttcctgaagcgcgtgaagaaaagcggcttcgacgacgccctgttctacgcgtggcgccgcgacccggaattcgtgctgaacaagccggaatacaagcagggcaagattctggtggccggcccggatttcggcattggttcctcccgtgagcacgccgtgtgggcgctgcacgattacggtttccgcgtggtgatttcctcccgtttcgccgacattttctacggcaacaccgccaagaacggcgtgctggccgcaattatgccgcaggaatccattgagctgctgtggaagctgctggacgaggagccgggccgcgaaatgaccgtcagcctggaagaccgtaccgtcacctgcggcgatgtgacgttgccgttcgaagtgaacgactacacccgctggcgtctgatgaacggctacgacgacatcgacctgacgctgcagcacgaagacgacatcatcgcatacgagaagatgcgcgccgaaaagttcccgttcaagccgaagaccctgccggtcaagcgcgagccggaacagccgatcgaatctgcccgagagggtgaataccctgattggcaagggccgttggccgatcgcggcatcatctgacgcgatggctggtcggcagtgcagtgcactgccgacagggccttgcccgagtccgaaacgagggcagcaatgagcctgcgcgcagcgcagtccataattgcaggacagggccgttggctgatcgcgacggtagcccatttcatcattggctgaccgcaaccacatctaacttttcccaagcccggcacccaagccgggctttttgtttaccttccatcacctttccgccaacagcaaattccacaaagcggtggcaaagcgcgcgcaaagcggtggtaaaatcataatacgacggcaaagtggcggcaaagcgagcgtaaaacgcgtggtaggtaaggcggtgatggccaatggacggtagcgagcacgatgatgcctggtggtcccgggaggttcctcggatgcgtgaaggcaaccgtttggaagcgaaacgtgccaagggcggcctgccccacagtttatgggagacgtacagctccttcgccaataccgaaggtgggctgattctgctgggcgtgtccgaacatgaagaccattctttgtatatcaccggagtagatgatgcgcggaacatggcgcaggatttttggaacatggtgcatgatccatcgaaggtcagtgccgttgtgctgagcgacaacgacgtggtgattcgccatacctcgcagggagatgttatttccatcgacattcctcgtgcggcgagggactgtattcccgtgtacgtgggccagaatccgatgacgggctcataccggcgtaatggcgatggcgattatctgtgcgatgaggaaacggttcgtgccatgcttcgggacagtgacctgcttcccttggacagaacgattgttgaaggcatgggtgctgacgcgctcaacgcggatagcgtcgcatcatatcgtcggcagttcaagaacagacggcccggccatccatgggtcggattgtctgatgaggatttcctgcttcgcatcgaagcgttgcggcttgatggttctcaggtgcgtcccacacgagccggattgctgatgttcggtgaggcgtggcgaatcacgtccgaattcccctactatttcctggactatcgcgaggtcatggacgaccaggagcggtggaatgaccgattcacgtcggatgatggcacttggtcgggcaacttgtacgatttttggggcaaggtggtcaatcgtctgcggtcggctgttgcccatccgttccagcttgatgccgatttgcataggattgatgacaatctgatggataaggccgttcgtgaggctgtcaccaacacgctcgttcatgccgattaattcattcgccggggcacggtgatcatccagtattacgacagaatcgtattgtcgaatcccggcagcctgcgtctttcctccgaagaggtgatgcaaggcggcatttcggatacgcggaatcccacgttgatgaaaatgttcaatctgattggcatcggagaaaaggcgggcagtggttttgacgtgatgcgtgaaggctgcctgttcgcaggaaccgccgcgccggaattggaagtgttcgacgatccggggcgtgtgcagcttacgttgtatccgcgcaagatcgccggagattccatgatcgccggagcttctgctgttcccggagtctctgcagatggcgggggccctgttggtgcggagtcgccgacaatgcggaattcggagcatggcactggtacggtccataggattggcgctcgcggggctgaccgtttgaacgacatggtcggcacattcggcaagaacgtggccctacctgccgatttcggcaatgcgatcaggccgcaaagccagttggagaaaatcacctatgcgttgacggtcggcggaccgcaacccacctcgtatctggctgtggtgctggggcttggcctcacccgtacccgggagatattggcctcactggtgaaagacggtgttattgaaccaataggcgtcggacgcggacgcaagtaccgtcttgccgagcataccggctcatgacggcgttccggttctctggacttgacctggatcgagagcccaaactcgtctggggaagtcctagccaaggaggtttccaaggtgagacggggcgtgcaggcgggacgtgtgtcgcgttacagtggacatgacatttcgtgtgttcgcatcgcatatccaaaacatgacacgagaacaatttcggggagcagtatgagccagggtttcgcgccgttttacgacgtcaatcgcacgtatgaagacaactatctgcaggggcccttcggtgcgttcgccgaagtgatgaagggcgattccgctgccggcgcctccgcgcagtctgcacagaccacccagtcgcagtcgtccgaccaggccgaggaattcctcggcttccgcgtgaacctgccgtttggcattcccgctggtccgctgctgaacgagcggttcaccaccgccgccttccgcatgggtttcgatttggcggtgtacaagacggtccgctcccgcgcgtggggttgcaacgccttcccgaacgtgctcgccgtgcatccgaagaacgcagacgggtctctggttcccggcagcgccgaactggatgaaggcgtgcttgccgacacccgatatgagcttccgatttcgatctccaacagtttcggcgtgccgtcgcgtgaccccgacgaatggcagccggacatgaagaaggcgatcgccgccgccggcgacgggcagctgctcgtgcccagcttccaaggttcccgcgtggacggcatggaccgcaaggcgtacatcgccgaccatgtcaccaccgcgcatctggttacggaaaccggagccggactgatggaaatgaacaccagctgccccaacgaaggtcacaatcgcctgctgtgccacgacccgcatctggtgggggaaatcacggaagccgtgaaaaacgaaatcggcgatcgcccgctcatcgtgaaactcgcctacattcccaacgacaccgacctggaaaccatggtcagggaaaccgtcggacatggcaccgtgcaaggcttctccaccatcaacacgatttccgcgcgcctagtggacgcgaacggcaaccaggcgctgccgggagccggacgtgaccgttccggcgtgtgcggcaacgccatccgcggcgccggtctcgacatggtcggcaggctcgccgccatccgtgaaaaactcggcttcgacttcgccatcgtgggcgtgggcggcgtgatccgtcctgacgactacaaggcgtaccgtgaggctggcgcgaacgccgtgatgagcgccaccggagccatgtgggacgcgaatctcgcgcgcgaaattaaggagacactgcgctgaattccgtttttcgcgaacatgctacatgccttatggcaaactaagcagcagtgttttttgagcttgatccaaaagggaatcgaaagaggttgagcgtgtctgacaataagaacgacattctgcacgtcgaaggcggcaagccgctgaacggcaccatcaaggtgcgcggcgcgaagaacttcgtaagcaaggccatggtcgccgcattgctggccccgggcacatccgtgctgaagaacgttccggaaatccgcgacgtgcacgtggtgtccgacctgctgcgcctgcacggcgtggacgtgaccgtggacggcgcgaacggcgtggtgacgatcgacgccaccaacgtgcaactcgccgacgtggccgacgtggacacgctgtccggctcgtcccgcattccgattctgttctccggcccgctgctgcaccgtctgggcgaagcgttcattccggcgctcggcggctgcaacatcggcggtcgtccgattgacttccatctggaaaccctgcgcaagctcggcgcgaacgtcgacaaggaacacaaggacggcattcacatcaccgctccgaacggtctgcatggcgcgaagatccacctgccgtacccgtccgtgggcgccaccgagcagacactgctcgccgccgtgctcgccgaaggcaagaccgagctttccggcgccgccatcgaacctgagatcatggatctggtgagcgtgctgcagaagatgggcgccatcatctccgtggacgtggaccgcacgttccgcatcgaaggtgtcaaggagctcaagggctacacgcacacgtctctgaccgaccgcatcgaggccgcctcctgggcgtccgccgcgctcgccacccatggcgacatcttcgtcaagggcgccacccagccggaaatgatgaccttcctgaacgtgttccgcaagatcggcggcgaattcgacatcaccgacaagggcatccgattctggcatccgggcggagatctgaagccggtggccatcgaaaccgacgtgcacccgggcttcatgaccgactggcagcagccgctcgtggtggcgctgacccaggccaacggcctttccatcgtgcatgagaccgtgtatgagaaccgtttcggcttcaccaagccgctggtgcagatgggcgccacgattcagctgtaccgcgaatgcctcggctccctgccgtgccgcttccaacagcgcaactacaagcattccgcggtcatcttcggaccgaccccgctgaccggccgtgacatcgacgtgccggatctgcgcggcggcttcagccacctgatcgcggcgctcgccgccaaggggccgtccaacgtgcagggcatctccctgattgaccgtggctacgccgacttccgtggcaagttggaggctctcggcgcagatttcgactgattcgctgcgattggttcgatgaatcggctgcggctgatttattgcgattggccaatcgtgattgatgattcgcaattgaacagttgcgattgacagtcgcgtcgaacgcccatgttgctttcaccggtactcgccttacgcgggtgccggttttgttttatccgcgattgccgctgccgcaatcgcaaacctgctttccataccttccacatcttccgcatattccttttactgccttatcgcccgtcttttctgcatcatttgacggccaaatgatgcagaaaacgatggcatgaggcagtaaaaagcaagataacgcggaaaacatcgatgacgaacgtatcggcggccggtggcacaatggaagccatggcatccaaaggaaaaccgtcgccgcgctccgcagtgaagccgctgagcgacgagcaagtcgcaaaactcgcgcagaagcatcatcttgtagacccgacccacgatttcccgaccggtccgcgcaaagccaacaccacggaaatcgaagcgcagaaccccaaagccacgcatcgcctgctgaccggctgcgacgtggtgctgcgcaatcacagcaaagtgaaggcctggggcttggaacacgtgccggaaaccggcccgttcatcaccgccgccacgcatgtgaccatgtacgacgtgttcgtgccgatggtctcgatgttccatcagggccgccgcccgcgctacatggccaaggcggaaatggccaaatggccgctgatcggcaaatggttccagctggtcggcatgcagccggtgcagcgccgcgcgggcaaggccaaagccatcgaggaaacgtccgtggaaatcctcacttccggccgcccgctgaccgtatggccggaaggcaccgtgacgcgcgatccgcagaaatggccgatgagcatgaaaaacggcgtgggcgtgatcgccctcgaatcctcacgccgactcggctaccaggtgccgctgtactgtgccgtgacctggggcgcggccagcatcaaccactggtggccgtggccgcgcaagaacgtggtgatgtgctacgacgaagcgctcgactacgcggacctgcttgacggctgcgattcctggggagacgaagtgccgacggaccgcgccgacgaactcacccgacgcatccgcgtgcgcatgaccgaaatcatggccgaaatccgcggcgaacaggcacctgacggctactgggactaccgcaccatgagtcgcgtgaaagactgattttcccccacacacccgttccggcggcgaacaaaatacgcgtgcgaccggaacacgcggccggtgtgcgtagccggcggtagcataagacaacgtcgattgaaagcggcggccgatgtggcatacgctcggccgcaaaaagcaatccaaataatccaaggagcaaaattcatggcgaatgtgacggtactgggcgctggcgcttggggaacggccttcggtcaagtgcttgccgacgcgggcaacaacgtgaccatgtgggccatcgaaccggaaatcgtggaaggtattcgtgaccatcaccacaacggtgtgcgcctgcccagcgtggaaacgctgcccagcaacatgaccgccaccggagaccgcgccgaagccgtggccaacgccgacatcgtcatcgtggccatcgccgcgcagttcgcacgcgtggcactgaccgaattcaagggactcatccccgagaccgcgctcgtggcctccctgatgaaaggcatcgaacgcaccaccggcaaacgcatggacgaagtcgtcatggaaacgctcgaccttccggcggaacgcttcgccgccatttccggaccgaacctgagcaagcagatcgccgaccgtgagccggccgcgaccgtggtcggatgcgcgaacatcgacaacgcgcgcaccatcgccaccgcctgcaccaccgactacttccgtgcgttcgtgacgcgcgacgtgatcggcttggaaatgtgcggatcgctgaagaatgtggtggcgctcgccgtgggcatggcccgtggcgcaggctacggcgagaacaccgcggccatgatcgaaacccgtggccttgccgaactgaccgcgctgggcgaggcggccggagccgatccgaagaccttcgccggacttgccggcgtgggcgacctcatcgccacctgcggttccccgctgagccgcaactacacgttcggttccaacctcggcaagggcctgagcgtggaagaggccaccaaggtgagcaacggcgtggccgaaggcgtgccgaccaccgacgcggtggtggcgttgggcaagcagtacggtgtgccgaccccgctcgccacggccatgagccacgtgctggacgacggcatctcctgcgcgcagatgctgtccgaactgttcggcgaaggcatcaccgaggagtagcagccggcttgtatgctggatgcttggcaaaaatcctgaaaagtcataaaagttaaggaataaaggctatagatatggcaaaaaagcgcattgtggtgatgtacggcggcaaggccgacgagcattcgatctcctgcatctccgctgcgagtgcgctgcgcgcgctggacacggacaagttcgaagccattccggtgggcatcaccaaggacggcaagtggatcgtcaacggtgagaatccgctcggatggagcctggacgaaggcctgccgaccgtggagaaaaccccaggcgccaaggacgtggtgcttgaagtggctctcggacaggacggcttcttcgcccgcgaggatgacggtacgatgaccccgttcggccatgtggacgcggtgttccccgtgctgcacgggccgtacggcgaggacggtaccatccagggtctgttcgaaatgatgggcgtgccgtacgtggggtgcggcgtgctcgcctccgcggcctgcatggacaagcattacacgaaggtgctgctcgcggccgccggcattcccgtcgcgcccggcatcacgctcgacgcgcgttccttcgacaaggcttccgaattcaagaccgacgccgatgcgatcatggcgcaggttagcgaagccggcttgcagtatccgctgttcgtcaagccgtcccgcgccggttccagcttcggcgtgaccaaggtggagcatgagggcgatgcggccgaacttgcggccgccgtgtacgaggcgtcccgccacgattggcgcatcctcgtggaacagggcatcgacgcgcgcgaaatcgaatgcgcagtattgtgtccgaaggctggcgaagcgccgcaggccagctggccgggcgaaatcgtgctcgacaagcgcgccgaaggcgacgaccagttctacgacttcgacagcaagtacatggacgccgccgcaagccacgtggaagtgcccgccaacctgccggaagagacgctgaacctcgtgcgcgaaaccgccaagaaggcgttcgtcgccgtggacggtgccggtctgagtcgcgtggacaccttcgtgaccaaggacggcaaggtgatggtcaacgaaatcaacaccatgccgggattcacgtccatctccatgtaccccaaggcatgggaggccaccggcgtgcgctacaccgacctgatcaccaagctgatcgaaggcgtgctgcgctgaatcctgaatctcatccgagctgagccgaagccgtgctgcatttcgagctgaaaagcgcaaagaaagcaacacgaaaaaggccagttcatcgtaagtttgccgaagcgaaacgggaatattcctaaaaatcgcttcggctttacttattctttgacactgcgttaggtaacgccattacgtttccatgttgtcgattccaagaacaacaaaacaacaaaggaaacgaaaacgatgaacgctttgcgcaagatcgccgtcggctcgctcgccgccgtgctcgcatgctccatggccgcctgcggatcaggtaacgccaattccaccgatagcgcctccaacaccggtaaaaccgtgaaagtggacgaaaagtccgcaaaggccacttcgatctccgatttcggcggcatggacggcctcgtggccgctgccgaaaaggaaggcgcgctcaacgtgatcgcgcttccgcacgactggtccaactacggtgacgtgatcagcggcttcaagaagaagtatccgaagatcaagatcaacgagcagaacccgaacgcctcctccaaggaggaagtggacgccggcaagaccaacaagggcaccgacgccgctccggacgtgtacgacctcggcctggccgtggcctccaccagcaccgacaacttcgcctcgtacaaggtgcaggcctgggacaagatcccggattccgtcaaggataaggacggcaagtactacgccgactacaccggcatcatgtccatcggctggaacgccgacaagtacggcgacatcaagtccatcaacgacctgaccgacccgaagttcgccggaaccgtggcgctcaacggcaagccggccgaagccggcgccgcgttcaacggctacctgatgatcaaccagctggccggcggcgacatcaagaacctgcagccgggcctcgacttcttcaagaagctcaaggactgcggcaacctcaccaccgtcgacgtgaccgacggcaccatcgactccggccagaccggcgtggtgatggactggacctacaaccaggcctcctaccagaagagcctcaaggccaagggcgtgaactggaagttcaagaccttcaagaacgcccaggtggtcagctactacaaccaggccatcaacgtggacgccccgcacccggccgcagcccgcctgtgggaggaatacctgtacagcgccgacgcccagaacgactggttcaagggcggcgcgaacccggtactgctcgactccatgaagaaggacggcaccgtcgaccagaccaccctcaagaacgccatcaccatcgacggcgatccggtgagctacaccaacgaggattccacccgcatcaccacatggctccaggacaactgggacaagaccatcggcaactgacatgaccgcagtgcttacctcaggagctcacgccaagcgcgcgggctcctccgccatctcgtttgccgcgcataggcgtgaactcggcaccatcgccgtgtccatcccgttcttcgcctacaccgcgtgcttcctgctcgccccgacggtcatcgtcatcgtgggcgccttccaatccgccgacggcagcttcaccgtggcgaacttcaacaaacttttcgaagcgaacaccatcgccgcattcggcacatcgatactcgtatcggtcgcatccgcggtcatcggcgccatcgtgggcgcgctcgccagctacgccctcgtcatcggctccaagccgaacggcctgctgcgccgcatgatttcggccatctcgtcggtactcgcccaattcggcggcgtgatgctggcgttcgcgttcatcgccaccatcggcatcaacggcgtgggcaccatgctcatcaaacagctgaccggctacgtggtgaatccgaactggctcagctcgctgccgggcctgatcaccatctactgctacttccagattccgctgatgatcatcatcttcctgcccgcggtcgattccatccgcccgcagtggcgcgaagccacggaaagcctcggcggcaacaccttccaatactggacgcgcgtggccggcccgattctggcgccgcgattcatctccgcgttcctgctgctgttcgcgtccgcgttctccgcatacgccacggccgccgcgctgttctcccagcgttcgatcctcgtgccgctgatgatccaaggcgcgatgcgcaacgaaatggacccgaaccagcaaggcttcgcgcaggtgctcgccttcgccatgatcgtcgtcgtggcggtggtcatgatgatcagccacgccgtggaaaagagggccggacgatggcagtgaacgcaaatacgcaaaccgtaagcgcgcaatcggaggaaaagcagaacatgcaggaatcgcaaaccatgccgccgcagctgcgtgcggccagactcggcaagcaacgcatcgtcaaaaccatcattctcacggtgacgctgctgttcctgttcgtgccgctggtgtccatgttcctgttcaccatccgacacccgttgtccggaaaatggagcttcgacccgtggatcgccatcttcaccggcgacggcagcgcgctcggcgccgacctgagcaccctgtggagcggcctcggcgcttcgctcgcgctgtgcgtggtgaccgtgctgatcatgctcgtgctgctcgtgcccaccatggtgatcgtgcacatccgctcgcgcagactggaacgcgccatcgaatgggtggccacgctgccgctgaccattccggccatcgtgctggtggttggcctgggaccgatctaccgctggctgtccgccgacgtgctgagcaccaacccgatctggctgtgcttcgcctacgtggtgctggtcatgccgtttgccttccgcgcgcttgcggtgggactcaattccatcgacgtgaagacgttatgcgaggcctcacggtccctcggcgcttcatggccgcgcgtattcttccgcgtactcattccgaacctgtggcagtcgatcctgtccgcatcgttcatctccatagccgtggtgctgggcgaatacaccgtcgcctcactgctcggccgtatgaacctacaggtcgcgctgtaccagctcggccaatccaattcgcaaatctccaccgcaatgtcgctgctggcactgctattcggcgtgattctgctggtggctctcgatctgatttccggcgcgatgcgtcggaacaaggaaggtgacaactcatgactctcgccgaacagaaggcggtggttgcccatacctcggaagcgttctccgataccgaacccaacgtggtgaccgaagcggcgaaggccgtgctcaaggattccgaagcgcgcggcggcggtgtgcagatgcttggtgtagacaagatctaccccggttcgaccgtcaaggcgttggacgatttcaacctggaaatcaatccgggcgaaatggtggtgctgctgggcggctccggctgcggcaaatccaccgcgctgcgctccctggccgggctggaagacattcaggccggacgcatcctcgtcggcggccaggacgtgaccggcgtgcccgtcaacaagcgtgacatggccatggtgttccaggcctactcgctgttcccgcacatgaccgcgttgcagaacgtggaattcggccttgaaatccgaggcgtggaccgtgcggaacgccgccgccaggccatggagaagctggaactggtcggacttgccgaccaggcgaaaaagtacacgcagcagatgtccggcggccagcagcagcgcgtggccctggcccgtgcgctggccgtgaacccgcgcgtgctgctgctcgacgagccgctgtccgcattggacgccaaagtgcgcgtgcagctgcgcgacgaaatccgccgcatccaactcgaagccggcaccaccaccgtgttcgtgacccacgaccaggaagaagcccttgccgtggccgaccgcatcggcgtgatgaaccacggccgcatcgagcagatcgccgacccgcagacgctgtaccgccgccccggcacggaatacgtggccaccttcatcggcctgaccaaccgtctgccgggaatcgccaacggtgaggaggccgtggtgttcggccagcgcgtcccgctgctggacggttccgccaccgacgcctccacggtgctggtacgccccgagaacatgacgatcgaactgaccgacgatgccgatgccgtccacggagccggcgaacttggccgcgtggagatggtgcatttcctcggcgcgctggcccgcgtggacgtgcgcgtagcctgcgcaggcatgggtggcacgattcgcgtcaccgtgcagctgccggccaacgagctgcccgcaggacttgcgatcggagcgcaggtcgtggtcgcgcctcggccgattccggcgctcgccgtctgacgattggttgctgcgcgcgatcgttgcgtaccgtcattgcgtgcgatcgccgtgcgtgattattgcgtacggtcgcccatcgcgtgagccgagccattcgcagggctgagattccaagctgatattcagagaactggtagtacagtgctggatatcagcttttttatttgcttgccgtaagttcgtaaggtgaccatgacgtttccgcaacaaccgcaacagccgcagtacccccagtatccgcagggaccggcaccgcaatatccgcaatcgcaattcccgcagcagctccagcagccgaatcgcaatccgttcttcgaatggcttcagcgggcgaaacgcgacttttcgcgcatcggcgcaagcctgtgcctgatggtgatcatctggtacgcgggcgtcttcctgctcaaaggcgtggtgcgcgcggtcgcgggcggtgtaggcgccggcggcgatatgccgaattggatgacgttcctcatttccgacgtgccgctgtatctgatcgccatgccggtcgcggtggtgctcatgggcaaatcgaccgtcatcgaaacccgcaaattcaacatgaaaccgggcatgttcttcaagctgctgctcatgtgcctgccgatgatgtgggtcggcagcatggtcggcagtatgctgtcgctggcgctttccgacggtgaagccacgaaccgcgtagccgatcttgccatgcagacgaacatctggaatgtcgtgttcttggtgattcttggcccgattttcgaagaatggatgttccgcaagcagctcatcgaccacactcgcaaatacggagagaaaacggcgattctgctgtccggccttgcgttcggactgttccacatgaacctgttccagttcttctatgcgttcctgctgggagtcatgttcggctacatctacatgcgcaccagcaaactgcgctattcgacggccatgcacatgatcatcaacttcaacggcggcgtgctcgcgccgtggattctgacgcgcgtcgacctggaccagctggacaaggtgtctcaggccgcggaaaacggcaatgtggcggcgatggaacagtgggcgtcgcagaacgccaccgggctggcgatcatgctcgtctatttcctgctgtacggtgccgtgattctcgccggattcgtgctgctgatccgtaacttcaggaaagccgaattctacatcgcgccggaggagctgccgcgtgggaccggcgccagaaccgtgtacggcaacgtcggcatgatcacgttcatcgtgctcacggtgctgctgacggcgatcagtctgttcctatagccgcagtcgcgcggattatgaaggccggccggggatacgttcccggtcggcctttctgttgcctgcatagcttgtgttgcgtgcgttgcgttgcgcacgccgctgccgctattcgccgctgccgaccgcgcggtgctcaagataatcggcatgcgcgatcgactgcgccaccgcatccgccatcgtggacagcagcaggtcgtttttcgcgaacgcgtagatcgtgccgtcgatgccgtacggggtgaagccgttgagcttcaccaccggcttgtattgcgggttggcaagccccacggtcgcatgttccacggtgctgacgatgtcggccttcatacgctccacatccacgcccgccttcgcggtgaacggcaccgacaccaggcactcgttcgacgggtcaagcttctccagcgaggcggtgttcagaatggaattcggaatgaccatctcgttgccgttgcgctcgcgcacgatggtctgacgccaattgatgtccttgacggtgccggtgatgccggccaccttgacgtaatcgcccggctggatgacgcggccaagcataagcccgaagccgccgatcacattggcgatcgtatccttcaaacccagcgaaaccgcaagaccgccgatgccaagcgccgtgaacagggtggtcggattgatgccgaacaccggttgcagcagcgtgccgatggcgaacacccacaccaccacgcgcaggatgttgacgaagatggatgcgttcggcacctgcgatttgtcgagcatgcggcgcaccaccttggtgagcgccttgtcgataagcgcggcgacgatgagcacgacggcgagcaggatgagcttgctgtagtttttggcaagccagtgcatgagaatttcaactggatccatggctgcctagtctacacaggggacgttgcacaacgcttgcgattgactggatgattcctgatccgccggctggccgcagcggagcataatggattccgtaggatgcgttggccagcgaaaaggggtgcgacatgggcaatgtcgtggattatgtgcggcgcgagtttcatggattcgcggagctgccgttcggcgatgttgattcgctggtgctggctgagctctcatatatgcggctttccggcttggttccggcgttcggcgaggcgaggtcggtggcgacggtgccgattcgagagctgctgcgtgcggaaagctatgacgacatgttcgtttcgaattcctccgatatgaacgagtatcggctcgcgttgctgcgtgccgtctgcgaatcgccgcgtttccgcgcgttgcgtgtcggcgagtacgcggagcgtctgagcgagcgcgaacagcagcagttcgccgcgatgacgttcgacgtgggttgcggacccgtcgattcgctgtatgtagccttccgtggcaccgatggcacgcttgtcggatggaaggaggatttcaatatggcagtgcgctgtccggtaccgtcacaggaatccgcgtatcggtatgtgaactcgattctggacaggtcggaaggtttcctttcgtcgggcgattcgcccgcggtcatgctcggcgggcattcgaaaggcggcaatatggccgtgtatgcggccatgcgtatcgcgcacgatgacatcgaagtggctggcgagcgcgcgcggcggctcggattgctgccctcattgggtgggccagtgcggggtcgcaacagacggatctcccgcatcttttcccatgacgggccgggccttccgaaatcgacggtgcgcggtcaggcgtaccgtgcaatcgaatcgcgtatccgcaaaaccgtgcccgaatcgtccgtcgtgggcatgctgctgcaatcgaatgcgccagtgcgcatcgtcaaagcggatgccatcggcatcatgcagcatatgggaaacagctggcaagtggcggaaaatggcgatttcgaacaggtggacgagctgacggccggcgcgcagctcatcaaacgaaccctcgacgggtggcttgacaccgtaagccaggagcagcgcgagcgcgccattgaccagatctacgggatcttcgcggcggcgggatacggcaatatcgccgatttggtggagcattggacggattcgctgccgaagattgtggaggcggcgcgcaataccgatcgggagacgcgcggactcatcagggcggtgatcaaggcgattccggtcagcgcggcgaaggcggtgcgcgagggctgaagcgggttgagtgccgaggcgggctgaagcgcgtgccgaggcggggctatgggcggatgcagcggctggtcgggatggttgccgagccgcatttcggccgattcatgtgtcacgatcctcgaaaaggcgtgaaaaatggaattgtgacacataagtgccgcgcaagtgacacacgagtgccgcacaaatgacacataagaagggcaatggagggcattggggcgccgatgatccggatgcatccccgttcgctgacgtaggatggtgcggtgcggacgcataattgtggaagcataatggaatgcggaatgtcgacggctgcgaaaggggtgtgcaatgggcaacatcatcgattacgcgcgtacggagacgcgcgatttcggcgagcttcccttccgtgaggccgacgcgctcgtgctcgcgcagctttcgtacgacgacgtgccggaatgcgtgccgcggcttgacgacatcgaatcgcgatacggcacgttgcatgaccgtgtgaagcaattcgacccgcgccatcccatacgctccgtgcggatgctgcggaaacctccattcgacggtgtgacgatcgcgcgcgccgacgacgagctgcaccatggaagcgcggtgcccgaccataatgtcgagaacgtgggcttggttgatccgcaggtgacgcacgatttctaccatgccatcgccgcgaatccgcgtttttccgacattgaaatgggggcgtttctcgagcagttcgacggcgatgagcagacgcagttcgccgccgtgacctatcgcctgccgtccggcatgctggttgtggcgttccgcggtaccgacgattcgctcgtgggttggaaggaggacttcaacatggccttccaatacccggtgccggcgcaggtgaccgccgccgactatctcgccagggtggccgagttgtggaaggatgttccgatcgtgctcaccggccattccaaaggcggcaatctggccgtttatgcggcgatgaacgctgaggacggggtgaaggaccgcatcgaacgcatctattcgttggatgggccgggcttccctgaggcggtggtgaatagcttcgaatatgcgagcgtgagcgatcgaatcgtcaaaatcgtgccggactcatcggtagtgggcatggtgctggaaactcccgaacgctgcatcgtggtgaaatccgacgtggaaggaataatgcagcatttcgtgttctcctggcagatgcacggcggtgaattcgacaaagtcgaggatgtggccagcagttcggtgaccttcaacaaagcgctgaacaagtggcttgccaacctgtccaaggagcagcgcgagcgtgcggtggacgcgttgtttgccgtgctcgaagcgtccggtgcgggcagtatttccgccatgatggcggccgggccgaaagtcattcccgaaatgcttggcacgtacgttgggttgagcggtgaggatcgacgcaatctcaaccaggcgctggcgattatgttgcaggccgctcttgcccgcaatccgaaagtgcggcgcaagtagacgtagcgcggaggtcgtgacgcagtggtgtgaggtgaggcgttgcggtggatggcaatcgctattaatgcgacatgctgtgcagtttgttctagacaacttgtatagtaattcgcgttgcgcttttaaatcgaaggtacaaaatagggggagccatgccacgtccacgccgagattcggagattctgccagccaaagaacggctcgaaaacgcattctgggaactgctttccgaacgcgagtatcgcaaaatcaccgtcaccgacatcgtgcgcacggcggacgtgaatcgcaattccttctactatcatttcacgggactgccggaacttgccgattccgccattctgcacgccgtggaaaacacgccgcttcccagcgcgcccaacgcgaatttcaatcccgacaacgaatggcgcaagcatgtcaccgcgctgctacgcgagcccgagcagcgtcagcgtcttgaccggctcgcgctgcttgccgggccgcacagctcgccggaactcgttgaatccctgcaggacttcggcaggctcacgttgatctccgtgctggggcttgacgccgaccatcttgacctcaaaactgacctgatgctcgacttcaccgtcggaggcatgttggcggtgctgcgccgctggccgaagctccatgagcagctgccgatggacgccgtgttcaacgaggatgtggcggtgctggccacgggcatattcatgtccatgtccaaaaccgacatgctgggttattggaagcgcatcttcagcagcggtttcgtggcggggcagggcgtgcagagcgaagccgaacagaaagccgaacagtgaacgatgcgccgcatgtcgtgacttttcggtggtagaaacgtctgtagcggcgctctttcagggtgcgtcagacgtatgcaacagcacgacagggaggttgttccatgatcaacgaagcctacaaggccatgctcggcggaaaatccgtaatccgcgagctgagcgaatacgcgaccgcgcgtggcgccgaaattggctacgagaacgtgttcgactattcgctgggcaacccgagcgtgccgtgcccgcaggactataccgacgccgtgatcgacatgtataaaacggccgaaccggtggcgttgcacggctattctccgtccttgggcatttcgtcggtgcgcaaggcgatcgccgaaagcctcaaccgccgcttcgacatggactacaccgccgactacatcttcccgaccacgggtgcggccggcgcgttgacgcatgcgctgcgcgtggtgaccaagccgggcgacgaagtgatcaccttcgccccgtacttcccggaataccagccgtatgtgaacggcaccggcgcgcacctgaccgtcgttccggccgacaccgagaacttccagatcaacttcgacgcgttcgagaaggcgctcaaccccggaaccgcggccgtgctcatcaacaccccgaacaatccgtccggcgcggtctattccgctgaaacgctgacccgcctggccgaggtgctcaacgccaagcagactgaatacggccacgacatcttcctgatcgccgacgagccgtaccgcgagatcgtgttcgacggcggcgagcagccgtatccgagcaaattctacgacaacacgctttcgtgctactcgtactccaagtcgctgtcactgccgggcgagcgcatcggctatgtggcggtgaatccgcgtgccaccgacgccaagctcatcgtgccgatgtgcggccagatcagccgtggcaccggccacaactgcccgtcctccaccgcgcagctggccgtggccaaggtggttgacgagacaagcgacctgtccgtctacgaaaccaacatgaacctgctgtatgacgcgctgacccgtctgggcttcgacgtggtgcgccccggcggcacgttctacatcttcccgaaggcgcttgaggaggatgcgaacgcgttctgcatgaaggccaaggattacgacctgattctcgtgccgtccgacagcttcggcgtgcccggctacttccgcatggcctactgcatcgacacggagaaggtggagcgttccatcgcggcgcttgagaaattcgtgcacgaggtgtacggccgctgagccgctcgcgtatttcgcctatattccgcttatagatggcggattcgctctcgtgcctgatgccatctcgcttatggatggcggatgatgcggggaaaagccggttggagggtatggatattgccccctaacctttttgctgtaggaccccgccatctataagcgagatagtgcaggattgtggggcggcaagccgactgtctgacgggaccgtgtgcgttgatacaggttcgcccggagctggtggggtccagctccgggcgaagtctgttatggggaaggaaggaatctgaatcggttaatgcgtgaatccgtcagtgggtggcgatctcgtcgatcttggtgacgtggccgccgaactgggcgcgcatggtggacacgacgcgcaggatgttgtcggcgccgccgcgcgaggtctgacgtgcgtacagtgcggccgcggtggccggggtcggcacgccgagttcgagagccgcctcgatcatccacttcgcctcgccggactcgttggcgaccggcggcatggacttgagcgtcgggtcggacttgaaggcgatggccagcaggtcgagcagccaggactgcaccacggaaccgtccctccaggagctcatcacggccgccggatcctcaacgagatcggacttcaccatggtggcgaagccttcgccgaaggcctgcatcatgccgtattcgatgccgttgtgcaccatcttggcgaagtggccgccgcccaccgggccggccagcaccaagccggaatcgccttccggcttaagtgcctcgaaaatcgggcgcgcgctctcgaagtccccctggctgccgccaaccataagcgcgtagccgcggtcgatgccccacacgccgccggagacgccgcaatccatgaaatggatgcccttcggctccagttcggccgcgtggcgtgcgtcgtcggtgtaacgggagttgccgccgtcgatgatcatatcgcccggctgaagaagctcggcaagctcgttgatggtgctgtcggtcgcttcaccggccggcaccatgacccacaccagacgcggggccttcagcgcggccaccagttccttcaggcttgccacggtgcggtccgactcgggggagtggtcgtagccgaccacctcatgccctgccgccgcgatgcgcttcgccatgttgccgcccatacgtcccaggccgatcattcccaactgcatgatgtgcttctttctctaaaaatggttgaaaagtttttgcgattttgaataaggattgatgccgcccgttggcttcccgcgccttccgcaacgcagaaaagaaggttgcggcaagctttgcgggcggcaagttttggttatgttttgggttatgtgagtgtggttgcgattgctgcgttcagtgcgtcaaagcaccagcgagagcagcatcacgcagcccagaccgaccaccgacagaatggtttccatcagcgaccaggtcttcagcgtctggcccacgctcatgccgaagtattccttgaccagccagaagccggcgtcgttgaggtgggagaagaacacggagcctgcgccgatggccagcaccagcagtgccagatgggtcgggctcatgccggcggcgagcggcaccatgatgccggaggcggtgacggtcgccacggttgccgaaccggtggcgagacggatgagcacggccaccagccagcctgcgatcagcgggttcatggcggattcggtgatggagttggcgatcacgtcgccgatgccggagtcgaccagcgtctgcttgaagccgccgcctgcggcgacgatcaggatgatgccggccacggagccgaaggactgtccgaccatgccgttgacggcgtcacgggagaacttctgcatgtagccaagggcgaccatggcgaagacggtggtgatgagcagtgccacgagcggggtgccgaggaacgcgatcacacggccccaggcggtggtgttctgaccggtcagatccacgatggacgcggcgagcatcagcacgaccggcagcaggatcacggacagggcggtgccgaaggacgggcggttttccgcggacttcggagcttcggcctcagcctcgttctccggagctgcgatcggaacccacttggcggcgagcctgccgaacagcgggccggagatgatgacggtcgggatggccacgatcaggccgagggccagggtgatgccgaggttcgcgttcagcgcgccgatggcggtcagcggaccggggtgcggcggcacgaaggcgtgcagcgtggacaggccggcgagggccgggatgccgagcagcaccacaggggacttggaacgacgggcggcgaacagcaccaccgggatgaggatgaccacgccgacctcgaagaacatcgggatgcccacgatgaacgcgatcagtgccatggcccacggcagacgctgcaacggtgtcttggccatgatggtgtcgacgatggtgtccgcaccgcccgacttgaacaggatggtgccgatgatcgagccgaacgcgataagcaggcccacgttggaaatcgtgccgccgacgccggaagtgaagctatcgaacgccttgtcgaacggcacgcccgcgcacacggccatgacgaatgagccggcgagcagggacaggaacggatgcaccttgcatgccgcgatgagaagaacgatgacggcgatgccgatgatcgccgctgcgatgagattcatgaatcctccttgactcgttgaatttctctttcgatttttagttatgtgcgattattttgcgctgtgttgcggcttgcgccgttcactcggcttgctgcgattgcgaggccaccttcgccgcgtactcgttcactgcggcgacggcacgttcgaccatttcctcgacgctgccttcgatggagacttccacgccgttctcgtctggctggagcggctcaagaatggcgaactggctcggcagcagtgccggcggcatgaagtggcccttgcgctcgttgagacgctgctggatgagttcctgcgagccggtcagatgcacgaagaaggtgggaacgttctgggcgagcacctcacggtagctgcgcttcagggcggagctggagaccacggtgttctcgtccagcgcctcgcgagccaccatccaggtgttgatgaccttgagccacggccaacggtcctcgtctgtcagcggaatgcctgcgctcatcttgtcgatgttggcctgcggatggaagtcgtcgccctccgcgtacacgtatccgagacgttcgtgaatggcttctgccacggtggatttgccgcatcctgcaacacccatcaccactacgtgaatgctcatgttgtcctccttgaactctgctgtattgccagtgccacttcgcatcggcgatgacatcaatatagctatgaaaggtagtactagtcaagttaaaagtactacgaataaaaataatcatgcgacttgctatgctgtaggtagtacaaatcggcggcaaatcgcgcgaatcgtgcgggggtaattattcggacgtcacgcgaacggcaatcgtatacggcgtgtcgcaaaaacctgaaaaaagatttgcacgcacaacgagaggaattgtggatggcaggaaacgaaaacggcggcgaactgctgcaggatgcagtgtgccgcacgctggccatcgaaatgctggacggcaaatggccggccggtgaaagcttgacgttggaagacgtgcagaaccgtttcggcatctcccgtaccgtggcgcgcgaagtcgccaaaacgttggaatccatgggtgcggtgacggtgcgccgacgcgtcggattggtggcgcggccgttctccgactggcaggcgctcaaccatcaggtcatcgaatggcgactccactccacgcagcgcgagcggcagctgtcgtcattgaccgaattgcgattggcggtcgaaccggctgcggcggcctcggcggcacgcctcgcctccatcgacgtcaaggcgaaattccccgtctacgcggcgcagatgcgccaaatcgccgaatcaaacgaagagggggctgccggcctgaccaaattccacgatctggacgtggaattccatactttgatactgcgcgaaagcggcaacgaactgttcgccgcgcttgccgacaccatcgccaccgtgctgcgcggccgtgtggaactcggcaaatacccgatgaagccgaagccggccgcgctcgacgcgcacgatgcggtcgctgacgcgatagcgaagggcgatccggaacgtgcgcgcaaggccatgttcgacatcgtcgacgaagtggcccgcgcgctcaacttcttctaaaaccaatcgctaccggcgtcgaaccgccggattcgcggtcaaatcacaggttcgcgtcgaccgtctgacgcaggtcgtcaacgatttcgcccaaagtctcgctgaacaccgcctgatcggcgtacatcgaatcgaacagcgtatcgatgtttttgcggaaatccttcggcagaatggcgcagtcgcgttcggcgagcttgtcgagacgcttctcgccgggatgcgtgcggcggttcagcgcgaatagcacatcgaaatacgattccatgaacgcggccatgcgatggttgaccgcgattttgtcgcctcggctcgcggccttgcggatctgtgcgtcgtacgacggcaggttgccggtaagtagacgcatgttgcgattgatgatgttgcggcgcagttcctcggggaacggcacgtcgaaccgctgtcgggtcgcggcgtactggccgtcgcggtcgaacagcaccttgctggtgagcatgttgtgccacatgcacgtcgtatagccgttgctggcctgaaaccgttccaccacgtcggcgacattggctgcgaactggtccagatcgcggtacagcacgtcgatattggtgccgtcgttcagcgtgcagtcgtcttcggtctcccaaaaatcgttgtcgatttccatatggctgcaatagttgcgcagcagcctgcggcggcgttcggcagacacgggtgcggtgacgtacacgtagacgtcgtaatcggatttttcatcgttatcgccggtggcgcgtgacccacccaacgtgatggcctcgacttccggccatgcggacactgcttcgactagttcatttgccaatgacatcgtttacctctctctgcgtcattgctggagcggcgctacgttgcgccacggtgtgcaaacgatgccagtataacataccagatggtaactgtcgaagttgtgccggcctacgcggtttcccgcaggccggcacagcgcattccgccgaacgacgattgtcaggcggaatgctatcgagcgattgctgtcgagcggaacgctgtcggacggcagctgtcagtcgacggttgcggcttccgtcgaacccttggtcggatccttctgcagaagcaggaagacgagcgcgacggccagcagaatggctatcgacaacacgccgatcgacgcgttgccagtcagcgacgtcgtggtagcgacgaggaacgtgccgataatcgacgccgtcttgccgaaaatatcgtagaagccgtagtactcgttggcatggtccttcggaatgatcttgccgtaatacgaacgggacagcgcctggatgccaccttggaacatgccgaccagaatcgccagaatccagaattcaagtgcggcgcgcaggaagaacgcggcgaagaagacgatgcacatgtacgccaccacggccgcggtgatcatggttttcgagccgaaccggcctgccagcttgccgtagatgatggagcaggggaacgccacgaactgcgtgacgagcagcgccacgaccagctgcgtggagtcgatgcccagctgcgtgccatacgacgtgctcatggaaatgacggtgttgacggcgtcgatgtagaagaagaacgcgatcatgaacatccacagcggcttgttcttgcggatggcgcggaacgtggagccgagctcggcgaacgtgccgcggatggcctcgcctgcctgccccgcggtggcgcggtaatgcacctgcttatagctggtgagcagcggaatggtgaacgccacccaccacagcgcggtgatgacgaacgaggcgcgcgtgcaggctgtggtcgaccagccgaacagcgcggggcctccgaaaatcagcgcgatgcagacgatgaacggcacggtcgaaccgatatagccccatgcgtagccgtgtgaggaaatgcggtccatccgttcgttcgaagtcgtgtccaccagcatggagtcgtagaacgtaagcgaaccattaaggccgatggtggacagcacgtacacgatgaggaacgcgagccaaccaagcggcatcgccatcgcgcagcacatgaccacgcccgtcaggaagaagccggtgaagaagcggatcttcatgccctgcacgtcggcgatggagccgagcagcggcataagcacggcgatgacgagcgatgcgatggtctgcgcgtagccccacgtcgacacgatgttcgtctcgccggccgccttgagcagcgaattcgcgtagatcggcacgacggcggtggacagcagcacgaacgcggaattgccgacgtcgtagacgatccacttcttctcgcgtggcgtcatcatatgcttggattgctggctggattgctgcggctgctgggcctgcgcgttctgctgggacggttgggtctgcggctcggctgtgtcggtcaatgttgactcttttcggctaaatgtcaatcttatggctcatcttattccattacttcatcgtacgggcgtggcgggtggtaacagaccattcgacatgaacagcgcatgaacaagcatgttctgcccgtacgggccgcatacgcgtgctgtcgagacatggcaaaaacggcggaatatggggaatgcaagccgattttcgtccacaagtttgcgattggccggggctggttgtatagttgagaagttgtgtgttctgccatgcacttcgttgtgtggtgtcgaacgcgcagacttgcaagtcaatagtaattatagggagtccattatggcagctcgttgcgcagtgtgcggcaagggaccgcagaccggtttcaccgtttcgcactcacatattcgcaataagcgcaccttccgcccgaacctgcagccggttcgcaccaccatcgacggcgagaacgttcgcgttcgcgtttgcgtgaagtgcatcaaggctggcaaggtccagcgcgttgaagcgtgaatcgcgaaataacagcttgaaaccccggtaagccgaatggccgccggggttttgctttatctgaccgtccacaagccgtgttgcggcgaatggcgccgccacgaataatggggaattcagcccgccgcacaatcatccggtcgtgacacaatggagtgttatgagcaccacatggcaaaccccgatttcctcgttcgaaacgaaccgccgcagagtcggcgcgctgaaatcgctgggcgtggtgtccgtgggcgacgcgctgacctactatccgttccgcgtcaccgagccggtgccggcacgcgccctgcgcgaagcgaaaataggggagaacatggccttcgccgcgcacgtgcgtggcgtgcgcgtctttccgatggcccgtcgcggattccggctgatcgccgacgttgatgacggcgatttcgcacgcagccggcacatggacgcttccatggcgtctctcgtgttcttctcctatcgcaagtcgtacgtcgattggatccagcgcaaactgcacgaaggcgcgttgctggtggtcgcgggcgagccaagcgtatacaacgaccgtctgcaattcacccatcccgacatactgacggtcgatccagccggcgagcaattgcgcagccgctcatctgaggaagccgccgaatgggatgacggcttcggcacggaacaaccggcggtcgtcccgcaatcgtcgaccatgccgaatctcaaatacgatgcggcttccgtaccggaggcgatgcgccacgtatgccgcccacgtcccgtctaccacgcgaactcgcgcatctccagcgaacacatccacgagtcgatcgaaaaatgcatggaccggctgtgcggtgacgaatacgctgcggcacaggcagcccgtgcattgcatggcgccgatgccagcgacgcgcaacatggggaattcgacgcgccgcaagccgaccggcaggcacggacggaagcgcttgccgccgccattcccgacatcatgccggaagcgtttcgtatggaacatgggctgatgcaccgagccgaagcgttcagggcgattcacgatccgcaaaaccgcgacggtttcaacaaggcgttgcgtacactgcgctacgaggaagcgctcatctgccaaaccgcgctggtgcagtctcgtgattcgtcgcgtaaggccacggccacagcctgcgccgacacgcggctgaaagacgatttcgtcgagtcgctgccgttctcgctgacggacgggcaacagcaggtgatcgccgatatttccgacgatatggcacgtgattaccccatgcaacgcctgctgcagggcgaggtcggctccggcaaaaccgtggtcgcggtggcggctatgatgcaggccgtcggctccggcaaacaagcggtgctcgtcgcgccgacgcaagtgttggcggaacaacattacagcagcatccgcggcatggtggatcggatgtgtggtaccggcgaagaggctgacgaaaacgcgaaatcaggggaatcgcagacaaaatcaacgcaccgtgcggttgtggatgaaagtggacaagtcacgtcgggaaacgcgccggaaccgcaaaacggtggacaatcggatggcggccaggtggagaaactgctggacggccaatcgaacagcctgccggacattcccgtgctgctgctcaccggcggcatgaaactcgccgcccgccgacgcgtcctcgcgcaagcggcctccggcaaaccatgcatcgtggtggccacgcacgccgcgttctccaaaaccttccaagcgcccaacctcgcgctggcggtcatcgacgaacagcaccgtttcggcgtggaacagcgcgaatcgctgaacgccaaaggctccacggcaccgcatctgctggtcatgacggccacgccgattccgcgcaccgcggccatgacctggttcggcgacctcgacatctcctggctcaccgaactgcccggcggccgcaagccgatccgcacattcgtcgtgcccgaagcgaacggcccgctgatggcggaaatgttcggtctgattcgcaagcgtatcgacgcgggggaacgtgcctacgtggtctgcccgcgcatcgacgccgacgcgaaggatgccgacgatgcgggcggttcaggcgatgcggaagtcggttccgcattcgacgccacatacgatttgggcgaggatgacgaacagcgcgaacagcggccgccgttgcattccgtcgcggaaatcgcggaacgcttgcgatcgctgccgcaattcgctggcatccgtatcgccacgctgaccggccgcgacgatgacgaaacgaaatcgcagattatggccgatttcgaagcgggcgtgacgccgattctggtggccaccaccgtcatcgaagtgggcgtggacgtggcgcaggccagctgcatggtgattttcgatgccgaccggtatggcctgtcccagttgcaccagctgcgtggacgcgtgggccgtggaggcaccgaatcgggcgcgttccttatttcacgtgcgccggaaggcagcgatgcggccaaacgccttgacgtgattgccggcacgttggacggcgccgaaatcgcacaggccgaccttgaattccgcggcgcgggcgacgtgctgggcgacgcgcaatccggcggcaaatccggactgaaactgctgcgcgtggtcaaagacgtgaagatcatcgaggaagccagagcggaagccgcgaaactggtggccgaagaccccacgttgcaagggtacgtgcagcttgccggcgcggtgctcgacttcacgcgcggcaacgagacgttcctgaccagcaactaggctcgatggttatgcgcgtaatttcaggacgattcaaaggcatggcgttgaccacgccgaaaccgggcaccaggccaaccaccgaccgtaccaaggaagcgatattctcgcacctcgattcgtggggcgtgctggatgacgcacgcgtgctcgacctgttcgccggaaccggcgcgttgggcatcgaagcgctgagccgtggcgcgcgcgaactggtggcggtggaatcggccgcaccggccgccgcgctgatcgcaaagacgttgacggcgttgaagcacaaccgttcctgggagccgggcatgagcgcccgcgtggtcaaggcgcgtgcggaaaagtacgcggcggccgcatcggcgattgcaccattcggcgtgatcttcatcgacccgccgtacgcgttcgaaaccgaggcgtgcaaccggctgctggccgatttggcgggccgtgagtccggcgaactgactggcgagggcacggtgatcgtgctggaacgctccactcgttccgacgagccgaccgcgcccgaaggctgggatatcaccgaccggcgtgattacggcgaaaccgccgtgtattacatcgaacctgccgaaaccgccgagccggcagagccggttgaatccgcggactgacgtccgggctttccaactaaaaacgtcgacggtggacctgcatgccctccgtcgacgtgaacaatcgtgcgtaatcagcgctgccgtgggtgcgcgccggaaacctcccagcccaacgccatcagcgttttgcgatcggccttgtcaagcttggaacaatccaacgcctcgatgagatccggacgcagctcgttggtcttcgccagcgcctcatcgcggcggaaacggtcgaccttcgcgtggtcgccggacaacaggacgtccggaaccttgataccgcgccaatcggccggcttcgtatactggcggtgctccagcagggcgttctctcccgtatacgattcctccacgatcgaggccgcattgcccatgaaaccgggcagcagacgggtgatggcctccaacatgaccgacacggccacctcgccgccgttcagcacataatcgccgatcgaatattcacgcacgtcgacgccctgcgcacggtaatactgcggaatacgcgcgtcgtagccttcgtaacggccgcagccgaacagcagatggttggcgtggctcagctccgtcgcgtcctgctgggtgaacaggggggcggacggattcgggaaaatcagcaccggacggtcggtcgccggaacggtatcggcatttgcggcgatttctgtcgccgattccgccggttcggccgcgtccgcggaagccgtgtcgtctgcgtctgccgtggaatcgcaagtaaccatggaatcgcaagtaaccgtggtcggctcaagatgcagcagctcgtcgagacattcgctccacacttccggcttcatcaccatgcccgcgccgccgccgacgggagtatcatccacggaatggtgcacgtcgtgcgtccagtcgcgcaggttgtgcgcggtgacttcgaccaggcccttctcctgcgccttgccgagcaggctcaggttgagcacttcgaaatattccgggaatacggacacgatatcgatcttcataatgttccacaataccggtacgcctgccaagcgcggcgcgtacgaacaaggcgccggcataatcgccagcgccttgttgaaaaagcagcggatcagagccccggaatgagtccgcccggcgggtcgagggtcagatatccgccctcgaggtcgatgtccggcacgagctcgtccacgaacggcacgagcgcgctgttctcgaccaccacgccatcggcgtccttgacgggattggccagacggatcttgagcagccactgggccacttcaatcacatccaccaccttgcctaccacagtgccgggcgcaagccccagcgtattgccctcggcaaggcgcgcctcaagactgatcaggtccttcgggtaccactcgtctgcttcaagcatctcctccggatcgtccgcttcgccatatagcaccacgccattggcggcttcggacgcatcacggtcgtcgatgccttcgaatttgatgatccaacggttcttgaaggtgcgggagctttccaccacgtactcttcctcgccgtccttcgtatacaacacagcaccgggagcgaaccggtattccggttcgtccgtaaagatctgcacggtgacctcgcccttgagcccctgcgcacgcccgatacgacagaccctcagcagctcaagctgttgagggtcgtcggaatgcatatcacgcaccacgctaggatctcacctgcgcacgtccatgatgtcgacgcgcaccttgtggtcggacagtgcctgcaccacggtgcgaatcgcatttgccgtgcgtccgctgcgtccaatgacgcgaccgatatcctcagggttcacgcgcacgcgaatgagttcaccgcgcggattctcatgggacttcaccgagacatcatcgggaaaatcgacgatgttcttgatcagatgttccacagcctgggcgagcatgatcactcggcttccgcagccggctcttcagccggagcttcctcggtggcggcggcttcggcctcagccttggccttggcgtcagcttcggacttggcggccttcagcttctgggcctgggcttcgacagcctcgacgcgagcggcggcatccgggccagcctcaacggtcttcagggtgccttcagcaccgtcaagacccttgaacttctgccagtcaccggtgatcttcagcaggttcagcacctgctcggtcggctgagcgccaacgccgagccagtactgagcgcgctcagagttgatgttgatggtcgaaggctgggtgttcgggttgtaggtaccgatctcttcgatggcgcggccatcacgcttggtacgggaatccatgatcaccacgcggtagaacgcgtagaacttcttacccatgcgcttcagacgaatcttggttgccaaaatggctctccttgtaactaggggtgtgtgtttcgtgttctgtgtggggcacggaatccgaaacccacgtgttcctcacgtcacgcgattggtagagggcctcgcgcgcgcgaataactgagcaattataaccgtggggtatggacgcgttcccgtatgcgttcccgagcgtccgtttctgttgactcggacgctcggcttgcgttttgcgcattctgaatggccgtttctccagaatcggacattggtgaggtgttgtggcggtctcgggcgtccgaatcacccgaatcggacgaactcgctatgctggatatgttcattggcggttttcgtgcgcctgattatggccatttcaaggggatttgcatgagtgttgcgttgtggatcgtactgctggtatgcgtgttgtggatcgctctgagcgaaatgccggccggttgggacggccacttgccgttgccgtatctgattgcgctgacaccgctgttgtggattccaacattggcgattgcgattgccggtgccgtacggcatgacaccgccctcgccgtcgtcgcggcgatcgcgtgcatcgcctcgctgctacgcaaaatcgcgtattggaacaacaatctcacgtccatcaacacggcgcagatggtggccgacaacatcgcaaaaaagcgtgaaacatcccgtggaacacatacgtcgactgccgcggaagccgcgaaacacggccgtttccgcgtgatgacgctcaactgccggtacggtcgtgccaatgcggccgcaatcgtcagcgccgtcaaggaacacgacgtcgccgtgctcgcgctgcaggaattgacggacgatctggtcgcggccttggacgaggccggcctgtccgatttgctgccgtaccgccagttaggggagaacaaagatacggacaacggcggcttcaacggtatttggattcgcatcgagccaagcgacacgtcgccgatcaccgccgtgattcccgccgccgacgtgcctggcgtgtgcttcccgattgatgcgatgcgcggcatcactttcgtttccgcccatccgaaatcgccgatgcgcggctgccgcgactggtccgccggcatcatcggcttgggtgagctggccacatcgcagaagcagggcgatatcaccgtcgtattgggcgacctcaactccggtaccgaccatccgagcttccgcaagctgcttgacgccggcttccaggacgccgcgttgaccgaggcgaagggccgccgcgccacgttcccatcgtggctgccgtggccgcgtctcatcctcgaccacatcttgttcaccgccggtctgaccgcatccgacgtgcgctccttcacggtcaacggtaccgatcatcttgctctggctgccacgctgacgttgaaataaaccgaaaataagctggcataacgaaactgccgacgctggaaaacgttccaacgtcggcagtttcgttatatatgccgtattgcgattgccggttgtcgtaatcgccggcaatcgcacatatcgcggcttagtgcagcagacgcttagtgcagcagaccggacagaccgccacctaagttcggcggcagctcgccggaatcgcccagcatatcctgcaatccggcaggaagcgccggattctgcggcttcttggcgaacgcggagccacctgacgaagcgccgtcggaagccttgccggcgagcttgtcgcgcaatgccttctcctcggcttcacgcttcatcggattgccggacttgcccgacttcttcttgttcttcttgcctttgcccttgcctttgccgccgcccatcgcggggcctccgaagccgggcacgccggcgccgaccttgttgctcatgcggcgcatcatcttcgcggcctggtcgaagcgctgcagcagcgcgttgacctgcgaaaccgtcacgccggaaccgtaggcgatgcgggcgcggcgggaaccgtcgatgatcgagggatcgcgacgctcggccggagtcatcgaacggatgatggcctcggtgcggtcgatttccctctcgtcgaactgctcaagttccttacgatgcgcggccatgcccggaatcatgccaagcaggtttttcatcgggccgagtttgcgcacctgctgaagttggtcgaggaaatcgtcaaggccgaaggaaccgtcggagatcttgacggcggccttgcgggcctcttcctcgtcgaactgcttctgcgcctgctcgatcagggtgagaatatcgcccatgtcgaggatgcgggacgccatgcggtccggatggaagacctcgaaatccttcaatccttcgccggtggaggcgaacaggatcggcttgccggtcacggatgccacggacagcgcggcgccaccacgggcgtcgccatcgagcttggacagcaccacgccggtgaaatccacgccctcgtcgaacgccttggccgtctgcacggcgtcctggccgatcatcgcgtcgatgacgaacagaatctcgttcggctgcacggcatcgcggatgtcgcgagcctgcttcatcagctcctcatccacgccgagacggcctgcggtatcgatgatcaccgtgtcgtaaagcttctgcttggcgagctccacggcgtcacgggccaccttcaccgggtcgccggtggtctggccgggggagacgaccgcttcgccgccatcggactgcacgcccttctccggcgcgtacaccggcacgccggcgcgttcgccgaccacctgcagctgcgtcaccgcgttcggacgctgcagatcggccgccacgagcagcggggtgtggccggaatccttcagccagtagcccagcttgccggcgagcgtcgtcttaccggcgccctgaaggccggcgagcatgatgatcgtcggcggattctttgcgaagttcaacgggcggtccacaccggcgccaagcaccgcggtgagttcctcgttgacgatcttcaccacttgctgcgccgggttgagcgcttcggaaacctcggtgccgagcgcgcgttcgcggatgcggctggtgaaggaacgcaccacgtcgagcgccacatcggcgtcgagcagcgcgcggcggatctcgcggatggtaccgtcgatatcagcctcggaaagcttgcccttgctcttcagatgcttgaacgcattcgagagccggtctgtcaaagaactaaatgctgccataatgttcctcagtctagcgtttcacgcggatagcggatgaaatgggtgcgattgcctacttcagcgaccaagtggagccttgcggaccgtcctcgatggcgatgccggccgcgcccagcgcgtcacggatcgcgtcggcacgtgcgaaatccttggccttgcgcgcttcggcacgttccgcaagctgttcggaaaccagcttgtcgagcgcgtcatgctcggcggaatcggctccggcaccagccgcaccacctgcggcaccgtcggaaacccacggctccgccagcggatccaagcccaacgtgtcgagcatcgcacgcacgttcaccagcgcctcgcgaacctcggccttcgccacgtccgaatcggcgcggtcggccagcttcgacagcaacgtgttgccggaacggatcgccgtgaaaatcgcggcggaagcgcccgaaacgttgatgtcgtcgttcatcgcggcaacgaaatcggcgggaagcgcgtcggcggaaatcgccataatctcttctcgtgacggctgttcgccgacggcagcgcccgcgcgctcgatgaagttcgccacgcggtcgtacgcggactgcgcctcggcaagcgtctggtcggaccattccagcatggaacggtactgcacggaaccgagggcgtaacgcaccacccaagcggaatgctcggccagcaccgccggcacggacaggccgttgccgagcgacttcgacatcttctcgcccttcgcggtgacccaggcggaatgcatccagcgcgcggccgaatcgtaaccggcggcgcgcgtctgcgccatctcgttctcgtggtgcgggaatcgcagatcaagaccgccgccgtgaatgtcgaacatgtccttcagatagcggtggctcatcgcggagcattcgatatgccagcccggacggcccgtgccgaacggggtattccagcgcgcgtcgagcggatcggaatccttcggcgccttccacagcgcgaaatcgcgcggatcatgcttgtcgggggacatgtcggcagggtcgaccggattgtacttgtcgttgcccgcgttgtccacggacggtcccatcgcgtcggtcacttcggaagccgcgtcggaaaccgcggtctgcttctggtgcgtcagctcgccgtaatgcggccagctcgccacgtcgaagtagacgttgccggtcgggttgccgtccgcgtcacgcaccacataagcgtggccgttgtcgatgatcttcttgatgaggtcgatcatgtcgatcatgtggccggtggcgcgcggctcgtacgtcggcggctccacgccaagcttgctgtacgcctcggtgaactcgcgttcgtagatatacgcgcgctcccaccactgctggcccgcggcggcggccttgtcgaggatcttgtcgtcgatgtcggtgacattgcgcacgaacgtgaccttgtagcccagacgctcgaaccagcggcgcaccacgtcgaacgcgacggcggcgcggatgtggccgatatgcggtgagctttgcacggtggcgccacacgcgtagataccgacctgacctggtttgatcggcgtgaaggacgacacggcgtgcgatgcggtgtcgtacagcttcagccccgcggcggccttcgccaccgcaagagcgccggaagtgttggtattctgcggttcttgcgtgtttgtcatagtcacgagaatattgccagaatcggacatgacgcttggttttcccggcatatgcacggcatcgtattgcgaacgtatgcagacacagagccgaatcgcgagcgtcatttacgcagatgatgtaaaaatagtggcatgacgcaatcgcatgtgctgattcttcaacacgtcccgtgggagaaaccggggcgcattttggatagtctcgacgacttgggcatgtcgtatgaagtgatgaacatcgccaaagagaaaaagcccgatcttcccgatttcagtgacgtctccggcatcgtgattatgggcggccccatgggcgcgctcgacatcgacaagtatcccggtctcaaagcggaatccaaactcgtacgcgccgccgtcagcgtcggcaaaccgttgctgggcgtgtgcctcggacatcagatcattgccaccgcgctgggcgcgaaactcaagaagggcagcgagccggaaatcggattcgcgccgattaaacgcatcgacaagcacgactacttctccatgtggaacaagacgttggacgtgctgcactggcacaacgacgtggtgaccctgccggaaggcgcacagccgttggccaaaagcgcgaagacgaagaaccaggcgttccggttcggttcggcgcttggcctgcaattccacctggaggtcacccccacgttgttggacgagtggctggacgagccgtgcatggtgaaggatttgaaggccgccggcggttcgaaatcgcagctacgtgacgccttcgccgaatacaatccgcagctgcagccgatggccgatcaggttttctccggattcgcggcccggtgcaacacctatgccgcaacgctggagcgctgataagcgttctgcccgctacacgccccactgaatcgccagctgagtgccttccgtaggtggttcctgagttccgtaggtggttgggtgatggaccagtgtttcggaaaggctgaatttaaggcttttcttcgtgcggtatccgaagacaaccacctacggaagcggaaaaccacctacggaatcttctagggcgttttcgttgcctacattccaaggtctcctgtctacgtttcgcatcatgcagctggtgagcaagccccaaatacgtgtgcgggaggcggtgttccgccgacgcgctacattggtgagttatgccgacttatgatttgggacttgaacacgtttcgctcgctttcgcgaccaagaatattttcaccgatgtgacgcagggcgttttcgaaggcgaccgcatcggcgtcgtcggcaagaacggcgacggcaaatccacgctgctgcacctgttcaaaggcacgcaggaaccggattccggtcgcgtgaccatgcgcaatggactgacgttcggcatgctcgaccagcgtgacccgctcgacgacaacgccaccgtgcgcgaagccgcgttggaagggcgagaagattacgaatgggctgcggaaaccaaatcgcgtgagattgtggaggctctgctgggcggcatcagtctggacgcgaagatcggctccctgtccggcggccagcgtcgccgcgccgaccttgcccgcctgctgctcaaggactgggacattctcgcgcttgacgagcccacgaaccatttggacgtggtgaccatccactggctcgccgagcacttgaagaaccgttggccgtccggccagggcgcgctgctgctcgtcacccacgaccgttggttcctcgacgaggtatgcgaatcgatgtgggaggtccacgacggcgtgatcgacccgttcgaaggcggatattccgcgtatatgctgcagcgcgtggagcgcgaccgccaggccgacgtgcgcgagacgaagcgccgcaacctggctcgcaaggagcttgcctggctcacccgtggcgcccgcgcccgttccaccaagcagaagttccatgtcaaggcggcgcgcgagctcatcgccgacgtgccaccggtgcgcaacacgttggagctgaagcagatggccacgtcgcgtctcggcaaacaggtggtcgatctcatcgatgtgacgcagatcttcgaacatgcgcagggagaggccgatatcgatccggatgtggcggaaatggaagcttcggcctcgcgcgtggacgtggtgccggccatgtatgccgagccgcaggcgcacggcagcgtggaggtcgccgtcgacgatctgaccgatccgcggttggtggacgccggcgtgcccgaggcgcgacaggcggcgcaggccgcccggcaggccgaggaggagtcgcacgagtcgggtgacgacgccgacgagtccacgccggaagtcacgtccgcggcgcagaaggtcaccgtgaccggccgcaagatcctcgacgacgtgacgtggctgatcggcccgggcgaccgcttcggcatcgtcggcgcgaacggtgccggcaaatcgaccctgctgaagatcctcgacggcacgatcaccccgaccgccggccatgtgaacatcggcaagaccgtgaagttcgcggtgctttcgcagcgtctcgacgagctggagaagctcggcaagtacaagatcaaggaagtgctgagccgctacaagccgagctacatcgtggacggcaaggagaccacgccggggcagatgatggagcgtctcggcttcgaatccgcacagctcatgacgccgatcaaggacctctcgggcgggcagaagcgccgcatgcagctgctgctcatcctgctcgacgagccgaacgtgctcatcatggacgagccgggcaacgacctcgacaccgacatgctcgccgtgatggaggatctgctcgacacttggccgggcacgctgatcgtcgtctcccacgaccgctacctgctcgaacgcgtcaccgaccagcagttcgcgctgatcggcggcaagatccgccatctgcccggtggtgtgcaggattatctcgacatgaccgaggccatcaagaacggtaaggacccgtttgtggacgagaaggccggcaaggctagcaagggcggtaatgccgctgcgtccacgggtgctgccggcgactcctcatccgtgtctgccgatggcgactcgactgcttccgcgccgaagcttaccggcaaggcgttccacgaggcgtccaagcgcgtcgctgcgatcgaacgcaagctggccaagctggaggaacagaaggccgatctggaagcgcagatggccgcgcatgacccaagcgattacgaaggtctgggcaagctcaacgagcagttgcagtccgtcacggacgagtctgaatccctcgaaatggaatggatggagctctccgaacagctcgagtagtcccagtcgggcaaactgatggtgagaggcttgtaggcgtcggtttggcggtacggaatgtgcaaaaccgacgctggcgattcgctcagcgtcggtttaccggaataattcgtcgtggctgccagtacgctcgaagaacgcgaccgaatcgttcgatgaccagatcaccagccagtccccggcattggcgacatggcattcgtaccgtccacgccaattgccggacagggtgtgcatgttgtggcggcggtgcagctcctccagcgttttcgggtgtgtagccattcgtgcgacagcaaggtgtagcgcttgagatatcagtgtcatattcttgttcttacgggggtggagctgttctccgcaagaacaaccaatgggggtgtctcatgaatcaagtgatgcgaagaagcgtctgttgtttgttgtcggctttgttgctgtgctcatgcgccggttgcgcgaattccgtgcacgaaacctccgatggtgacgctgctcggagcagcagcaagaatgatgatgctgcggagcaagcgtataaagcatttactgtggacgctttggaccgtgttgccgccgatgatctcaataactcggacaaattggttctggtgaacaagctgggcgcgaaatccgtgcacggcgatggtgctattccatttgccaaaaaggtcgacgaaaaccatatgtattatgtcgtctccatgtgcaaacagaaggagcaggctccttactcacttgtcctctacaaagatggacagccgcacactttaaccactagggaatcctgtacgtctaatggagtggaaacagtctctcttccggcgaagaatttccttggcgccacctcattgtccattatcaatatcggcaatacggatcttgttgtttccgtatatgaagtaaaggaaagccaccgtgaataaatgctggtggctggtttaatgtgtttgatgagttagcggaatcgctagggacaatgaccattcttcattttctgaatttatggtcattgtcccattatgttgttgcgcaaaatcttgtatgagggctgtcccgtagtgattttctggagcactatttattgcggcgttatatagatttgatgcgaagatgcggaccgcatctggtcctacagagaggataaaagcaaaagccccgggtttcccgtgtttggcaatgttattgagaatttcggtacaaaccgtttgcaacgatggtagtagtgacttgtccattgcgtttagattcccgcggattattggtgtcccggtaaaacccagtattctcagtcttttgcattgagcttctatatgttgttgaaagagctcgtccgcgtcttcctctttgtctgttttaagctcatcggtcatcgggctgatgatttgagtgcgaagctcatgtaatgcctgcatgaggacctgttcaatctgtggcaaagtgtcgctgctctctgaggactcttttttgcggcacagcagaatcgcatatgtcatagctcctgcgatggaatcgtgcagtatgtgaatttctttgagtcttttctgctggcgtcgaacttgttcttgtgcaatcgccaagtccatttttcgttgtgctgtttgcgctttccatctcacggcaaaaccaacgcagaatgctccaatgtaggagcatgcaagcacggggatgcttggattgtagtcgatgccgcctgtccaatagcccaaaggaagtgctagtgcgcaaagcagcggtcccatgatggcaaattcaaatcgtttgatttcaaatgcgattatcccgcatgcaagccatgtgccatataacgtcgaagggccatcgcatattgccgggattatcgcgcatgctatgtgtgttacaagaatcgccatgcttgccggtacggggaaccaggccagtagcagcagggcgatgcagtacggagccaaatatagccatgaccaaggtgacatatttggccaagcggtcagctcgagcaggaaaaagcagatgcagataatggatcccgctaagtagggcttgcgcacggcctttgccaatgacattatttgttggggcagcctcatcgttatatccaaccgtttcttacgcacatcgcaacagcttcggcacgactatgagcatggagcttctcgaaagctcgtcgtgcatatgtctttaccgatgcttcgctgatattcagttggtgcgcaatagtggaagtggtgaatcctctcgcatagccggcaatgatctgtaattccttgccggaaagccgcatggagtttatgctcttccccgcccacgacgcaacctcgtcatttccagtggcttttccgatgattcgaaccagttgaatcgtgggaatttcttttggaataatcgcataaaacgcatcggaccattgtgctccgtatcttttttcgttttcgtcatccaaaaaggcgctgataccaatgacggcaatatctggatgttgttccttgatatgatgcgctaattccgagccgttcatcccaggcattgcgatatcggtaagcacggcttgtggcctttgtgcagagtccctcatggcctcaagtgcttgttctgcagaggtgacagtccacagaatccgtattggtgcgcatgtctcgaccaacaagctttgaattgcgcttgcgaccagtggatcattatccacaatccccaaagtcggatcattgacaatcgtgcgcataatgccccccattagtctgcttcttgctccagaatagacattttcccactgctgcaaggaatcatagcgttgccggtagcgtatgtcgtgattgagatcaaagcacgaatatattgtacaaataatttgtatataatgggaggcgatggaaaggagtcttctacgatgaacgatacgaactccaacgaggggcagctgcccgaagacgccgcagtgaccgtgaccagtgccgatactcttcgggccatggcgagtcctattcgcatgaggatccttggaacgttgcgggtgaacggcgaacagaccgtgggaagcatcagcgagcagcttggcgaggctcccggagccatcagctaccacttggggcagcttgcgcatgcgggactagtgaaaaaggtggagtctcctgacggagatcgaagaaagagctggtggaaggcctgtcaaagcgccattcgtctgggaaggcccgaagaaaagaacggtacggacgagtcgaaggccatggatctgttccggcgttccgcggcgctctcctacgagatggcctacgagcgttttctggacaggctgccggaattgcctcgggaatgggctgattcatgcaccagcgatgatcatgttctgaacctgaccgccgaggagacgagctcgatgatcgaggaactcaatgaggtcgtgcgccgctggcagatcaaggccggcatgcacggcgacgatgagctgggcgtcgaacccgtggctctgattctgcaggccttcaggtgggtctcataagacgccggcggggttgacgcatgaatccacgagcaaaccggaaagcgtgggcggaacagtcggaacaagtgggttaattggagcaaagcatgagtgaaacgacgaaatcattctggcattccgcagggtatatcccgtggttcaccgccgatacggcgtcggcggtcggagcggcgctgcgcgcactggcgatcagtttgctcggatatgcggtgtccggctccaccatcgccgccgggtggctcggaacgtcgtcgatgatcgcgcaacaggttgcgagcgtattcggaggtaccttcgtcgacaggcatgaccgcaaacggcttatcgtggcgaacgccgtcgtcggcgttctggcttggggcgcaatcgcggtgctgctgctgtgcggcgcattgtcgttccccgtgttgctgttgatcgcggtgctcgcatccggcatcaacggatttcttgggagcgctacggatgcgatgcttcgctcgatcatcgatatccgctattatcccaaggcgcggagcctcaacgaggggcgcgacgcgaccatcaccatggtaggagggcccatcggaggtttcctgtacagcgtcgctccatggctgccgttcctggcgtcggcttgtatgtacgccgtggccggcgtcgccgccaccggcgtccgcgaatatggttcggatggcgggcgtatcggggaaccggatggcgatgcagcgaagggcggtttctgccacgatttcctggaaggctggtcatggtcgctgcatcggaaaacgctggtgatcgtgctcatcgtggcggcattggtcaatttcggcgtcaatggcatccaatatgccatccagctgcatctggtgtcgtgcggaaccaatgcgaccctcatcggattcatcagtggcggcatatcgttgacgatgcttgtgggatcgttgctggccggcaaactcagcgataaggttccggtcggaccaaccgtgtgcctcgcctacctgttcatctgcctgtgcgcattgccgatggcgttgaccgacaactattgggtcatgctggttgccaattcgttggttggcctgccgttcccgttgatcaacgcgatgctcctcggtttcatcttcgccaagtcgcctacgagcatgcaggggcgtattactgttacattgacggttccggcccaggtgctttcgatgttctgtagtgctgtggctggcaccttgctcccggtttttggattccatggcgcggtgctgttgttcctcgcggttcttgtggcaagtgctgtgctggtgatatgttcccgttccattcgtagcattcccaaggcggcgcaatgggaacatacgatgttgcggtgaatcgaaataaaaagcgccgccccacgaaacgaatcgtggggcggcgctttgtcgtaggcaatgccgctcagcccgttcagcgaccggtgatctcggagccgagcaccttctcgctcagggctttcgggccgcgggtcacggccaccgcgccggagcggaccagctcgatgatgccgtaatgctccagcagaccgagcagcgcatcgatcttgccttctgcgccggtggcctcgatggtcagcgactccggattcacgtccaccacgcgcacgcggaacagacgcacgatctccagcacgtcggagcggttggactcgtcggcggccaccttgatgagcaccaactcgcgctccacggtggtttccggatcgagatccacgatcttcagcacatgcagcagcttgttgagctgtttgatgatctgctcgagcggcacttcctccacgtcggccgtgacggtgacgcgggaaatgtccggacgttcggtgggggagacggacagcgagttgatgttgaacgcgcggcgggcgaacaggccggcgatacgcgccagcacgcccggacggttctcgacgagcacggacagcgtatgacgcttggaacccggctgggatgcaggatagtttgccatgatcgaaatgtccttccttacgctctactcgttcactcgttctcgccggcgcgctgcagaggcttgacaccgggcatgtaggtgacgttgtcgttggagtcgccggctgcgaccatcggccacaccatggcgtccttccacacgcggaagtcgatcagcaccggacggtcgttgatctcgttggccttcttgatgcattcgatggcctcgtccttggtgaacgcgcgcatgcccacgcagccgtacgcttcggcgagcttcacgaagtccggcacgtccacgatgtcagacatgttctcgccgtccagcaggttcgtggcggagtagtggtgattgtagaacagggtctgccactggcggaccatgccgtacacggagttgttgagcagggcgatcttcaccggcgcgtggtcgaggaacgcggccgccagctcttcggaagtcatctggaaggagccgtcgccgtcgatcagccacaccggcttcttgtcatcgaattcgcgggcggatccgacgcgtgcgccgatggccgccggcaggccgaagcccatcgtgcccaggccgccggaggacagccaggagtggggcttgttgaattcgatgatctgggtggcccacatctgatgctggcccacgccggacacccacacggtgttggggtcggccatgtcggacagctgcttgacgacccactgcggagcgaggctgccgtcggtcggctcatcccacgtgatcgggtattcctcacgccacttgttgatgacgtcccaccagtggctggtgtcgggcttgccatgcaccgcctgctcgcgcttgatctccggaatgaggtccttcagcacggtggccacatcgccgacgatcggcacgtccggctgacggttcttgccgatttccgcagggtcgatgtcgatatggatcacgcgtgcgcccggagcgaacgcgtcgagcttgccggtgacgcggtcgtcgaaacgtgcgccgatcgcgaccagcagatcgcaacgctgcacggcgccggtcgccgcgattgtgccgtgcatgccgagcatgccaagcaccttcggatcggaatcgggcacaatgccgcgcgccggaagggtggtgacgatcggagcgccggtcacttccgccagctcctcgaccagctcgcccgcgtcggaacgcaccgcgccgccgccgacgtacagcaccggacggtacgactgctcgaacagcttcgccgcgtcggacagcacgcgaccgtgcgccttggtggtcgggttgtagcccggcagaatcatgcgctgcggccaggaataatacatttcgccggtctgcgcggtcttggtgacgtccaccaccaccggtcccggacgaccggaacgtgcgatgtaatgcgcctcggccagcacgcgcggaatgtcctgcgcgcgggtgacgaggtacgaatgcttgaccaccggataggtggcgccgacgatatcggcttcctggaaagcgtccgtgccgatggcgttcacgccgacctggccggtgatgacgaccataggaatggaatccatgttcgcgtcggcgatcggggtgatcatgttcgtcgcgcccggaccggaagtgacgatgcacacgcccacctgtccggtggtcagcgcgtagccttctgccgcatgtccggcggcctgctcgtgacgcatcagcacgaagcggaacttcgtatcgtccttgatggaatcgtagacgggcagaatcgcaccgcccggaacgccgaagacgtccttgacgcccagatcctccagcgaacgaaccagcgcttcggcgccggtcatcttttcgccgtcgacaatggtctgcttttcagtggtagcggatgcctttggcatgccgctgaatgcctgcagaggcgtaggtaacaccatgttccctctcatgctcgttcgtggaaaatttcctcgtaaggggccgcggccgcgtcgttcatgcgccgttttaccccttaaacggaatgctatgcaaccgcttgtggcggattgcagccgcattcctctctgataatgagtctatgctaacggctgacagcttggttcgccggaaaggcccatattctggcgcgttacgcgccattgtgatatggaccatattttttgcgattgcgacgctgccttgtaatgctgtttcgtgacgccggccgtgccgccgcttgcgttaccgtttgcgcggttacttgccctgcgctgcatcctgcgtgccaccgttggacttgcgatgtgacctgtggtgcgacttatgcgtcttcccgttctgcttgccgcccatttcgcccttgcgactgtcaagcgccttccagcccatttccgcggccgccagctgcgccttgcgtttgctgctgccggtaccgacgccgatgacttcgccgccatcgccgagaatcgcgcgcgcggtgaactccagtgcgtattccggtccggcgaccgacgtctggtagtgcgggtcgggcagacccatctcatgcgccttgacggtcagcgacgtcttccaatcgagcgccggaccttcggtggcgacctccgccagcgtatcgtcgacgagatgatgcaccacgcggcgcgcctcgtcgatgccgtgctggatgaacgtcgcgccgatcagcgattcgacgatgtcgcacagaatcgaacttttgtccgcgccaccctgttccgcctcgccgtggccgagcagaatgtacgggccgacgtgcagcttttcgcgggcgattttgctcagcgattcctcggaaacggctttcgcgcgcattttggccagctggccttcgttcatgtcgggatgcaccttgtacagcgtttccgtggagaccagttcgagcaccgcatcaccgaggaattcgaggcgttcgtagttcttggccccctcatgctcgtgtgagaacgagcggtgggtgagcgcttcgacgagcaggtccggttcgattgtggtgccgagcgcctcgagcaacacattggcggtcatctcgccttcgggggtgatggaggtgccgatgcggccggcgttggtattgttgccgttttcggtttgggtgttgtcctgcgcgttgtcctgattggtctctttggccatggatgttccttaccgttcatgcggcgggccgagcctgccgcggtctgtggttgtggccgttgcgcacatggcaagacgccagctgatctggcggttttgctacgcaagcaacgtatgtcgtacgccgatcgcacgcggaaataaacgcaatgcaatcgccgtatcacttgataataataaaagaaaccctgccacccgtcgatggcagggtttcgatgctttataccgttatccggcaaccactcacttggtgtggatggagcggacagcctcgcggtacacgcggccgcggaaggaaccgcagctcgggcatgccatgtgcggcagcgtcggagcgccgcagttcgggcaggtaacggtctgggcggccttggccttccagtttgcgcggcgagaatgggtattcgcgcgcgaggtcttgtacttaggcagtgccattgtgtttcctctatttcgttcgaacgattgagcttaagcgttcagtatcttaacgtgagctccgtacaaacgatggaccatcccatccgaacggcttattccttgccttccagcttggctttcagcccttccagcgcggcgaaacgaatgtcggtcatgtcatgctgatggtcggggttctcgttgaggtcgatgccgcactgcgagcacaggcccttgcaatccggcttgcacaacggctgcagcggcagttcctcgaccagcgtgtcgcgcagcagcgcctcgaggtcggcccatgcgccgccgtcgagcagcgggtacgtgtcttccgcctcgtcctcgccggcgatgatgtccacttcctcttccttgccgttcttgccggcctttccgcccttgccggcggcggacttgtcctcatacgggaagaaggaggtgacgttcaccgtccaatcgcgctggatcggcttcaggcagcgcgtgcattcggcatgcacgggagcgctgatacgcgcgttcagaatcagaccgtcgacgatcgaatcgaacgagccgaccacgctcacatccgcgccttcgtccacgccgacgatctcatcgccgatgccgctcggcgcggggaaagtggcgtcgatctccttgctttgccccggacgcgaggccacctgcgccacggaaacggcccatggggaatcttcagtacgtgccatagttcagtctttcgctctttcttgctatgcgttccacgcgtgttacgcgtcttgctcagttttccggataatcgtccgcatcgagatggtccagatgcgcgccggcttcgcgttggcgatcgtacagcacgttcaggcccgcctgcacgccggtgccgatcttgtcgacctgctgttgcaacgattccatcatggtgatgcagtatttgtcggcgttctgcgtgagcttgtcggccttggcttgcgcctggtcgagaatgccgcgcgccttctgcctggcgagttccgtcacgttctcctgcccggcaaggaactgcgcctgctcgttggcttcgcgtacggtgtcggcggcacgcgactgcgcggatgcgatgatcacgttggcttgcgtttgcgcgctttccagacggcgttccgattcgcgcatcagcgcggaggcgcgttccagctgcactggcagcatcttcttgagtttgtcgagcttgccggtgaacgattcgcggtccacgcgcaccgagctcggcgcgaacagaatcggcttggcctcgtccaattcctcttcgatgctgtcgatgatgtcgtagacggtggtgaattcgtcgcggctgcgatccgaactgtcgtcgagtggcgcatcgggatcgaacgtggcacgaaggtcgggcaggtccgacatggaaatcgacggtttcgacgatttcgcgggctttgccggctcatccgtagcacggtcggcggcattgccggttgcggagttgttggtcgctgcggtaccggcaacagcgccggtggccggataatcggccgccggcgtgaccggctgctgcgacgtggcgtcatcggcgtcagcaagcggcttgaaatcgttggtctcttcactcatcatgctctcttttcgttcttgagcgcctcgccgagcagtggaatcacgcaatcgggcaccatgcccgtcacatcgcctccgtgccgtgccacgtccttgacgatggagctggagatgtgctccaggtccggggccgcaggcagaaacagcgtttccactccggcgagtttgcggttgaccaatgccatgcccagctcagcctcgtaatcgccgttctgccgaagtcctttgacgatgaccgtcgcaccgattttcgtgcaatagtcggtgatcaggccggtggtagacgccaccttcacattggtgcaaccgcgcttggcgagcgcctggcggatgatctcaacacgggtttcctcggaaaacatcggcgtcttcgccgcgttcacggccaccaccacatgcacttcgtcgaaaaagcgcgcgcaacgctcgatgacgtccaggtggccggcggtcactgggtcgtacgacccggggcaaactgcaattgtcataaccttaagcgtaccgcgattggttgagaacgtgcgcaacatcggcgtatgcccgtgttggcgcggttcgtgcgcacgggtggcggcgcaatgcggctcggctatgatggaaggcagtggggccgcgatcgcggcttgtgtgaggagtcttaattatggtatttgcgattttcgatggcctgttcggatccgacgatccggtttcgccgctgtccaacccggatgcgggtaccggtaccgccgttctggaacgtcctgaagaggaaacgaagcttgatgacggtggcaatggcgatgccgaccgtttcgcgcattatgtgtcgcgtgaccgtatcgccgaatcgaagatgacgggccgtccggttgtggcgttgtgcggcaaggtgtgggtgccgaagcgtgaccccacgcattacccggtgtgcccggattgcaagcgcatctatgacgagatgatgaacagctcgttctgattgccgttcgaccatgttgccgattcatgccgccggttgcggtggctgaacgtggcgattgaatatggcggctgggtgcggcgcaacgtcgtatgttatgcaaaaaccgacgcccggtgaatcaccgggcgtcggtttttgttatgtcgtttgctccgtacagggcggttcacgccatgacggacgtcacagcacggtgacttcggtcgggatgaccggatcgcccttcatcaggctctgtgcgccgatcggcagttcggcgagcgcctgcgcgcggtagttgtgcgcgttgacgatcgcgtcgtggccctggtattcgctgtggttctcgccattggtgacgtagtcgacgagcaggtccttccagccgtcttccggctggtatgcggcgagcttgtcttcggagccggagatgacgtgttcgcagtcggccagcgagtattcgtaggagcggaaggcgagcttgcggcccggaacggtggccttgtccttcgacttcttggcgaccggctgcatttcgccggcggagttctcgcgttcggtgagcttgtagaccatcgcgcaggtcggggcgcccgagccggtgacgagcatggtacccacaccataggaatcgaccggagcggtctgcagagaggccagtgcgtactcgtcgagatcgttggtgacggtgatcttcgtattggtggcaccaagcgcgtccagctggttgcgcacgcgctgcgcgagggaggcgagatcgccggaatcgatgcgcacgccgcccagttcggggcctgccacgtcgacggccgtcttcacggcctcttcgatgttgtacgtgtcgaccagcagcgtggtgttcttgccaagcgcggcgatctgcgattcgaaggcgctccgctcgtcgtcgtgcaccagggtgaagcaatgcgcggcggtgccgatggccttgaggccgtacatttgcgcggccagcagattggcggtgcccttgaatccgcccaccacggcggcgcgggcggctgcgacggcggcccattcgttggtgcggcggcctcccatgtccatgcacgggcggtccttcgccgcgctgaccatgcgggacgcggcggaggcgacggcggaatcgtaattcagaatgctcagcagcagcgtttccagcagcgtgcattcaccgaacgtgccttcgacctgcaggatcggcgagttcgggaagaacatctcgccttcgtggtagcccttgatggagccggagaagtggaagttctccagccatttgatggtttccgggcttaccaccttgcggtcggcgaggaatttcaggtcgttgtcgtcgaggtggaacttctcgagcgcgtcgaggatgcgtccctgtccggcagccacgccatagtggcggcccagcggcagatgccgggtgaagatctcgaatacgcacttgcggttggcggtgccgtccttcaggcatgcgtcaagcatggtgtattcgtacatgtcggtcatgagtgcgggtgaataatccagcatttccaaagcctttcttgacttttggtgaaactgaccataagtgtaggacccacggtggccaatctttggttgcatcccatcatacgtgcaggaggggtctcgaggcgcggcgtgcttggctggtgatagggtcgaatgctgaaaagacgagtaatcggacggcggcaaaagccgaaatcagcggaaagcgaagtgcagaacagcaatggtagcgattaaggatatgttgggcgaccagaccgtggtgcgtgcggacggacgcaaggtcgacgaactgcgcccggtgcgcatcacccgccatttcacggacgttccggaaggctccgtgctcatcgaatgcggcaacacgcgcgtgatgtgcaccgccacgttcaccgccggcgtgccgcgctggcgcaaggactccggcctgggctgggtcaccgcggaatacgcgatgctgccgcgcgccaccgccgaccgcaccgaccgcgagtccgtgcgcggcaagatcggcggccgtacgcacgagatcagccgtctgatcggccgctgcctgcgtggcgtcgtcgatatgaaggcgctcggcgaaaaccaggtgcagatcgactgcgacgtgctgcaggccgacggcggcacccgcaccgcttcgatcaccggcgcgtacgtggcgctcgtcgacgcgatgcattgggccgaggaacacaagcacgtcaagtccgccaaccgcgtgctcaaggactgggtctccgccgtctccgtcggcgtgatcaacggcaagccgatgctggacctgccgtacatcgaagacagccaggccatgaccgacatgaacgtggccatgaccggttccggcgatttcatcgagatccagggcaccgccgagcatcgtccgttcaaccgcgccgaactcaacaccctgctcgacctcgccgaaaaaggcaacagggagctgcaggccgcccaacgcgccgcgctcgcgctcgactgagccgatcgacggcacggcatgcgctgaatgtaggacgttgacggtccgatgccggcgactcggcgcgcatggaacaacgcaaacagatataagtcggaaaacgacggaaggaaccgtaaggcatgaagatcatcgtcgccacgcataacgaaggcaaactggcggaaatccgccgcattctcgaggaacgtctcggcgcggacgccgccgacatcgagctcgtctccgcaggctccctgggattgcccgatccggtcgaggacggcgtgaccttccaggagaacgcgctcatcaaggcgcgcgacgtggccgaacgtaccggctgcccggcagtcgcggacgattccggcctgatcgtggacgtcatgggcaacgcgccgggcatcctgtccgcacgctgggccggcgagcacggcaacgacaaggccaacaacgcgctgctgctcaagcagctggccgacatccccgacagcaagcgcaccgcacggttccgctgcgccgccgcgctggtcctgccaggagagcgcaagacggacggtgcggatgatgataagccgtacacgatcgccagcgaaaccgtcgaagtcggcgaaatgccgggcgtgctgctgcgtgccccgcgcggcgccaacggtttcggctacgatccgctgtttgtgccgaacgatcagccgcagcgtgcggtcgacgccggcgaaaagctcacgtccgccgaaatggagccggccgagaagaacgcggtctcccatcgaggcaaggcgctgcgcgcgctggtcgcatcgatcgaagcgctggtcaaataacatcggatgacggccgcgacgggcgcttgccgtggcgcgcgacactggatggcgtgcgtgcgatttgtgctcgtccggtttttccgctatgctttgtttcttgtgcgcggctagcgtatgcttactgggcattgcgccactttagctcagtcggtagagcggctcactcgtaatgagcaggtcgacagttcgattctgtcaagtggctccactgccctagatgttcggaggttttccgagcatctagggttttgcatatgtgcatccgtgcgtatcggttttcgccgtgcgcggatggtgattgcgcgagtggcggaattggtagacgcgcaggatttaggttcctgtgtctttgacgtgtgggttcaagtcccatctcgcgcacatgtccacgttaattcagccaatcgcgctgctggccatcatcctcaccggctacctgttcaaacgcgccggcaaattcaaaaaccgcgactaccgcatcatgcaggtcgccctgttcaacctggttctgccctgcgccatcatctactcgttcgccacgaacccgcatgattccagcatgctgtggatctccgtcttcggcttcgtggtcgcgttcatcccgcccgtgctcatcttcctcaccacacgtcacacgcctgtgcaggatcgcgcgttcaccatgctcaacggttccggcttcaacatcggctgcttctgcttccccgtggcacaggcgtttctcggcaccgcggcgatcgtgccagcggccatgttcgacatcggcaactgcgtgatggtggcggccggcacgaacgtcatgacgcagaccctcctgcacatccagcccggcaagaccttggacgagcagtaccaggggcatgcgccggtgctgccgtatacgaaacccaaggatcgcgatgcccgccggctggcacgccacgcgctgctacgcaacgtggcgaaaggcttcttcggctccatcccgtttgacacctacctggtcatgatcgtgctcatgcttgccaatgtgaagatccccgccgtcgtggccacgttcgttgagccgctcgccaacgccaactcgttcgtcgccatgctgatggtcggcatgctgatggacctgcccgccggccgtgacgatgtgatgaagctgctgaagatcatcggcctgcgactgccattcggcctgctgtccgccgtctgcgcatggttcgtgctgccgttcggcgccaatgtgcgcgaagccgtggtgatgtgctgcctcgcgccaatcgccgtgttctccaccctgttcaccgacgaagtgctcggcaatgcgaaactcgccggcttctcgctgtccgtgtccgcgatcatcggcctggtcatgatgaccggcgcgcacttcctgctcgccgccatcgcctgacttgcgtaagccgcgtgcgtggtcgtgcgtaagttgcgtacgtaatcgtaatgcgatcgttgcatacgacagccgttttcacgtgcgttgaagctttcccgctgaacgttgcatacgatttcagtaatcgtcgtttatctggcatgtcgccactgaaaagtggtcggaaccgcggtatatcgcgcttccgaccgaatgtgttaactcgggaaacatttttgtgttgttctgtcggcttttgtgagtatcttgtgaggtgaagaaaacggctcgtgccgtggaaaatcgaacgagattccaccgtcacgttccgcttcacagtgatgatgaaaggacctatcaacatggccatcaatcctcccgttgacgccaccaagaccccggagtgggccgcgctgcagaagcactacgacgagctgcagtccgagggcatcagcctcaagcagtggttcgccgatgacgccgagcgcgtcgagaagctgagcttcgatgcaggcgacctgcacttcgatctgtccaagaacctgatcaagccggagaccctgcagctgttcgccgacctggccaaggccgtcaagctcgacgagcgcaccaaggccatgtacaccggcgtgcacatcaacaacaccgaggaccgcgccgtgctgcacaccgcgctgcgccgcccggtcgaggacgagggcaagtacatcgtcgacggccaggacaccgtcaaggacgtgcgtgaggtgctcgaccgcatctacgcgttcgccgacaaggtccgctccggcgagtggaccggcgtgaccggcaagaagatcgagaccgtggtcaacatcggcatcggtggttccgacctgggtcccgtcatggtgtacgaggcgctgaagccgtacgcagacgccggcatctccgcccgctacatctccaacatcgacccgaacgacctggccgagaagaccaagggcctcgatccggagaccaccctgttcatcatcgtttccaagaccttcaccaccttggaaaccctgaccaacgcccgtgaggcccgcacctggctgctcgaagagctcaaggccaagggcgccatcgacggttccgacgccaagaacgccgaagccatcaagaagcacttcgtcgccgtctccaccaacctggagaaggtcgccgagttcggcatcgacccgaacaacgcgttcggcttctggaactgggtcggcggccgttactccgtcgattccgccgtcggcacctccctcgccgtggtcttcggcccggcccgcttcgaggagttcctgcacggcttccacgagatcgacgaatacttcgccaacaccccgttcgagaagaacgtcgtcgtgctgctcggcatgctgaacgtgtggtaccgcaacttcttcaaggtcgcctcccacgccgtgctgccgtacgaccagtatctgcaccgcttcccggcctacctgcagcagctgaccatggagtccaacggcaagtccgtgcgttgggacggcaccccggtcacctccgagaccggcgagatcttctggggcgagccgggcaccaacggccagcacgccttctaccagctgatccaccagggcacccagctcatcccggccgacttcatcgcgttcgtgaacaccccgaacccgaccaaggacggcgaccaggacgtgcacgagctgttcctgggcaactacttcgcccagaccaaggccctggccttcggcaagaccgccgacgaagtgcgcgctgagggcaccccggaagagatcgtcccggcccgcgtgttcaccggcaaccgtccgaccacctccatcttcggcgtggctctgaccccgttcgcgctcggcgagctcatcgccctgtacgagcacatcaccttcgtcgagggcaccgtgtggggtctggactcctacgaccagtggggcgtcgagctcggcaagcagcttgccaagcagatcaccccggccatctccaaggatgacgacgccctggccgcccaggatccgtccacccagtccctgatcaagttctaccgcgccaaccgtgagttctgattccgctgcgttgcatcagaactcacggttgcgcgcgccgcacggtgttgtctggtgaacggtctggcgaccgttcatgccgcgagttctgatcttccatcgaaacgtggcgtctagcgcgtacgtggcataccccatccgtgtcttacggatggggtatttttgattattgctgtgctgaaaggtgggatgccgcataatcccgcttttctttgggtccagccggaacggtcgcaggtaactccggccgtgctttatcgcaatatttccggcggatcggcaacccttcgcaggcagacctgcggagcggaagaacaggccgagacggcaatcgcaagaacgccgtacgaagcccttacctgtgcgccgatatgcggcggcgactcgaggaaacacaatggttaacgctattgaggcatttgacgccaagcacatgaagccggccgaggaaatcccggctttccgtcccggtgacaccgtcgaagtcaacgtgaagatcaaggaaggcaacaactcccgtatccaggccttcaccggcgtggtgatcgctcgtcagggcggcggcgttcgtgagaccttcgtggtccgcaagatcagcttcggcaccggtgtcgagcgccgcttcccgctgcactccccggccatcgattccatcaaggtggtccgcaagggccgcgtgcgtcgcgccaagctgtactacctgcgcaacctgcgcggtaaggccgctcgtatcgtcgagcgccgcgacaactccgagaagtgagttcgaatcgcaaataaagcgtggaatcggctcttcggcaacccgtcgaggagccgattttctatattgggccgctatgataggggccagtgcgtgaaaccggacggtaaggaatcccatgaagcatgccagaagaagagtcgaaagcgaggaaagcttcggcttacgagacaccctgatctggtgcggcatacccatcgtcatcgtgctgctggtgcgcatgttcctgttcggcttctacgtgattccgtccggctccatgctgaacaccatcgaaccgggcgaccgggtcatcaccagcaaactcacccccaaagtcttcaagctccagcgcggcgacgtggtggtcttcaaggaccccgaccattggctgcagcaggagaacagcggccgattcggcggcgactacctcatcaaacgacttatcggcctgcccggtgacaccgtggcctgcgaggggcccggcaagccggtcacggtcaacggtgtggccatcgacgaaacttcgtacatccgctccggcgtggaccccagctccttcgcgttcagtgaaaaagtgactgcgggacatgtgttcgtcatgggcgacaatcgcgccaattccgccgattcccgctaccatcaggacgattcctcgcacggcctcgtgccggtttccgacgtggtcggcgtcggtctggtcaagtattggccgctgaaccacatcagcacgctggacgcgcatcacgacgtgttcaaggacgtgccggaaggatctgccgactgatgtccgtttccatagtgcccacgctggatatggaacgggcgatcgcggcctccggctacgacgtgatcgtcggcttcgacgaggtcggccgcggctcgctcgccggtcccgtcatggtcggcgccgccgcaatccgcacgtgcgacctgtccggtccgtcgccgcttgccgtacccgacggcgtggccgattccaaaatgctgacggaacaccgccgcgaagccatattcgaagagcttaaatcgtggtgcgcgtcctgggcggtcggctcggccagcaacacggaaatcgacgattggggcatctcctacgcgctcggcgtggccgcgttgcgtgcgctgtcggaagcggagacgagactcggcatcgacggcaacggtctgcttgacgggcggccggtgaaggtcggggcgatcctcgacggaccgaacgactacatcaccaaagcgctgaacaccttcgacgcgcctgacgtgccggttcctgcggaagtctctaccaaagtgaagggcgacaggtactgcgccaccgtggccaccgcagccgtcatcgccaaagtcacgcgagaccggctcatggtcgaactgggagcgcaaccccaatatgaaccctatgaatgggcccacaacaagggttacggttcggccgcacaccgtgacgccatcgctgaattcggacccagcgacctgcaccgcctctcctggcatctcgtctgacatacggcatctcatccgcagtccgcgattacgctaatccttgcggatgatgcatgccggaaggaaacctgtaagttcatcccgccgtctgatggccgggaccaatccgtttccgtaccgtaggaaacatggaacacatacttcacgcgaccgatctggtcatggattattcgacccaacaggcgacaccgaacgccacacacatgctggcgctcaatcacgtggatttcggcatccaggcaggcgaaagcatcgcggtcatgggaccgtccggttccggcaaatcgacgttactgcacgcactcgccggcatcatcaccccgacagccggcaatgtgatgtttcgcggtgccaacctggcgcggttgagcgacgctgaccgcaccaaactgcgccgcagcgccttcggcttcgtcttccaatccggacaactgctgccggaactgccggccatcgaaaacatcgcgttgccgatgatgctgggcggcgcaagctaccagcaggccaccgacacggccatgctatggctggaacgattgggattgcgccagctcgcgcaacaacgtcccggcgaaatgagcggcggccagatgcggcgcatcgccatcgcacgtgcgctcgccgcgcagccggcagtcatcttcgccgatgaaccgaccggcgcgctcgaccagaccaccggccacgaaatcatgagcattctcatgcggaccgcacgacagaccggcgcggccgtggtcgtggtgacgcacgattcgaacgtggccgcattctgcgatgccaccgttaccatgcgtgacggcaggctgagctcgccgcagcaatcccaacctaccgccggaggcgcacgatgaacatgttccgattatggcgattgttccaccgctccggcacccgcggcacatccagccgcacctctgcgctggccatcgttgccttcgcatccgccaccgccgtcttcctaaccgtgctcggaggcctgcatggcttcatctggcgggcctccgccgaccacacgttcggttgcatgatcaattccaacaggtgcgcgcccggtacatacgaaacatggtccaaaaccctggcgcacgccgacaagctcgtcgccacggtcggcgacggccattggacggccgaccaggccacagccgtcatgaacacctattccgacggctatgtgctgctcgccgcattcgccagtctgctactcatcgtgccgttcgtggcgctcgccggctcggcggcccgtctcgcggcctcccgcagggacgcacgtctcgccgcactgcgacttgcgggcgccaccaccgcgcaggtcacgaaactcaccgcgctcgatgctggtggccaggctctgcttggcgcgctggtcggcatggccggctacttcgcgctgataccggcgatcatgctgctcgacttccaaaaccagcatttcaccttcgaacagttgtgggtgggactgcctgctctggcggccgtgaccgtcggagtcacgctgcttgccttggtctccgcgctggtcgccctacgccgcgtggccatcaccccgcttggcgtgatgcaacgtaccggacaacccatgccgtccgcatggcgcgcactgattttccttgccgtgttggccgtaggctacctgctgctcaacagcatctccgcattcgcgcacttgggtcagatggtggtctacgccatcatcttcggcgtcttcttcctcggtttcgccatggtgaacgtcgtcggtacctgggtggtggcgatgcgcgccagatcgcgtgcgaaacacccgaaggacgcggccactatgattgccatgcgccgtatcctcgacaatcccaagcgtgcttggcgtaacgtgtccggtgtggcgctcgctgtgttcattgcggggatgacgtcggtgtgcggattgctcgccaccggaatcggaggcaaccacgacccgttcgacccatctatgctgtacatgcgcgatatagcgatgggtggtttcctgacgctcgcctttgccgcggtgctcgccgccgtcagttccggcgtgatgcagacgggcaacgtctacgaccaggccgacgagtaccgcatgcttgcgttggaaggcacggatgaggcgacgctcgacaaggcacgcatgatggaagtgatcaccccgctcaacacggtgatggccgtttcattggggtgctcggtgttgttgctgtttccgattctggcaacgtcgttgctcaatccggcttcgttgcttacgttggccgcgggaatcggcttgtgttatgcgctgatggtgctcggagggtgtgccgcgaatcatgcggcgcacgggctcggtcatgccggctaccgtatggacgattgatggcctcgccgcggcggtcgtggataccgcggcgaggactggcgaggtcagccgagcagcaccgcgataatcgcgatgaaaatcggcgacgacaacgtcgagaacagaatgccgtcgcgtgcgaacgacagacccacgttgtaccgcgccgcgtagttgtagacgttctgcccggtcggcagagcggcgagcaccacgcacgcgtacagcgtggcgccacggaagcccatcacgaaatacgacagcaggaacgcgatgatcggcatcacaatgttcttcaaagcggccaccgtgaacaccgccggaatattcgacttgtcctgcaacggcttcgtgccgtgcaaggacatgccgaacgccatcagaatcatcggcaccgcggaattgccgatcatgtcgatcggatcgtaaatacagtccggcaccacgaaatagccgaccttcgcggaaatcgcggacaccacaatgcccagcagcgagccgatgagcagcggctgatgcaacggctgcttcaaaatctccttcgcggagaccttgcctttggtggtcacgtcgagcacggtcaggccgatcggcgtgaacaccgcctgctgcatgaccagaatcggtgcgacaagcgccggattgcccagaatgtacgtggcgatcggcaggccgatgttgttcgagttcagatacagcgaattcagtgcgccgatggtggcgtccgcggccttcatatggaagaacagccggttgagaatcaggaagaccacgcccaccagcagcgccgaaaaaaacgccacgacgatggaggaatggaaaatctcgaagattttctccttggacaggatggcgaacatcaggcacggactcgacacgaagaagctgaacctgttgagcaccatctgcgcggtcggcccgccgatgcgcatgcgcgcggccacatagccggtcgcgatgacgatgccgatgacgcagaaaccttccatcgcgcttaacagacccggcattgcactctccttttcgttgcggccgttgcctttcgaccgctatctagtgtggcaccaagcgcgcgtcggtcgtatgcacgtctcaaaagcgagcccgatacacgattgacggcacgttttgccggataatggacggcatgaacgaacttacgattggattttccgcttccgccagcaaacaggagcagttgaacgagctgatgaggcagatcatgggctgctattccgtcagcgatgacgaaggcccgttgacggacgccgtcgaggtgttcctgaaaaaacagccgcatctgacggtgcgcaggcacggcgacacattggtggcatccaccgatttcggccgcgagcgccgcgtgattcttgccggccatctcgacacggtgccggtgattgacaatttcccgccgaaatggcttcagccgggcgatccgctgattcgcgaggatgtggcggccggtcatgagcatgagcgtgtgatctggggtcgtggcgccaccgatatgaagggttccgacgcggtcatgctgtatctggcggccacgctgacggatgcgaaatacgatttgacgtacgtgttttacgaccatgaggaagtcgcggccgagaagaacggcctgcgcaaggtggtcgagtcgcatccggattggatcaccggcgatttcgcgatcatcggcgagccgaccgattgcggcatcgagggcggctgcaacggcacgatgcgattcgacgtgatcacgcacggcgttgccgcgcattcggcccgcgcctggatgggcaagaacgcgatccacgcggcggccgagattctgaaccgtttgaacgcacatgagaaccgcgccatcgaagtagatggcctgacctatcaggagggcctgaacgccacgctgatttccggcggcaagggtaccaatgtgattcccgacgagtgccgtgtgcacgtcaactaccggttcgcgccggacaagtcgctcgccgaggcgaaggcgctgatgatcggcgcggatgcgggcgcgaaactcggcaacggcgagcatcaggccactggtggcgtgttcgaaggcttcggcatcgagatgaaggacgaatcgccgagcgcacgtccgggcctcaattcgccgcttgcccaatcgctggtatcgcttgtcaaggaacgtaccggtcgtgacccgcttgccaagctgggttggacggatgtggcgcgtttcgcgattctgggcattccggccgtgaatctcggcgcgggtagcccgctgctggctcacaagcaggacgagcagctgccggagaccgatctgctgctcatggccgacctgctggaggactggctgcgttgaatcgccgttgagtcgttgctgagctgccgttgaatcgccggtaattcgctgccgcgggcttgccgcagaaccactattggtccaccgttgaaccgctgctgaaccactatgccggcgcacgttcattcacggcgtgtcaacgcgaatcattggaaaacggagcgtgtagggggaataaatttcccgtcctgtcacgctccgttgttttttgtgtcatacttatagacggtggttctgcaagaccgccgacgcatccgatggcgttgatcccctcgcgtgaatgttctgtgagtcgcgagcgcaggtgtccgccgtcgcatgatgaagacttttgacggaagttgcttcctacgggcgccatgatgcgcggccacggtgagagcgtggtgtgagaaccgttggggcttgagtgaaggcgatgcgattgcagcgcgttgccgaggagcgttgtgcctactaccaatgagggcctcgatcaggtcgaggctgttgtgtcatccgataattcaaccaataatgcggcaagcagtgcgggttctgtgtctgccgatccggctccgcgccgccgtcgtggaggtcgccgcgtggtgcgtggcgtaggtgccgcgggcgcgtctttggagctgaaggtcgaggagcatgccaaagcccccttgtttgaggaaccgaagcttgagcctgtccagcctgcgcgtgattccgccgatttcaatgatgccgatgacgccgagccgtcgcgtccgcgtcgtcgtcgcgtgacccgttacgatgacgacgatgagatgcgtgacgaacgtccgcgccgtcgccgtcgttcctctgtggacgtgcaggacgaggatgatcgcccgtcgcgtcgccgtcgccgtatcagcgacgagccgcgtgatgaccgtgacgatcgtgacgattacggcaatcgtggcaatcgtgacgaatcatccgaagaccgtgcgctcgacgccgtcagcgcgctgccggaaggccatgagacgcgtcataatccgcgtccgatgacgtcgctgctgttccaggagccgattctgccggccgcccccgcgggccgcggatcgtccgacgatgacgatgctgacgatacgggccgcagaggttcggacgatgcccgtgacagccgtgatgaccgcgacgatgaccgtccgactcgtcgccgccgccgtcgcagccacgacacggccgacacggaccgcacggacgcttcgaatgacggtcgcggccgtgatgatggcaatgaccgcaacaacgacgccgaagacgatgatcatggcgattcccgtcgttcccgtcgttcccgtcgtctgaacgcgcaggaacgtcgtgccgctgccgaagtggagcagatcgaggaggacctggtcctcgatggcatcacgtatgcgccgatcgatgacgagtcccgcaatggaaacgatgatgatgacgagcagccgacgcgcacccgtcgccgccgtcgcggacgcggcaaccatgaggaagccgacgagcagcagacctccgaacgcgaatcccgtcgccgtcatgaggatgacgatgaggaagagggcacggtgacccgtcgccgtcgccgccgccgtggagggtcgaaggccgaggaatcggacgagacgatgtcccgtcgctcccgcaagcagcagtacatcgacgaaatcaccgacgtcgaaggatccacccgtctggaagccaagaagcagcgccgccgcgacaaccgtcgtgaacgcagccgtcagaaccagctcatggagcaggacttcctggcccgtcgcgaacacgtcgagcgtctgatggtggtgcgcgaacgtgagcgccacacccagatctccgtgatcgaagacaatgtgctcgtcgagcattacgtgtccggcatccaggaagtggccaccgtcggcaacatctatcttggccgcgtgcagaacgtgctgccgagcatggaggccgcgttcgtggacatcggacaggcccgcaacggcgtgctgtacgccggcgaggtgaactgggattccgcacgtctggaaggccagccgcgtcgtatcgaactggcgttcaagtcgggcgatccggtgctggtgcaggtaaccaaggatccgatcggccacaagggcgcaaggcttacctcgcaggtcaccttggccggccgtttcctcgtgctggtgccgtccggcggcatgaccggcgtgagccgcaagctgagcgagcgtgagcgcgcccgcctgaagaacatcgtgtcgaagatcgcgccgaaggatatgggcgtgatcatccgaaccgcggccgaaggcgcttccgaagaggccatcaccaaggatctcgagaacctggtgcgccagtgggaacgcatcaccgccaagcgcgacgagttcctgcacggcaagcgtccgaagctgctgcaaggcgagccggacgtggccatccgcgtggtgcgcgacatcttcaacgacgacttctccaagatgatcgtggaaggcgaccgcgtgtacgagcgtatcgaggaatacctcgacacgatggcccccgacctgaaagacaagctcgagaagtgggatccggccgaacatgacggcaaggacgtgttcgacaagtggcagatcgactcccagttgcgtaagggcatggaacgtcaggtctacctgccgtccggcggttcgatcgtcatcgaccgcaccgaggccatgaccaccatcgacgtgaacacgggccgtttcatcggccgcggcaagagcctcgaggaaacggtgacccgttgcaacctcgaagcggccgaagagatcgcgcgacagcttcgtctgcgcgacatcggcggcatggtgatgatcgacttcgtcgacatggtcatgccggccaacagggatttggtgctccgccgactggtggagtgcctggcgcgcgaccgcaccaagcatcaggtggccgaagtcacctcgctgggactggtgcagatgacgcgcaagcgcatcggccagggtctggtggaggcgttctccgaggaatgcccgacctgcaagggccgcggcttcatcctccatgacgaaccgaccgtttcggcggattacgacgatccgtacgccctgaagggcggcgatccgttcgtcaagaccaacaagcatggccatggcacggacgtgcaggtgccgaagggctcctcgccggacgtgaaggccaaactcgcgcagatcgcggcggcagccgtggccgccaacaatgcggacctgggcgaggaagaacaagaagaataaaggaaaatcccggtatgtcaacttgacacgccgggagcagacttgcggttgtacgcgggtatgtgtagattagattgctggtgtctggccgcgaggctcgaacgtgccgggcagtaagctttccaagttaataaaggaacggatatgtacgctattgtgaaggccggcggccatcaggaaaaggtcgaggtcggtgacgtcatcctcgtcaaccgtctcaacgccaagaagggcgacaccgtggagtttccggctgccctcgtggtggacggctccaaggtcatcctcggtgccaaggatctcgccaagctcaccgtcaaggctgaggttgtcaacgatgaggccaagggtccgaagatcagcatcatgaagtacaagaacaagaccggcgttgctcgtcgcaagggccatcgccagcagctgactctcgtcaagatcacggctatcgcctgattcgcgtagggttagagtcaaggaccgaaaggaacagacatggcacataagaagggcgcgtccagctcgcgcaacggtcgcgattcaaacgcgcaatacctcggtgtgaagaagttcggcggcgaagccgtcgtggccggcaacatcatcgttcgccagcgtggcaccaagttccacccgggcgagaacgtcggcatgggcaaggaccacaccctgttcgccctcaaggacggcagcgtgaagttcggcgtgcgtcgtgaccgcaaggtcgtcgacgtgattgccgcctgagacacgcgcaaataacgcttttgatgaaagaccgcgcccatatggacgcggtctttctgttatgtaaggtagatacatgagtgattttgtggatcgagtgaccgtccatgtcaagggcggcgacggcggcaatggttccgccggcatccgtagggagaaatacaagccgttggccggcccgaacggcggcaatggcggcgacggcggttccgtgatcttcatggccgattcgaacgccaacagtctgcttgattaccgtttcatgccccaccgggaggcggaaagcggcacgatgggcctgggcgacacgaaggacggttcgaagggcgctgacctgatcctgcccgtcccggtgggcacggtcgtgttcgaagccaagggaccgcagggcaagccgaagcatccaggcgagcagctcgccgacctgcgtcatgcaggagacaagttcgtcgtggccgcgggcggcaacggtggtcttggcaatgcggcgctggccaatcgcacccgtcgtgcgccgggcttcgcactgctgggcgagccgggcgaggaacgtgacgtcatcctcgagctcaagtccatcgccgacgtggcgctggtgggctttccgtccgcaggcaagtcgagcctgatcgcggcgatgagctccgccaaaccgaagatcgccgactatccgttcaccacgcttgtgccgaacctcggcgtagtggtggccggcgacatgcgctacaccatcgccgacgtgccgggcctgattccgggcgcatcccagggcaagggcctcggcctcgaattcctgcgtcacatcgaacgtactgaaatcatcgcccacgtcatcgattgcgccaccctcgaacccggccgtgacccgatgagcgactaccaggcgctcgaacacgagctcgccgaatacgccggcaagctcgaactgccgctcggcgcgattccgatccccgaacgtccgcgcatcatcatcctcaacaaggtggatgtgccggaagccaaggaactcgccgaattcgtcaagcccgaattcgaaaagctcggcctcaaggtccacatcatctccaccgcctcccacgagggcctgaaggaactcaactgggcgctggccgacctcgtgaccaacatgcgcgcggaagtcgccaaacgcgagcaggccgaggaagaggcccgcgtggtcatcaagccgctcgaggagccgcgcaatcgccgtcgccgtaacgacgaaggcggcaacgcgctcgacttcaccgtggaacgcaaggagaacggcaacggcgaagtctggtacgaggtgctcggcaccaagccggaacgttgggtcatgcagaccaacttcgataatgacgaggccgtcggctaccttgccgaccgtctggccaagctgggcgtcgaagacgagctgcggcacaagggcgccaagccgggcgacgaagtgcgcatcggccgtggcgaccgtgccgtggaattcgattgggatccgaccatcgcggccggcgcggaaatgctcgacggcacccagttgggcgcacgcggcgtcgacctgcgactgcaggaatcggatggtcgtgcgcagcgtcgttccaacacggaacgccgtcgccagtaccacgagatgatggacgcccgtcaggccgtgcgcgaagccatgatggccgaacgcaaggcaggacactgggccgatccttccgtggacgacgaccgtcacgacgaaaccagtctttttggacgtggcgagaccgccgacgacgaggatgtggaacaatagaaccatccaacgaagcccgctgatgtgccgatggcatgtcggcgggctttttcaatagccggtaacggtaccgggaggaactatgaacacgccatcgcaagcgcaagtgcgcagggccatcgccgaagcgcagaccatcgtggtgaaggtgggctccagctcgctgaccgagccgagcggccacttggatccgcaacggttgaacgcgcttgtggcggccatcgcccgcgtgcgattgatgggcggccgcgtggtgctggtctcctccggcgcgatcgcggccggtttcggcacgctcggtttcgacaagcgtccgaccgacgtagccgaccagcaggcgtgcgccgccgtcggccaaggcctgctgatggcccagtatgaggccgctttcgcacggtacgggctgcgtgtcggacagatcctcatcaccgtttccgacacgatcgccccacagcagtaccgcaacgtgcgccgtacgctcgaccgcctgctcgacttgggcgcggtgccgatcatcaacgaaaacgattccctcgcgtccaacgagatccggttcggcgacaacgaccgtctgtccgcgctcatcgccaacatcgtcgtcgccgacgcgctcgtcctgctcaccgacgtggacgcgctgtacaccgcgccgccaagcgagcccggctcgaaacgcatctcctatgtgccgaacgtcgaggacgcgctggcgaaggttcaggtcggcggaaccggctcgaacgtcggcaccggcggcatggtcaccaaaatggaggccgcgcgcgtcgccgcggtgtccggcattcccgcggtgttgacatgcgcgtcgaacgcaggtcccgcgatgatgggcgatccggtcggcaccgcgttcgcgccgatcaacgaccgcggttcgtcacgtaggctgtggattggcttcgcctcccacccgcagggcacgctggtggccgattccggcgcggccaaggcggtgcgcgggggagcggccagcctgcttgcggccggcgtggtggaagtgaagggcgatttcgccgccggcgacgccgtctgggttgacgacgagcagggcaaccatttggccaagggcctggtcggcttcgactccgaggagatcccgcagatgctaggacgcaatacggcccagctcaagcgtttcctcggcgaggaatacgcgcatccgctggtgcaccgcgacaatctcgtactggtctgagccagtgcaaaaggtgtggttaggccatcgatttcgcttcaagcgaagcgttcgcggcgaaatagacgtgtgtcgtggggctgtcgtttttcgcgtggcaggtctagcattacaggcatgactatggctgactggcagactctatccgaccgtatcaatcacgtggctccgagcgctactctggccgtcgattccaaggcgaaggcaatgaaggccgccggaatcgacgtcatcgggttcggcgcgggagaaccgaacttcccaacccccgcaccaatcgtcgcggccgcggccgcggccgtgcaggacccgaaaaactaccgttacacgccgaccgccggcctaccggaactgcgccaggccatcgcggacaagacgttgcgcgactccggctacgaagtcgatccaagccaggtcatcgtgaccaacggcggcaagcaggccgtctacgaatcgttccagattctgctcaacgagggcgacgaggtcatcatccccaccccgtactggaccagctatccggaagccgtgaagctcgccggcggcgtgcccgtgaccgtgttcgccggcgccgaccgcaacttcgagcccagcatcgaagccatcgaagcggcccgcaccgaacacacgaaggccatcatcgtgaacacgccgaacaacccgacgggcgcggtgtggaagccggaaaccgtcaaggccatcgcgcagtgggccatcgaacaccacgtgtgggtcatttccgacgaaatctacgaacacttgaactatgacggcgccaaaaccacgtacatcggcgccgcggtgcccgaagtgcgctcccagctgctcgtgctcaacggcgtggccaaaacctacgccatgccgggctggcgcgtcggctggatgatcgcccccgtggacgtggccaaggccgcatccaaactgcagggtcacatgacctccaacgtgaacaacatctcccagcgtgccgccatcgaagccgtctccggctccctggacgccgtctacgagatgcgcgccgcattcgacaagcgccgccagaccatcgtcgccgcgttgaacgacatcgaaggcgtgaactgcccgactccgaccggcgcgttctacgcgttcgccgacgtgaccgcgctgctgaacaaaccgatcggcaccaacaagaccacgttcgccaacacttccgaactggccgccgcgttgcttgacgaaggccatgtcgccgctgtcccgggcgaggcgttcggcgctcccggctatctgcgcttctcctacgcgcttgccgacgacgatctggtcgaaggcatgcgtcgcatgaagcgttggatcgaggactgagccgaccggccccgcgctcaactgacggaaagttcagttgatagacgatatttttagcgattcgcgcttcggtgacatgccgggcgcgaatcttttttttcgttggaaaatagcggtttcttgcaattcgtcgtgaatcgggttggacgaagtcgcgaaaacccgctattatttcgacttggcggttttgccgtctgcttcttgcgtggttttgcatagaatcctcgccggcaagtggagacggcagagttcacctagggaagtggcgcaattggtagcgcaacggtctccaaaaccgtaggttgtgggttcgagtcccgccttccctgccaagcttcttacaacaagcccagcggaggattattatggcgaaggcgaagaacagcgagaaggccattaagccgaacatcttcatgcgcattggcttgttcatcaaacagattatcgacgaactccgcaaggtcgtcactccgaccagcaaggaactgttcttctggtccctcgccgtgtttatcttcgtgctgctgctgatggcactggtcaccggcatggactacggtctgggcaagctgaccctgtggatattcggctgataaacaacttgaaggtgaaagtgcatgactgacgaagtgttttccgacaacctcgacgaggcttccaaggctgataccgaggctgctgccgctgttgaggcgctgccggccgaaggcgaggccgtccaggccgtcgccgccgatcaggcgaccgatgagcaggcccagtccgagcaggacgctccggaagagcagaccgcggaaaccactgaggatgaagacactgagcaggatgccggtgccaaggccgtcgaggaattctccaagagcctgcgcacgcttgaaggcaagtggtatgtgctgcacacctattccggctatgagaagcgcgtgaagaccaacgtcgaatcccgcgtggccagcttcggtatggaagacaagatcttccaggtcgaagtgccgatggaggaagtcgaaaagcacaccgaaaaaggcaagaaggtcatcacccgcgtgcgtgtccccggctatgtgctgatccgcatgctgccggatgagaacgcccgtcgtatcgtccgcgagaccgaaggcgtcaccggctttgtcggcccgaccaaggatccggcaccgctgacccgcaaggaagtcgtctccatgatggctccgatgatcgcttccgaagctctcaaggccgccggagacaagccggctgcagccaagaagcgcaagcttgaggtctcctacgctcctggcgatcaggtcaccgtcaccgatggaccgttcaccaccatggccgcggttgtctccgaagtggatccgtccacgcagaagctcaccgtgctcgtgtccatcttcggccgtgacacgccggtggagctaggcttcaaccaggttgaaaaattagcctgaacgtgcatgacggagcgttagctgcgttgctccaagcttgacgcaccttggtacgcctgcgcttgggcgccttgctaccgcacgcgtcacacccattcaggaacctgaaatcgtgattcttttgaaccccgcttcggcggggtttctttgtatgtattgccatacgcgcaatgtcgtggcggaatcgcataatagaaaagttgtgtctggagggtctcgtgtgcctggacaaggcggcggcacctgctagcacagcacagcaatatacgttgcggaaggaaccggacgcgggagacctactccggtgccgttaaccaccgcttcacagaaagaagaaccatacaatggctcctaagaagaaagtctcggcgcttctcaagctccagattcaggccggcaaggccaacccggctccgccgctgggcccggctctgggttcccatggcgtgaacatcatggacttctgcaagcagtacaacgctgccacgcaggacaagatgggccaggtcatccctgttgagatcaccgtttacgaagatcgttccttcaccttcatcctgaagaccccgccggcagcagctctgctgaagaaggccgctggcatccagaagggtaccgagaacccgctgacccacaaggtcggctccgtcaccaaggctcaggtccgtgagatcgctgaaatcaagatggctgatctgtccgcacgcgacgtcgaagccggcatgaagatcatcgcgggcaccgcccgttcgatgggtatcacggttaccgactgagaggagaaggactaatggtacagcgttccaagaagtatcgcgaagcggctgagaagatcgatcgcaacaacctttacaccgccaacgaagccatcgctctcctcaagagcatgccggagtacaagttcgaccagaccgttgaggccgtgctgcgcctgaacgtggatccgcgcaaggccgaccagctggtccgcggttccgtgaacctgccgaacggcaccggtaagaccgccaaggtcctcgtcttcgcccgtggcccgaaggccaccgaagctctcgaggctggcgccgacatcgtcggtgacgacgacctcgtgcagaaggtcgccgacggtttccttgacttcgattccgtcgtcgccaccccggacatgatgggcaaggtcggccgcctcggccgcgtgctcggtccgcgtggcctcatgccgaacccgaagaccggcaccgtgaccatggacgtcaccaaggccatcaaggacatcaagggcggcaaggttgacttccgtgtcgacaagaacggcaacctgagcttcctcatcggcaagatgtccttcaccgagcaggctctggacgagaacttcaaggctgtggccgacgaagtcaagcgtctgaagccgtccaccgtgaagggccgctacgtcaccaaggcgaccatcacctccacgatgaacccgggcgtcccggttgatccggcggtcgttgcctgagtgcacagaagctaaacttcaccaaaagacccgtatctgcaatcgcagcatgcgggtcttttcatatgttcggaaagattcatgactttatgaccggatgacaggtgcaacgggcgtacccagacgccacaccacccgggcagcggctcagcggtcgcgcatacggccaatcgccagcgcggtcgtcagcacatacgcgtcacgcggatcggtggcatcccagccggttgtttcggcggcacgcttcaagcggtagcgcacggtgttcggatgcacattcagctccttcgccgtgttctccaacgaactgccatacttcaggaacgtggacaccgtcagataagtgggatcatcgggattctcgccgcgcagcacctgatatacgttccgatacagttcttcacgcgcgtaatcatcacccagcagcgcacgctccggcaacagctcgtcggcacgcagcggacgggaaggagtggacagcgccggagccgcctgcagcgagaacatcgtctcacgcaacgcatgcgaagcccccgccacaccggaacggaccgggctcaaatacagtggctcgtcctcgctgaacgccggcatgaccgcggtacaggtcacctccggcgtgaccgcgcccatctggcaagccaaagccagcaggaaagtgccgtacgtgccgatgaccacatgctcgccacccaaatcgcgcaccgccttgcggatggcgagggatgtcgaggcaagactggccgaaggcaccccgccgatcgcaaaacagttgaaatcgccttgccatccgagaatgttcatcaaggagaccacacgatcgtcggtcatgttcgtcaacaggcattcgaaagccaaccgctcgatggtcgtatcgtcggtatggcctgacaaaaggtcgaggatgtctgcctgctcggagttcataaccgtccattctaatcgtcgtatctgcgaattgccgcacgttcgccgaccgttccggtccccattcgcgcagtggcggtaatatgccgactatgagcgaaaacaagaaagccggaaaagccgacacgttcctcagctggacgttgggcgtgctcgcatgcctgtgggtggcgtggtgctgcggcatcggcccgctgtactggtttggcaccggactcgccgacttcggctgggccaacgtgctgtacatggcgatcgccttcgttgtttcgtttgctatattgtggtcgctggtccgttacggccgtggcgagcgcgtgctgccgacgtatttctcacgtcggtacgtcaagctgtgtcaggaggtgtccggcacgccgacgacggtattgggcatcatgctgcgccatctgagcgacgccgcgcatagccgtccggggcgcgccatccatgcggtgatcgtctggattggtcgcaagctgacacgttgcaccgactgctggtggaagctcatgctgctgttcgtcatcggctggctgtggattccgaccatcctgcttgccgcgtacggcgccgacatccgctcccagatccgcgaattcagctgggcgttgaaccagtggaccggactgaaacagccgtacatcggcttcttctcattcgtgccgatggacatctatccgaccgcgcattacatgtggccggccaatcccacgtatctgaccgaccagcacaacatcgtgctgaccgttttctacggtgcgttcgccgcggtctcccggtatttcaccgattccaacgacgccggcatcgtggcgctggccgcgctgcaatggctgttcgccgcgttctgctgcgccgccaccgccaatcgtttcttcaatctgccgtggcgtaggctgggcgtcggcacgttcgacttctcccatcccgaacggcacgactgctggaacatgcgcgatttcacccatcccgaggcgggtgtggtggcgcgtccgtccagactgcgcgccggcgcgaagacgcgtttcgtgattctgctgttcttcatggtgtgcccgttggcggtgttcgccacgatctcactgaccaaatcgccgttgttcgcgttcgcgttcgtctggtggttcggcgtgtggtatgagctgcatatgacgcatatcaaggcgctgcccaccatcaacggcaagcccatgaaactgcgcaaacgttccttggcggcactgttcatgtcgagctgcgtcatgctgatcagcgccaaatacgcgtggtacatcattctgttcgccgcgctgctggccatcatcaacgaccgtaaacgttggaagacgtacgtggtcgcattgatgctgccgaccgtgctcatccatggcggcctcgtctatctggtgaacagcggtgccgtcatcggcggcgatccgatcgaaagccgtggcatccagctgcagcagatcgctcgcgtggcgaaatacaatccgcagggcattcccgaggacgcggccaagaaactcgctcccgtcttcaacctcgaccagatggccgaatcgtacttccagcaggacgccgacccggtgaaatcgtcgggtatccagtccaagaaggtcagctacaagtggcgtaccgtcaccaaggacgacatgaaggatttcaatgacgcatggtggcagatcgtcaaggcgaatcctcagatcgcgctcgatgcgctcttcgccgaatgcttcggatacttcaacgtgaccgacctgccatacgtgtcgatggactactacgtgaacaacgattacgtgcagtccgacaacgaatggattcacctgtacaaccaccagtggcgcaaccaggtggccggctttgccaagaaatgggggcagattcccgtgcttggctgggtgacgcacggcaacctgtatgtcacgctgacactgctgatcggcgccgccgaagtggtgctgcgtcgatggcggtcgctgtcatggcatctgccgttgctgctgcttatgggtgtgatgatcaccgcaccggccaacaatttcgaacggcatatgcttccgatcgcattcgtgttcggattcctgtgcctggagttctggcgcgagtcgcgtgccgcgcggcttgccgcacgcgaggcgtcgtacgttggcacgtcgacggcgggcaaacggcgtatcggcgggcaccgaatcgacagatagcagtccgacaagcaggacgccgacgaacgatatctcgatggacgacagctcgacggacaggagaaggaatcatgacgaccatattggattccgcattgaccatgccacgcacctgcgtcgcggccgaccaggtgatcgcgctggactcagtgggctccaccaacacgtacgccgccgaattggtgcgcaaaggcgcgctgttcggctcggccagacgagatggcctcgatggctgcgatggacgcgattggaccggccgtgaaatcgtggcgatctgcgccgacgagcagaccgccggccgtggccgtctcgaccatcaatggaccagcgcggtgggggagtcgttcatcgtctccctggtggtcagcgtgcctacggcgattgtgcgggacacgtccgtcaacggctggctgcagatgatcgccggctgcgaggcgcgcaacgcgattatcgcggccatccgcgattgcggcggcccgctcggcaaggacatcgtgctcaaatggccgaacgacattttcgtcgacggcaagaaactgggcggcgtgctcgccgaaatggttccgcttgccgcaactcccatcgcggacggtgcgactggtaccactgatgtggctgccgcaacggaacgcgtcggcatcgtcttcggcatcggcctgaacctgaccgtccccgaagaccatctgccaaccgacaaggccacgtcgctgcagctggtcgcgcatggcctgcccgattccatgacattgcgcgacatgatcgcggcccatctggtggacggtttgcgatcaaggctcgccgatttcgaagccgacccgcatcgcgaggccacgcgtgcgatggaggagatgcgtccggtctgctggacgctcgacaagccatgcgaggcgcatttcgtggacggcaccaccctgcgcggcaccgcgctggaactcaaccccgacgcctccctcaccatcagagacgacaacggcaacctgcacaccgtgcacaccgccgacgtaggcgtcctaccccaataattctctaaccctcatccctcataaagtcgtaaagcgctttttcgaaaatcgcacgtttcaaaaaaacgcaatattcgagaaaaacggcatttcccaaaatcgcaatatccaaaaaccgcgccacccgcaaacgcaacattcccccaaaacgaggtggggccggcggataccaacgtaagaccgtaaaaaactcggcctgagcggcccggagcgtgtcgcacgttggtatccgccggccccaccggacacagcgaaaacgaaaatcacagcgaaaacggaagactgtatcaaaacccggaaatcacgaagaaacccggaaatcacagcggaaattctcagcggaaaaccctcagcagaaaattcccagcaaaaagtcgtagaaaactaccgcagaaaagtcgctgccgataaaagtcactgcagctttgccagtccactcgcgaccaacgaagccacaaccgccttgatgcaatcgcccacaatgaagcccatcgaagcgatggccaccaccggcatcgccacgcccgtaatggcggactgcacgatgaagccgagcagatagtcaagcacgatgcagccggccacgcaggcgaacagataccgtgcggcggtcaacgcagcatgcttcggggaatcgacacgcgccttgcccttgagcagcgaggtgacgacggcggctggcaggaaaccgatgaggaagccggcgctcgggccgaccaaagccatggtggacgcgccgccggcgaacaccggcagaccagccgcgcccgcggccagatacatgagcaccgcggcgcccgcctgcttccacggcagcatcagcgcggccagcatgaccacgaaggtctgcagggtgatcggaaccggagtgcccggaatcggcacggcgcccgccatggaggcggcggcgagcagcacggcgaacagcgtggacttcaaaacggcgccgaatttgccgctggtggccgttttggctgcggatgagatggtcaggattgcgttgcgcatggtggaatcctcccttttttgcggatgctacaggatgctacaaaaagtgacgaaaatgagtctttcgtcaatcaatgctccccatcgtagggttgctaagtttcggtaacgtttgtggagccttacaaaaagattgcgaatcttttgtgggaaacgagttcgtcgaatcacgcctcgaccgccaaacttgacattatgcctaagaatgtcaacaaactactggtggcgaatcgcggcgaaatcgcgcttcgagtcgtgcgcaccgcacgtgagatggggattcccacggtcgcggtctacgccgaacaggaccgtcacgcacagtacgtgcagatggccgatgatgcgtatctgctgtctggcgacacctacaaggacacgtatctcaacgaggatctgctcatcgacatcctgcagcgcagcggtgccgacgcggtgcaccccggctatggcttcctttccgaagtcgcaagcttcgcgcagaaggtcctcgacgccggcgccacgtgggtcggcccgaatccgaaggcgctcgtcgacctgggcgacaagatcacggcccgccgcgtggccactttcgcgaaggtgccgccggttcccggcatttcccagtcgatttccgacatgcgactgctgctcgacttcgcgcacacgcacggctatccgctgatgctcaagcgcaccgacggcggtggcggccgcggcatcacgctcgtgcacaacgacgacgagctgcgtggcttctacatgaaccacgatgcgctgcagggcggcgatttggacgagtatttcgtcgaacggttcatcgacaagggccgtcacgtcgaaacgcagtgcggacgcgattcgcacggcaatttcaccgtgtattccacccgcgactgctccgtgcagcgccgcaaccagaagcttgttgaggaagctccggcgtcgttccttcccgacggcgtgctcgaacagctggaaacctattcccgccgcctgttcgacgcggtcgattacgtaggacttggcacctgcgaattcatggtgaccgagcagggcaaggtctacttcctggaagtcaatccgcgtctgcaggtggaacacaccgtcagcgaagaggtctgcggcctcgatttggtgcgagaacagctcaccatcgccaacggcggcgagctaaccgtcgaccacccgctgcgcggacacagcttcgaactgcgtctgacctgcgaggatccagccaagaacctcgcgccgagctccggcacgctgaccaagctcgcatggccgtccggcccgggcatccgcgtcgattccggcgtggtggaaggcgacaccgtctccccgaagttcgattcgatgatgggcaagctcgtggtcaccgcctccgaccgtgcgacagccgtggcacgtgtgcgccgcgcgttggaagagctcaaggtggaaggcgtgccgaccccggcaagcctgttcgagcagatcttcaacgacgacgagttcaccgccgagcatggcgtggcctacgacgtgagcacgaaatggctggaacgcaagtacctgaacaaggaagcatcctccaccaagggcggccagccggcatccatggccggcgcttcgggtgcgaaggaagccgagcagaaggaatccagcgaaaccttcgtcatcgaagtcaacaaccatcgtgtgtcgctgaccgtgccgaacgacatcgtggccaacctgaccggcggcgccaaggcgcgtgacgccaagcgcgccatccagccgctgcgcggacagggcctgcaccacgtcgaaaagaagcagcagggcaacgacggccagtccggtgtgatcgccagcccgatgcaggcggtcgtcacacgcatcaacgtcgtcgaaggccaggacgtggccaagggcgacctgctcgtcgtgctcgaatccatgaagatggagaactacgtgtacgcgccggtcaagggcaccgtcaccaagatattcgtcggcccggcggcaggcatcgaagcgggcgagacgttgatgaccattgacgtcaacggcgcttccaaggcggctgacggcaagccggcaacggacggtaatacggaaaccaagacggaaggcggcgcgaaatgaccgacatcatcgcaagcccggccgtcaaagaggccgtgaaggtcgtcatggaacagcaggagcgactgggtgacgaagcggctgccgaagcccgcgaatcgcagccgatccgtacgtccgtgctgcgtgccgcgcagctcgccgccgaagccgaagaccatgcccgcggtcgccagcacgtcaaaggcaagctgaccgcgcgcgaacgtctcgatctgctgcttgataccggttccttcgaggaaatcggccgtttccgcggcggcgacatcaacggtggccgcgcaggctccgccgtcatcaccggcttcggcgaggtgttcggccgcaaagtggccgtctacgcgcaggacttctccgtcaaaggcggcacgcttggcgtggccgaaggccgcaagatctgccatctgatggacaaggcgctcgacctcaaggtgccgatcatcgcgctcatcgactccggtggcgcgcgcatccaggagggtgtggccgcgctgaccgaatacggccacctgttccgcaaaacctgcgacgccagcggtttcgtgccgcagctatcgctgatcctcggcccctgcgccggcggtgccgtctactgcccggccctgaccgacctgatcatcatgacccgcgagaattccaacatgttcgtcaccggtcccgacgtggtcaaagcggccaccggcgaagtgatcagcatggacgatctgggcggcggctacgtgcacaacgccacgtccggcgtggcccactatctcggcgaggacgaggcggatgcgatcgactacgcgcgtaccgtgctcgcctatctgccgtccaactctgaccagcagccgccggtctacgcgtacgcggccacccgcgccgaccgtgacgtggccaaacgcctcgccaccctcgtgccggacaacgaccgccagccgtatgacgtgctcgacgtgatccgctgcatcgtggactacggtgaattcgtgcaggtgcacgaactgttcgccgcttcagcggtggtcggcttcgcctgcatcgacggccatcccgtcggcatcgtggccaaccagccgaacgtcaacgccggcattctcgacgtcgactcatccgaaaaagtggcgcgattcgtgcgcttgtgcgacgcgttcaacctgccggtcgtcaccttggtggacaccccgggctacaagccgggcgccgaacaggaacatgcgggcatcatccgccgtggcgcgaaggtcatctacgcctacgccaacgcgcaggtgccgctcgtcaccatcatcctgcgcaaggccttcggtggcgcatacatcgtgatgggctctaaatccattggcgcggacatgaacttcgcctggccatccagccagatcgcggtgctcggcgcggccggcgcggtcaacatcatccaccgcaaggacctgcagaaagccaaagacaacggcaaggacgtcgaagcgctgcgcgccaagtacatcgccgactacgaacgcaccaccgtcaacgcgaacctttcgctggaaatgggcgagatcgacgccatgatcgaccccgaacagacacgcgagaccatcatcgaatcgctccgcctgctcgccagcaagaaacgcgtgcgccgaaccagcaaacaccacggcaaccagccgctgtgacggacgcaacgcgacgtaaccaacgtaagcaaccacaacaatcgcaagaaattttggaacaagtaaggaagattatgaacaccttttttcttgatcgactgaacagcgagccccacgcgctcgccttcgccggccaatccaccccgtggccggtggcgctcgccgaccagagcgcgaatccggcgctcgacgaggtcctgcacacccatgcggccgccgcgcaggcgctgctgtatccggtgtccgccgagctgctcgccaccaccggacgcccggtcgacctgttcggcttcgaaccgaacccggcacgtctgggcgccgcagccgcggcttccgccagcgttcccggcatcgcgctgacccagctgggcgcgctgctcgacgccgccgcactcggctacaatccggcccaggccaagccggtcgtggtgctcggccactcccagggcgtgcttgccgtgcatatggtgcaggcgatctgcgaagccggttccatcgacgcagccgcagccaagatcgacgagattcttgcgatcgcaacgctgatcggcgtcgccggcacccgtcaggcacgccagctcggtctcgccgcacgccacggcgaggcgaccccgatgctgtccgtcaaggacatcacccgcgcccaggtggacgcgctgatcgaacgcgtcgacggcgcacgtggcccgatcgccgtggccgtcaccaattccgccacgcattacgtgttgtccggctatccggaggacctggccgcattcggcgtggaggtcgccaaggaacacaagcgtcaggccaagctgcgcgaggagaaggtgcgtggcggccgcgtgttcgacccgacgctcgaatatctcgacgtgaccctgccgttccacagcccgctgatggccgatgccgtctcccaggccgtcgcatgggccgaggcctgcggcatcaacgccgaccatgcccgtgagctcgccgccgaagtgctgctcaaccatgtggattgggccgcccgcgtgcgcgccctgatgaagtccaccgatccgagcgccctgtgggtgctggacttcggtccgggcaacaccgtcggcaaactgttctccaccgtggcccagggcaccggcgtcggcgtggtggaagcctccaccgtggccgatcgcggcgcgctctccacgctcgagaccctgccggaacgcacccagaactggacgcgtttcgcgccgagcatcatccacacgtccgccggagacaaggtgcgcaccgcgttcaccgaacttaccggcaaggctccggtgctgctggccggcatgaccccgaccaccgtggagccggagatcgtggcggctgccgccaacgccggctactgggccgagctcgcaggcggcggccaggtcaccgccagcgtgttcgaccgtcacgtggccaagctcgaggaggaactcgaggaaggccgcaccgtcgaattcaacgccatgttcatggaccgctacctgtggaacctgcagttcggctcccagcgcatcgtgccgaagaagcgtgccagcggcaccccgatcgacggcgtcgtcgtctccgcaggcattccggaattcgacgaggccgtggaactcatccacaacctcaacgccgacggcttcccgtacgtgagcttcaagccgggcaccgtcgaccagatccgccaggtggtgcgcatcgccaaggccgtcgcgccaaccaaggtgctcatcgaggtcgaaggcggttccgcaggcggccaccactcttgggaatcgcttgacgatctgctgctgagcacctacgccgaagtgcgcgagcaggccaacctcgtgctcgtggtcggcggcggcatcggcacgccggaacgcggcgccgactacatcaccggcgaatgggccgccgaatacggccgtccgctcatgccggtggacggcgtgctcgtcggcaccgccgccatgaccgccaaggaagcgcacaccaaccctgaagtcaagcagatgctcgtcagcactcctggcattccggccaagggcgacgacaatgatccgttcgccccgctgggcgagcagtgggttccgtccggacaggccaagggcggcgtcacctccggtctgagccacctgcacgccgacatctacgagctggagaactcctccgcccgctgcggccgcctgctggtgcgcgtcatgaagcacccggaggagctggaaagccgtcgcgacgagatcatcgcggcgctgaacgccaccgccaagccgtatttcggcgatctgaagaccatgacctaccttgagtgggcccagcgtttcgccgacctctccttcccgtgggtggacgaaacctacgccgatcgcttcctgcacctgctgcagcgcatcgaagcccgcgtcaccacgcaggaaagcggcgaattcgcatcgctgttcgcttcccgcgccgacgtcgaagccgatccgaacgccgcgatcgccaagcttgccgaaacctacccgcaggccggcaaactgaccgtcaccccgatggacgaggcatggttcccggtgctcgtacgcgagtatccgaagccgatgccgttcgtgccggtcatcgacaacgacctgctgcgttggtggggccaggaccagctgtggcagtccgaggactcccgctattccgccgattccgtgcgcatcatccccggcccgatctccgtggccggcatcaccaccgtggacgagccggtggccgacatcctcggccgcttcgaagccgccatggtcaagcgcgtgtccgccgaatcggcgagcgccgacaagaccgccttcgcccagttgggcgcggccgtctccgccgaggaattcatccgcaaatccccgaacatctcctgggtcggccacctcatggccaacccggcgtacggcaccgccaacggcgacgccaactacgagatccgcaaggtggccgttgaaggcagcgtcgaaaagtacgacctcgacatccatctcgacaccttctgggacaacgatccggacggcggcgcctccaagcacgccgtacgcgacatcgtcattccgctgaacgtcgacggcaacgaatccggcctgttcccggtcgtggaccgcgaccgtctgccggagcacgtctaccgcatgctcgccgacaccgcgggcatcggcaacaccgccatcaccggcgacaagctcaccgccatgccgcagatcgaggaagtgtccgacaagaccgccttcccgttcggccaggcgcacaccggctacacgctgtccgccaacctcggtttcgaccatgaggccgccaccggcggcgcgctgccgagcgacctcgtgccgtcccgcatcgccccggacgcgctcgtcggaccggcttggcccgccatctacgcggccctcggctccgtgtacgtcaacggcttcccggtcatcgaaggcctgctcaacgccgtgcatctcgaccacctcatcgaactcgaggtgagcgaggacgagctgctgaagcacaccggcgagcgcatcgagctcaccagctgggccgacgactacttcgaatccgcttccggccgtgtggtgaccatccacgtcacgcacaccgctcaggacggtacgctgcttgccaacgaaaccgagcgtttcgccatccgcggccgcgcgtactccgacgcgctgccgccggaagcgcccgactatggtggaatcgaagccgaaatcgaaagcactccgcgccgtctgctgcgtcgtgtgaaggtcgtcgctccgcacgagatgaccgctttcgcccgtacttccggcgatttcaacccgattcacacctctcatcgcggtgccgccgtctccggtctcgccgcgccgctcgtgcacggcatgtggctgtccgccaccgcccagtacgcggtgcaggcgctcgacgagaagggcgcgcattacgagatcgcaggctggacgtacaacatgtacggcatggtgcagctcgacgacgaggtggagatctccatcgaacgcgtcggccgtgtggcccacgccggcatggtgctggaagtgaccagccgcatcgacggcaatatcgtgtcccgtggcaccgccatcgtgcgtgcgccgaagtccgccttcgtctacccgggccagggcatccagaagcagggcatggtgctcgacgagcgtgccaagtccccggccgcacgcgaggtgtgggagcgcgccgacaaggtgacccgcgagaagctcggcttctccatcctcgccgtcgtgcgtgataatccgaaggaactgaccgccaacggcgtgacctaccgtcatccggaaggcctgctcaacctgacccagttcacgcaggtggcgctcgccaccgtggcgttcgcccagaccgctcgtctgcgcgaagccggcgcggacatctggcccgcctacttcgctggccactcgctgggcgagtacaacgcgctgagctccttcgcaggcgtgattccgctggaaaccgtgctggagctggtgttccaccgtggctccaccatgcaccacctcattccgcgtgacgagaagggccgttccaactaccgtatgggcgcgctgcgtccgaaccagttcggtgtgggcgacgacggcgtgcgcgaatacgtcgaatccgtttcgaaggcttccggcgagttcctggagatcgtcaactacaaccttgccggacagcagtacgccgtggccggcaccatcgccggtctgaaggcgctgaaggccgattccgcccgtcgcgtcgccgaatacggcggcaagccggcgttcatgctggtgccgggcatcgacgtgccgttccattccacgctgctacgcaagggtgtgccggagttccgcgacaagcttgacgcgctgctgccgaagcacatcgactaccgtggccgtctggttggccgttacattccgaatctggtggccgtgccgttcgagatgaccaaggaattcgccgcgaagatcctcgaggtcgtgccgtccgagcgcatcaaggccgcgttggacgatccgaaggtgtgggattcctacgccgaggacgaccagaagctcggccgtctgctgctcaccgaactgctgagctggcagttcgcctccccggtgcgttggatcgaaacccaggcgctgctgttcggttccgccgaacagggtggccttggcgtggaggagtacgtcgaggtgggtctcggcaacgctccgacgctcgccaacctcggcgccaagacgctgcgcctgccgcagttcgccggccgtgacgtgaccgtctacaacgtcggccgcgacgaaggccgcgtctacatgaccgattccgattccctcgttgccgacgacgatgctgacgattccgtcgcagcaccggcagcagcttcggctccggccgctgccgccgcagcgcctgccgcggtcgccgcagcacccgtcgccgcagccccggctgccgctgcaccggtcgcacctgccggcgctccgtccggcgccgcagtcgcggatattccgttcaacgcttccgacgcgatcgccatgctgctggcatattcggcgaaggtgcgtccggaccagatcggcgaatccgacaccaccgacaccctgaccaacggcgtctcctctcgccgtaaccagctgcttatggacatcagctccgagctgggcgtggcttccgtggacggcgccgccgaagcgaccgtcaaggcgctgagcgcgctggtcgacaaggtggccccgaactacaaggcgttcggtccggtgctgtccgacatcgtccgcgaccgtgtgcgcggcctgttcggcgccgccggcgtgaagctcggccagatcaccaagcgcgtgaccgacacctggcagctcggcgaaggctgggcctcccacgtggtcgcagcccttgtgctggaaacccgcgaaggcgccagctcccgcggtggcgacctcgcctcgctgagcaccgaagccgcttccaatgcggccgccgccaacgcgctgatcgacgcggccgtgcagaaggtcgcttccgacaagggcgtggccgtcgccatgccgagcgcaggtggcgcagccggtggcgccgtggtcgattccgcagccttggacgcgttcgcggccaaggtgaccggtgccgacggcgtgctcgcctccaccgccaagttcgtgctgaaccagctgggcgtcaccgcttcggtcgccgacgattccgccgacgagaacgccgccgtggtggccgccgtcgaagccgagctcggctccgactggccgaagcaggtcgagccgcgcttcgacgagcgcaaggccatcctgttcgacgaccgttgggcatccgcacgcgaggacctgtcccgcgcctactacgacaacgacgcctccgcactggacggcagcttcatcggcctgggcaaggccgtcgccgacgaagccgcatggtatgcgggcaagaccgctgacgtcgagcttgccgccgcgttcaagcgcgtggccgacgaggcgctcgagcagacgaacgattccgccgaagcaagccgcttcgcaggcgatatcgccgtcgtgaccggcgttgccccgaactccatcgcagcgcaggtggtcaacggcctgctcgccggaggcgcgaccgtcgtggccacttcgcacagcttcaggcagagcgtgaaggcctgggccaagcagacctaccgcgagcatgcggcaggcgacgccaagctgtggctcgttccggcgaacctgtccagctaccgtgacgtggacgctctcgtggcgtgggtcggcaacgtgcagaagaagacctccggcgcgaccaccacgatcctgaagcccgcctacgagccaagcctgttcttcccgttcgccgctccgccggtgcacggcacgttggccgattccggcgagctgttcgaatcgcaggcgcgcctcatgctgtggggtgtggaacgcgcgatcaccggcttcgcgaagatcggcgccgacaccgacgtgcagcacaagctgcatgtgattctgccgggctccccgaaccgtggcgtcttcggcggcgacggcgcgtacggcgaggtcaagagcgccttcgacgcgatcgtcaaccgcgcccgcgccgaaaaggtgtggtccagccgcgtcaccttcgcccacccgaaaatcggctgggtgcgtggcaccggcctgatgggcggcaacgatccgctggtcgaagtcgtggaacgtcacggactgaagacctactccaccgccgaaatcgcggtcaagctgctcgagctgtccaccaaggaatcccgcgagcaggccgtcaaggccccgctcgacgtggacctgaccggcggcctcggcagcgagccgatcgacatcaaggcactgcgcgccgaagccatggaggacgcggccaaggccgctgccgccgaagccggcgatgaggacaagcagggcgattgtgccgctgcggcaacgctgatcaaggcgctgccgagcccgcgcgccccgcgtcaggcgaaggtcgatctgaaggattggcagcacgtcaccgcccgtccggaagacgagatcgtcatcgtctccatcggagagctgggcccgtggggctccggccgcacccgtttcgaagccgaactcggcatccactccgacggcaaggtcgacctgtccgccggcgcggtgctcgaactggcttggaacatgggcctgctgacctggaacgacagcccgaagccgggctggtacgacaccgacggcaacctggtgcccgaagaggatatcgccgaacgctaccacgacgaggtcgtggcccgctccggcgtgcgtccgttcgaagagggcatgggcaacgattacaaggacggtgccgacgaggaggaggccgaggtgttcctcgaccacgatgtgaccttctccgttccgacccgtgagatcgccgaggaatacgtcaagctcgacgaagcccacaccagctacgcggccgacgccgaatccggcgagtggaacgtcacccgccacgccggctccatgatccgcgtgcctcgccgcgcggccatgacccgcaccgtcggcggtcagttcccgaagggcttcgacccggtcaagtggggcattccggcctccatggtcggcgacgtggacaagatcgccctgtggaacatcgtcaccacggtcgacgcctacctgtccgcgggcttcaccccggccgagatcctcgaagccgtgcacccgtccatggtggcctccacgcagggcaccggcttcggcggcatggcctccatgaggaagctgtacctggaccgcttcctcaaccatgagattccgaccgacatcctgcaggaagccctgccgaacgtcgtcgcggcacacgtgatgcagtcctacatcggcggctacggcaacatgatccagccggtttccgcctgcgccaccgcagccgtctctctggaggaaggcgccgacaagatcgccctcggcaaggccgacttcgtggtcaccggcgcgatcgacgacatcggcgtggaatccgtgatcggcttcggcaacatgaacgccaccgccaactccgaggagatgtatgccaagggcatcgacgcgcgcttcttctcccgtgccaacgatcgtcgccgcggcggcttcgtggaatcccagggtggtggcaccatcctgctgacgcgtggtgacatcgcgctgaagctcggcctgccggtcgccggcgtggtcggattcgtccactcctatgcggacggcgcgcacacctccatcccggctccgggactgggcgcgctcgcagcgggcatgggaggcaaggactccaagctcgtgcatgacctcgccaagctcggcgtcacgccggacgacatcgccgtggtctccaagcacgacacgtccaccaacgccaacgacccgaacgagtccgaactgcacaacacgctggcccacgccatcggccgcaccgacggcaacccgctgttcgtgatctcccagaagtcgctcaccggccatgccaagggcggtgcctgcatcttccaggtcaacggcctgacccagctgttcaagtccggcgtcgttccggcgaacgcggccctcgactgcgtcgacccgaagctcaagcgcgacgaccacatggtctggctgcgcgagccgctgaaggtcggttccgtcaaggccggcctggccacgtcgctcggcttcggccacgtgtccggcttcgccgcgatcgtcaacccgggcgccttcgaggcttccgtggccaacaccgcgggcgaggacgcgctgaacgaatggcgcgaccgtgccaacgcgcgtctcgccgccggccagcgtcgccttgaagagggcatgatggggcgcgccgcgctctacgagccgatcgacaaccgccgcttccacgaggacggccgcggctacgacgcgcacgaggtggagaaggccatgctgctcgatccgaacgcgcgcctcgcgtccaccggctatttcgaagcgtgagacggctacgtcgaaatctgtcctgaatatgggcaaatgatgacggcctgataagaaaagggcgatacttctgcacagatgtgtcgcccttttccatatgacatggtcggggcattcccggggtaaccccgattaataattcctaggaaggcggaggaatgctgggtctagggcatgacgtcgttgacgtgcctgcgttcgccaagcagctgaatgagccggggacgcgtatgcgcaatctgttctccatgcgcgagatatggcagacggcgcaacggtcgcagctcaagcatgatgacgaggcggtgcacctcgccgcccgctgggcaggcaaggaggcgttcctgaaagcgtggtgcgcggccatttcgcggcatgcgaaagacggcgccgaagtcgcatatccgtacacgctcgacaacttcccatgggtgcgcatcgaaattctcgacgattcccacggcgtgccgcgcgtcatactgtcctccgaagtgcaacgcaaggtgcagcagtcgttgggcctgccgttggatccggtgtgccagtcgtacgatatctccatctccataagccatgacgggccgatcgcctccgccgtggtcatgctcgaaatctgaaatgccattcccgcttgcaaaagttggtgggatgtgtataatagctcgagtcgtttcgtgtcggcttcggacgtagcggcaacacgcggatgtagctcaatggtagagcctcagtcttccaaactgattacgcgggttcgattcccgtcatccgctccacaacagcatcagagaagaagaaggcgtgcctcaaggcacgcctttcgtatatccgtatgcccgggcatacgattgcccgggtatgctggaacgggccgcggcgtgcggcggcgcaatcgcaagatatcgcaatatatacggagcggaacatgggtcagaaggaacgcaacaaggcaacggaagtcgtggatggcgtggtcgagaccgtcgacgtctccaaacacccgacggcgtccatcgaaccgtcggacctgtccttggccgacatcgaacgccgcaaatcgcatccggtccgctggattctgttcatggcattggtgctgctggccatgatcgcgccgtactggtgggggcgcgacatcgcggtgcgggacgcctcatggatggtggcgaacctgaatttcctcgatcccaaaggcgtggcgctgatttcatggacggtgaccatcgtggcgctcaccggactcggactgatggtcgcggacgcgaagaaatggctgtgggggaccattttcgtgatcggccttgccgcggagcaattcgtcgccggcatgtgcctgctgagcttcaacttctggaacgccacctatgtgatgtacggtgaggcggccggactggcgaacgccgcgaatctcggcatcatcgccgccggtttcggcgtcgcggtctacgcggtgctctgggtgggcctgctggtgtgcatcaagaaggaatcgaagctcaacgtcctcacacgcagctgggcctcgttcctattgttcttcgcaatcgaactcgtcgcgcttgccgtggtgttgttcggcggtctgctcatgtccatggcgtgacgtgaagaacggccgtcggcgggggcggaaatatcggccggcgattttggtccggccgtcgtgtaagatgttcccttggcgtgtttcgcccgcggatagagagcgcgtcggtattgggccggcagcaccgcgcagcaatataaggaggatgccgtggcacttacggctgaggaaaagcaggaaatcatcaagacctacgcaacccacgagggtgacaccggctccccggaggtccaggttgctctgctcaccaagcgcatcgctgatctgaccgagcacctcaaggagcacaagcacgatcaccactcccgtcgtggtctgctgctgatggtcggcgaccgtcgtcgtatgcttgattacctcaagcgcgttgacatcaaccgttaccgctccctgatcgagcgtctgggtctgcgccgataacattcttccgcccgagcgccatatggcgcccgggcgtttttgcatgacagccgagttcaaggaacagacagtttgaaggcccgaggtttggggcgcacgaggtctagaatctagagatgaggaagcggcggaggcaacgccgcgtcacgcatgtaggaatcggttggagtccgctgaagaggactgccgatagtaggtacacaagaaaagaaaacaaaggaggaaccctatggagggtcccgaaatcaaggctgttgaagccgtaatcgataatggttcattcggcaagcgcacgctgcgcttcgagaccggtcgtctcgcccagcaggcggatggtgccgtcgccgcctatcttgacgatgattcgatgattctgtccacgaccaccgccggttccagcccgaaggagaactacgacttcttcccgctgaccgtggacgtggaagagaagatgtacgcagccggcaagatcccgggctcgttcttccgccgcgaaggccgtccgagctccgaagccatcctggcctgccgcatcatcgaccgtccgttgcgtccgctgttcccgcacaccctgcgcaacgaagtgcaggtcgtcgaaaccgtgctcgccgtcaacccggatgacgcatacgacgtcgtcgcactgaacgccgcctccgcctccaccatgatctccggcctgccgttcgaaggcccggtctccggcgtgcgtctggccctgatcgacggccagtgggtcgccttcccgcgctggagcgagcgcgaacgcgccgtgttcgaaatcgtggtcgccggccgcgttgtcgagaacggcgacgtcgccatcgccatgatcgaagccggtgccggcaagaacgcatggcacctcatctacgacgaaggccagaccaagccggacgaggaagtcgtcgccggcggtcttgaagccgccaagccgttcatcaaggtgatctgcgaggcccaggccgagctcaagaagatcgccgcgaaggaaaccaaggaattccagctcttcccggagtacaccgaggatctgtacaaccgcatcgacgagatcgcccacgccgacctcgacgaagccctgtccatcgccgaaaagctgccgcgccaggaccgcatccacgagatcaaggaaggcgtcaaggccaccctcgccggcgagttcaccgacatggaagacgccgagaaggacaaggaaatcggcaacgcgttcaaggagctgcagcgccagatcgtgcgccgccgcatcctgacccaggactaccgcatcgacggccgtggcctgcgtgacatccgcaccctgtccgccgaagtggacatcgtgccgcgcgtgcacggctccgcactgttccagcgtggcgaaacccagattctgggcgtcaccaccctgaacatgctcaagatggagcagcaaatcgacgcgctgtccggcccgcagtccaagcgctacatgcacaattacgaaatgccgccgtactccaccggtgagaccggccgcgtcggttccccgaagcgccgcgagatcggccatggcgccctcgccgagaaggccctcgtgccggtgctgccgagccgtgaggagttcccgtacgccatccgtcaggtctccgaggcaatcggctccaacggttccacctccatgggttccgtctgcgcctccacgctgtccctgctcgccgctggcgttccgctgaaggctccggtcgcaggcatcgccatgggcctcgtgtccggcgacgtcgacggccagcacatctacaagacgctcaccgacatcctcggcgccgaagacgccttcggcgacatggacttcaaggtggccggcacctccgaattcatcaccgccctgcagctcgacaccaagctcgacggcattccggccgacatcctggcgtccgccctgcagcaggccaaggaagcccgcaccaccatcctcgaagtcatcaacgagtgcatcgacggcccggccgagatgagcccgtacgcgccgcgcatcatcaccaccaccgttccggtggacaagatcggcgaggtcatcggcccgaagggcaagatgatcaaccagatccaggaagacaccggcgccgaaatcgccatcgaggatgacggcaccgtgtacatctcctccgaaggcggcgaggccgccgagaaggccaaggagatcatcgaccagatcgccaacccgcacgtgccggaagccggcgagacctacaacggcaaggtcgtgaagaccacctccttcggcgccttcgtgaacctgaccccgggcaccgacggtctgctgcacatctcccagatccgcaacctcgccaacggcgagcgcatcgacgccgtcgaagacgtgctcaaggaaggcgacaccgttgaggtggtcgtgcagggtgttgacgatcgcggcaagatctcccttgccatcccgggcttcgaggatcaggaatcctccgctccgcgtcgtgaccgtggcgatcgcgatgaccgccgtggcggccgtggccgtcgtgacgaccgccgtcgttccgacgatcgcgatgatcgcgattatgatgatcgtccgcgtcgccgtcgttccgaccgcgatgacgatcgtgattatgatgatcgtccgcgtcgccgtcgttccgaccgtgacgatcgcgactacgatcgtgacgaccgccgttcgtcccgttccgatcgcgatgatcgtgattatgatgatcgtccgcgtcgccgtcgttccgaccgcgatgaccgtgactacgatcgcgatgaccgccgttccgaccgtcgccgtggtagccgtcgtgacgaccgcaacccgcgttacgccgccgacgagaactacgacgagtaccgtgccgatcgcgaagagcgctccgagcgtccgcgtcgccgcgtgcgccgcgactttgatccgttcgaagactgacgtcttctcacggatccttcgcagcgaagctgctcacttcacctacgagaagcccactgggcttctcgcttgacggctcagcattcgaagactgatgacaccttcgcgcggatttcccgcagcataagatgattatctgaaaggcccgcccccgtggggcgggcctttctgcattccgacacgcttggcaaaacatgatgtcaatcgttttacgggtgtatgcgcgccgtggaatggtgcagtcctcatgagaacatgatggcaatagaagcaacgaagcagagaagcagagaggaaatacgatgatcgtagccattattatcgtcgtcatcatcgttcttgtgctgttgtgggcaatgtccgcctacaacgggctggttacgctgcgtaaccgggtgaagaacggctgggcgcagattgacgtgcagctcaagcagcgtgccgacctcattccgaatctggtggaaaccgtcaaaggctatgctgcccatgaatccaacgtgttcacgcaggtgacgcaggctcgtgccggcgtcatccaggctgcgcaaagcggtgatgtgcagcagcgcatccaggccgagaaccagctgagccgtgcgctggtgaacctccaggccaccgccgaggcatatccgcagctgcaggccaaccagaacttcatggatctgcaggggcagctcaaggggctcgaggagaaaatcgcctacgcccgccagttctataacgatgtggtgcagaagtacaacaccaagatcgaggtcgtgccgaccaacatcatcgccggactgttccacttcgagcaggcggcgtacttccaggtcgacgaagcggaccgtcaggctccgcaagtcaagttctgaacgtttccatacaagaaaggggagcgctgacgaggtgtgatgtcttgccagcactccctttcctgtattacggtccgttgacgccgagaccatgcgttggtgcttgaggacccttgagagaaaacagagataccgccgatgaatatcagacgtacgttggtcagtctgctgtccacgattgtggtcacgttgacgatgttgggcatcgtgctcatcaatgcgcagacctccgatgaggaacccgatttaagctaccgcacgcttgactacgacgtggcggtgcagaggaacggcgatctcaaagtcacgcagcatatcgacatgaggctgaaggaccgtggccgtgactggaagcagatgtatcagcggtatacgctgaaatccaagaatctcacggatatcagcgatattggggtcaaggacgtatccaacggcgagacataccgccagggcgacttcgtcttccccgacaatgccgacaactggaacgacgagcatgcgggacggtggtacatcgtggacgtcactgaggatgagaacgatcctcagccgttcaatccgcagaccgatgggttaagtgatgacggtcaggccgacaaaacacttgaaatcggttggaatattccacaaaccgtatccgaggacagtctcaaattcgatgtatccatgacgctgcatggcgtgagcaccgcctatgacgacgtcgtctccttccaatgggagccgttcggcgaggaaaaccagattcccatcggtacggtgacgggcaaagtcacattccccaacggcattaacggcaagaattcgtgggcatggctgcacaccaaaaatacctccaccacgaaccgcggcgataatggttccctgatgttctccgccaatgatgtgcgcgccggcgactatttggatgtcgtggccatgttcgatgcctcgcaagcgcaaggcgtggcacgcaccaagtccggcgcatacaagcaacggcttatcgacgatgaaaccaaacaggaacgggaatggaggtccagtcagcatacgaaggccgtcaaacgggtggccggctggatattcgcggcgttgatcggcatcgcgcttgctgtggcggcgctgtatttcgccatcgtcagcttccgcaaatcgcaatacaagggcgatatcgaatactggcgggacctgcctgacctaagtccagcagccgccgcgaagatggaggatatcatgagcgcatcctcctcgatattcggttccggcaagaccaagaacgccgacaaactggccaacagacagatgtccgccacggtgatgtcgcttgcctcgaaaggcgcgatcgccatctatccggggccggtggacctgtataacggcattgatttgaccacgacgagcgcggcttcggtggctggcatgctcggttccaatgcggcgtccgcgcgcaaactgaagaagaccagcaccatcgctatcatgccggtggtgtgtgacgacatcggttcgttgctgctcagttcctccgaaagagcggtgcttgacatcctgcttaaagcgtcatcgcgtctgcatgatgcgcaggtgtttgatttgaaacagatgagcaaggccttcaaacactattcgagcggttacaagctgttggaaaccttcgacaacgcgtgctccatggaattcgatgacttacatgccgtcaagcctatgggattgctcagctatctgttcagtgggctgggtattgcgttcgccttcttcctggcgttgaaatacgtgcaggacggtgagcttgccgtggcgctggtcgtctgcgttccggtggtcgcgctttgcgctttcgccgcagcatacgggaaacgctatgtgctgaccgatgaggggcaacgctatggtgggcaagtcgccggattgaaacgctatcttacggatttcagcgatttcaccgaccgaggcgtgctcgacatgacgttgtggggccggtacatggtgtatgccaccgcgttcggcatttccaagaaggcgatggcccagctagccagagcatatcccgaagtggccgatccgcagtggttggatgagcatgccggcacctcgtacatgtacatgcccttgcgttccagcagcctgcttggcgcatccgtcggcacgtcgcttggcgcctccacgattgatccggccgcattcagcgcgaatttcggcgatctcggtgcgcagctgagttccagtttcgccgatgtgcgcagcacgatctccgcggcggccccatcctcctcatccggaggttccggaagctccggcggttccggtggttccttctccggcggcggtttcggaggatcgtccggcggctccggcggcggttcgttcggaggccgatgaaacagacgtactggcaaacgcaccatggccgcattggccagtcgtagagagcaggaaggggtgaacaatgaacggtaaacggtacggacgcgggctaatcgccgcgttcagtgcgctggtggcggtggttgccatcatccttgcggtattcgtcatatccggcgacgaggcggacctgagctaccgctccgtcgacttcgatgcacggctccagagcaacggcgacattagattcacagagcatctggactaccagctgaagcgtcgcgaggacggcaacggtgacaccaagccgtggaaacagctgtatctgacgttcaaactgcgcaaccaagatctgacgaacatcaccgacatctccgtgaccaacgcatccacaggcgaggaatatacgcagaccgatccacaattgccatccggcatatccgacggcacatgggactcgacctatgccggccactggtacatcgccgacaccacggccggttccgactcgccgcagccgttcgatcccactaccgacggcatcgacccgaatggttccggcgagcagaagaacatcgagatcggctggaacatccccgccaccgtcaaacagagcagcctcaagttcgatgtgagcatgacgttccatgacatgggcacgcggcatagcgacgtgacgaatctcatgtgggagatgttccctgaaaacaaccaggtgccggccggcaaggtcaccggcaccgtgcgtttccccaaaggcatcgcctccaacaattcgtgggcgtggttgcataccgaagccacctcccagacatcgcgcgatgcggacggcacattgcatttcaccatcagcgacctgcgcaccaaccaatatgtcgacctcgtcgcggccttcgacaacacaggcgctgccggcgtcgaacgtacgcagtccggcgattatctcgacgaactgaaatccacggaggccgccaaggaacggcagtggcgtgaccgacaacggttgaaggcgcagctcaccgtcgcaggctggttgatttgtctgataatcggagtgctatgctgcgtgctggcgattcgtggcgtgctgtcggcgaaccgcgaggcccgttaccaaggcggcatcgaatattggcgcgatccgccgcaggtcagccctgcggccagcgcgtatctgatcgacgtggtggacgaatccgtaggtgaccgatcatcgcgtgccatgacggcgacgatactggcgttggtggtcaagaaggcgcttgccgtctacccggggccatccagcctgtaccaaggcatcgacctgagccaagccaacgcctccgacctcgcccgcatgattgcttccgatcccaatcgagccaaggccacggcttcctccagcactctggtgatcatgccggccgcgctttcccatcgcaacaccctcggtctgagccagtccgaggaagcctgtctggaactgctgatcggcatctccatgcgcgtcggctcgccggtgttcgacttcaaccagatggacacggcctgctccgactgggaggagggctaccagtccctgaatcggttcaagagcgcctgtgacctcgaattcggagcgcttggcgcggtgaagagcgtgaacggacggtggttggtgccgagcctatgtctgatggtcatcggcgctattggtatattcgccaacggtgcgagcaatatcgcgatggcgctgtgcttgggcgtgccgttcatctgtatcggcgtcttctgcatggccgcgggccgatcggaaggcatcaccgaacgcggccagcagtatgccggcgaatgcttgggactcaaacgctatatggaagatttctccaatttctccaatcgcggagcccttgatttgacgctatggaactggtacatggtctacgcggcggcgttcggcatctccgagaaggtagcgagggaattcgcccgcgcctaccccgaagtcaacgacccgcaatggcttgacacctacggttatgactccttgggctattggacctatcgttcccaggcgtggaacggtccgatcaatacgaatggcatgatgccgggtggtatgtatggcggtacgcaattcatgggcggcgtcggtgacatcggttcgcagatcagctctggattcgcttcggtgagttccacgatttccgcggccgcgccttcctcatcctctggctccggcggatccttctccggtggcggcttcggcggcggtggcggaggcggcggcggtggaggcggcggaggccgatagccaaggcgccgccgcggcagcgctgtctgcccgtcatgccgtttcgtcatacgatcattggcataatcaacgtggccccggcatggagaagcctaccgttcgcctatggcgattggtaggcttctccattggaaacacacctgaacgctgacgtcgaccggcttggcatgctttgccggaaagacgcttcgtgcatatgcccgatgcagggcacgtgcctgtttggaaggacaagacatgacgttattccgcgatctcggaccattccataccaccgccatcggccacggcgagatgccgctaaccattgaaaacaaccggggccacgatgtcggtatcgagaccttgcatgcatctttggatgctggctgccgtcatatcgacaccgcgtgggcgtattacacccccggtgaggaggagcagaccggcgaaaagctggtccgcgaagcactggagacctggaagggacctcgtgaggaagtcaccgtggccaccaaggtcggtctgcgccgcgcgtgggatggcgacaagccgatctggccgcgcgacggcaagccggaacacctcatcgaatacggcaagcagtccgcgcaggcgctcggcgtcgactcgatcgacctgctctacctgcatcgccacgatccggaagtgccgtacaacgagtcctgcgaaggtatcaaggcgctgctcgaccagggcgttgcccagtgggcgggtgtgtccaacgtgagcatcgaacagctcaaaatcgcacaggagattctcggcgacaagctcgttgccgtgcagaaccagtattcgccgatccatctggaaacccaggacacgttggaatactgcgcgaaggaaggtctcgccttcgtgtgctggagtccgctcggcggctaccgccacccgtacgacgagcacctgttcgacccgttccgcgaagtggccgccaagcatggcgtgagctaccagcgcgtggtgctggcttgggagctggccaagggcgaccacatgttcgtgattccgggcgcacaccgtcccgaaaccatcctcgactccctgaaggccgacgagctcgaactcactgacgaggagctcgccttcctcggctgaaaaagcactgcccgtccgcattttgttagcccaaccactcagctcgggtagcaaaacacggacgggcatacgtttttgcggaaccggacggctatcggggattacagcacggccatcgcgaaatcagctagtagtttgacgccgtacagcaccaccaccgcgccacacacgcggttcatcgcggtgatgattcgcgggctgaacttgtggctgaacagcgacaccagcagggtgatgccgaagaaccacagtgccgacgcggtttccacgccggtgatgaacggcgtggactgaccgacggtaagcgtcgcgctgaacgcgccgagcatcagcgtgccgtcgatgatggcctgcggattgcaccacgtcaccacaccggcggtgacgatggtgtgcagcagctcgctgtcgccgccgaatttcgaagtgacgcgttgcgcaaggccctgcgattgcgaggtctgcgactgcggcgtttgcgcggcgccatcatcgccacccttgccgggaaacagcagacccgcgccgatacggatgaccaccaagccgccgatcgccagaatggccagcttcagccatgcgtggtcctgcatgagcttgccgatgccgaaaaagcaggacagcgacaacgacacgtcgaagaacagtacgatcagcgcggtcagcagcgcgcggcggcgcggcttggtcagcgccgaatcgatgacgaacagattctgcataccgatcggcgcgacatacgccaatcccaacgtcagcccttggaaaaagaatcccatactcgcctcttatccatccaaacatatttggttggttgtaatcaacccagccaaaaccaaccaaattgctcattttgtaatcgcaggaaaaacctctattctgcgaaaaacaacgtaaccagtgtcatattgtataggtgttgctacaataggcaaccagccaaaagctgaggtttggctcagccaatcgcaggacggtccactgtcagaaagcagatgcgccgaccgcggaaaacgccgaaccataccgacaccaccaatgtgaaggagcgtcatggcacgcatcgcgccgctgaacatcgattggaaaccggaccgtaccaccggcgaacccgtcaccgaacaaatcgtcgggtacatgtgcgaacaggtgcacagcggcaattggccgattggctcgcgtctgccgtcgcaacgcgcgctcgccgaatggttcggcgtgaaccggtccaccgtcatcgcggccatcaacgagctgtccgattatggcatcgtcgaagggcagcatggagcgggcacgcgaatcgtcagcaacacgtggtcgctgatgctgccgggcgcgcccgactgggccgattacgtggattccggcttcttcaaagccaacaacgacaccatccaagccatcaaccggtacgagttcacgccgaacatgacgcgcatcggcaccggcgagctcgacccgcggctctttccgaaagccatgtggcggcaggtgctcggcgaggcggcggacgagatcgaaacgctcggctacccgccgcccgaaggcctgcccgaactgcgcgaggccatcgcggcgcacatgcgcgccaccggcgtcgactgcacggcaagccaggtgctggtcacatccggcgcgttgcaggcgctgcagatgatttcggtgagcctgctgccggccggcaccaccgtatacgcggaatcgccgagctacatcaagtcgctgcaggtgttccagtcggccggcatgcatctggaaggcgtgccgatggacgacgacggcctcaacgtgcaggcattgcgcggcctgctggcggaaggggagcttgacaccggccgtccggcgccgctcaacgcgcgcaaccgcaaaggcaatgcgatcctgtacacgattccgaccaatcacaatccgacaggcgtcactatgagcgacaaacgccggcatgaactggtcgagctttccgtggacagccgactgccgatcatcgaggacggcgcctaccgcgacctgtatttcgaggatgatgccccgctgccgtcgctgaaggccctcgatgagaccggcatggtcatcacgctcggcagcgcgtccaagtcgctggctcccggcttgcgcatcggatggctggtcgccgccgaaccgatcgtgcagcggctcgccgacgtgaaaatgcagatggactacggtgcgagcgtgctgagccagtggacgttcgcgcgattcctcacgaacggcatgtacgacgaatacgtggccggcctgaaacgggagctgcggcaccgccgcgaccgcgcgctcgttacgctgcaggagaaaatggacgggctcgcccactggaacgtgccgtccggcggcttctacatttggatgaccttcgaccggccgatacgcatgaaccgcctgttccagctggccgccgaacgtggcgtgctgctcaaccccggcgacatctacgatttcgccgccgacaactccctgcgcctgagctactcctacaccacgccggaagagttcgccgacgccgtggacgtactcgccgccgtcgcacgcgagctggcgtagcccgagcttgcgtaacggctggacgggctttgcctgtcccgtgaatctacgacaatatctgatggtcttttacgagtaagaggaacatccgtgcaaagaagaaacaagccagaagtgttggcccccgcaggcaatttgaggggactgaaaaccgcggtcgattacggtgcggacgccgtctactgcggcggcaaggcgttcggcatgcgcagcgcgccgaaaaacctgagcctcgaggatttcgaggaaggcgcacgctacgcccacgagcgtggagcccgcgtgtacgtcaccttcaacgtgctgccgcgcaacaacgaggtggaagccatgcgcgaatacctcggcaagctgaaggacaccggcgtggacgcgctgatcgtctccgacatcggcgtgatgctcatggccaagcaggtggctccgaacctcgaactgcatgtgagcacgcaggccggcgtcaccaactaccaggccgccaacgcgttctacgaactgggcgcgcgccgcgtggtgctggcccgcgaaatggacctgcaggccgtgcgcgacatccgcgcccgcattcccgacgacctcgacatcgaatgcttcgtgcatggcgcgatgtgcatggccttctccggacgctgcctgttctccaactatctgaccggccgcgacggcaaccacggcgaatgcgcgcagccgtgccgctggaagtattcgatcgtcgaagagaaacgccccggccagtacttcccgatcgaacagaccgcggaaggcgcgtacctgttcaattcgcaggacatgaacatgctcgcccacatcgacgatctgcttgattcgggcgcgacgagcctcaagatcgaaggccgttccaagagcgcctactacatcgccgccatgacgaacgcctacaagacggccgtcaacgaatacatggtccagcgcggcttcgaagatgccgacggcaatgttctgaagccgttccgcgaccgcgtgatccgtcccggtgacccggaatacggcaagccggacaccgaggatgcgatcatggccaacgccgatggcgcgttcgccggcaagcccgacatcgacgccgttcccgttgggggcgtgccgtccggcaacgtttcggctggcaacgtttcgtccggcaatatcgcgattggcgagccggacaatctgagctaccacgcacgcagcacccgacgcaagtcgaacaccgccgccgaaatactgccggaaggctggcatcacgccggtgtacggccggcaccgcatgtcaccctgccggattggctgctcgacgagcccgacaaagtggcgcaccgcgactactccaccggcttctattatccggaacacaaagtgcggcaaagcaccgaccgttccgcatacttccgcgcatggctcgtcgtcggcgaagtgctgtcatggagtccggaagacggaggacgcgtgaccatcatgagccgcaacaagatcgaagccggccaggaagtcgaattcgtgctgcccggcgcggcccccttcgcctacaccgtgcctgccggcggtttccgtgacgccgacggccactgggtcgaagccatcaacaacccggcgcacgtcttctccatgccgtgcccacaggaggtgcccgtcaacgcggccatccgttcgcgcacgaaaaagccgacgctgaaagccgaatagaagacggcaatcgcaagcaggccttccaatcgcaaaaccaaggaaaaacaagacatgagcagcacacaatacgatgacgcgatcctcgattccaacgccatcgaccccactgacaaaaacggcaacccgattcccgtgaccattccgatcatgctggcccccggcatcaaagtcgtctacaccacgcgactcggcggcaccagcgaaggcgatttcgcgcacttcaacctcggcggcaaatccggcgacaaaccggaacacgtgctcgccaaccgcaaggcgctcgccgacgtgctcggcgcgaaaatcagcctcatcagccaggtgcattccggcgacgcggtggacgtggacgaatcattcgtcatcaaccagccgttcggattcgacgtgtccggcacgaagaagccggaagacgagacggacggcgaaaacaacgcgacggggaatgacggtgagccgaccgtcatcgaagccgacggccaagtgacgtcccggaagaacgtggcgctcggcatgttcgccgccgactgcctgccggtgctcatggccgatcccgaagccggcgtgatcggcgcagcgcactgcggccgtcgcggtctgcagaaaggcgtgatcggcgcgaccatcgagaagatggtgtccaagggcgcccagccggaacgtatcgtcgccacgctcggcccctgcatctgcggcgactgctacgaggtcggtggcgacatcgccgacgaattcgatgcgcagttcccgggaaccttcacgttgagccgatttggccagccgggcatcgacatcgccgcggccgccctgcaggagcttgccaaagcgggcgtgccggccgacaacatcgtctcatcccgtccacgcgtcaacgcggccacgcagtacctgtccgaagacgaggaactggccggcatctgcgccgccgatggcgaaggcgatccgaagctttccgaacggttcaacaagatccgccgcagcctgtgcacgctcgaaaacccgctgtggttctcgcatcgccgcgcgtcgctcgccaaaaaacagcatgaaggacgcatgctggcgctgatcgtacgcgaataatcaccatacgagtcatacaagccacgcgattcgtgcgattcgagtgattcgcgtggccactgttgcggattgcgtgcagaacccgccgtggaacggggtggcatgcggccgcggctttacggtggagcatatgagtaagggagagcagatgcaggaacagaagatgccggtcgtggccgtggtgctggcagcgggattcggcacccgattcgacgagaacaaccccaagcagctggtgtcggtgggcggcaagccaatcgtctgccggagcatcgaggcattcgaaaacaacgaccgcatcagcgacatcatcgtggtggtcaacgaacgcgtcgaagagacggtgaacgagcttatcgacgaagccggctacgccaaagtgcgggccatcgttcccggcggcgccgaacgcgtggacagcacgctcgccgccctggacctgctcaagcaggccggcattccctccggcgcgaagatcctcatccacgacggcgtgcgtccgttcgtcgaggagcggtccatcgacggctgcatcgacagcctggaccagttcaatgccgccaccgtggcctacgcctccaccgacacgattctgctcacagaggatctgggcgaccgcaaggtggtcaaatccgtgccggaacgtccgaacaccttccgcgcgcagaccccgcaggcgttccgtttcggtaccatcgtcaaagcctacgaactggccgccgccgaccccgacttccatccgaccgacgacacgcgcgtggtggtggactacctgcccgacgagccggtcgccatcgtggacggttccgaaacgaacctcaaaatcaccacgccatccgacatgccgatcgccgaaggcatcgcccgcagcctcgaccccgaacacgccaaggaggaagccaaggcgcgcatgcacgccgtgttcgccgaggcgttctcccagatgcacagccgttgattttcatcgaacgttaagtccgtcgacgtgtcggcagacttaacgttcaacacattcaccacgtacactggaaaccatgcagcagatcaacatcgtcatctccggtttcacgccctacgaaggcatcgacgtcaatccggccgtgctcgtgccggcggcggtagccaagcaatggggcgatccggcgcaatcgcaggcgatctccgaagaactgctgcaggacatcgccgtcaccgtcaccaacgtcacgcttccggtgagcttcgccaaagcctggcccacactgctggaagccatcgaacaggccaagccggacatcgtcatcgccacagggctcaagcgcacctcccgtggcattctgctggaacgatgcgccacaaatctcatggatgcggccaagccggatgccgacaacgtgattccgccccgccgcccgatcgacccggaaggtccggccgcgtactggacgcgcctgccgttgcggtcgatactgcacgatttcgccaaacacgagattcccgccgcgttgagttccgacgccggtacgttcgtatgcaattcgctgttctaccatctgctcaactggtcggcgggccaggaacgtcgcattctgtcggggttcgtcagcctgccgatcgtcaacggtcggccgcacgaacgtggactgccgatcgaacagcagaccgctgcggtcgatgacgtactgcgtgaatcggtacgatacttcctgcaaccctcgtcaagcgacattctgcttggctgaggacggctccgctttctacggcacgattttctgcgacatgtgagtcatgcggtttcgacacgtggtcgcggacataccgccatacccccgacagactttttcgaacgatttctgtgctctctgtgagaataatgcatttcgttctgcgtgccgcctgctgactgagatagagtactgaacgagtgcgcgctggcagatgcgcgaagtgtagggaattcgtgaaaggaaaagggcatggttgagcagttcccaatcgtgttgagggggtacgacaaggatcgagtcgacgaggcgttcgcttcggctcaggagacggtgaaccgtctgcgtgagcaggtcaaggccgacgaccagaccatccttgagctgcaggcgcagctgcaggaggaaaagaacaagaaggccgctccgaagtccttcgcgtcactgggcgccaacgcccagcagatgctcgccagcgcggaacagaccagcgccgagctgcttgaacgagccaagaaggacgcttccgcggcccgcgccacggtgcagctgcaggctgaaacactgctgaacaacgccaaaatcgacgccaagcgcatcatggacgacgccaacgccaaggcggccaaggtgctcggtgacgccaaggacgaatccgaagccatgagggccaatgcccagcatgaggtcgaccagatgcgcagcgaggcccagaaggccgtggtggcgcagcgtcagaccgtcgatctggaactgaccaactcccgtgaggaacacggcaagcgtcttgccgccgaacgcgccacgcaggaacgtgagatttccgacatgcgcaccgaggcgaccagcaagatcgccgaacagcgcaagaacgccaatgaggagatctcccgcctgaagagcgagaccaacgaccagatcgaatccgcgcttgccgaagccaacaagaagctggcggacgtgcgcgagcaggtgtccaagatgatgaccgacgcgcagcgccgtgccgccgaaatcaccgacaccgccaaggcgaaggcccaggagatcaccgacgaggcggaggtgcaccgcaccaagaccatcagccaggtcaacgccgaagtggagcagatccgcgccgacatctccgcccagcaggaggaggccacgaagaaggtcaatgagctgctcaccgacctgaacgagcgtcgcgaggccgccaacaagcaggccagcgagttgatttcctccgcgcagaagacccgtgacgaggctgaggcgtacgcttccagcaagcgtgacgaggcggacgcgaacgcggcaagcatcctcaagcaggccaccgaagacgccgacgagcagatcaacgagcgtcgtgaggccgcgaagaaggaactggacggcgtgcagcagcgcatcgccgacctgcagagccgtgaggcccagatcacgcagcgcgtcagcgaactgcgtgccatgttctccaacgcgttctccggtttcggcatgaacgacctgtccgtggtcaacgccgtcgatgaaggcgagccttccgacgcgcaatctgatgacgacgcgcagcacgacgatgagaccgccgcaccggcagacgccgacacgcaggatgccgtcgagaacgattccgcagccgagaccgagccggaaggcgacgccgaatccgcagacgcttcgcagaacaactgaaaccatagaaagggaatggataatgaccgacatcacgccattgagcggtgatgaactgaacaagctcgtcgacgatttcgaagcaagcgagcacaatcgcatggccatgaacgccgtcacgacggccggcatcgacaaggtggcgcgcaactacgatcgcgcccgtctgatgcagcgtcgtttctccaccgtcgtggacaacggcaccgtcacccatcaggaccgttccggccgttgctggctgttcagctcgctgaacgtggcccgtttcgtggccaagcagaacatgggtctcaaggagttcgagttctcccagaactacgccatgtactacgacaagctcgaacgcgtcaactacttcctgaaggacgtggccaagctggtgcgtgccggcgagcctgccgattcgcgtctgatgcagcatctgctgtccgacgtgatgggcgacggcggccagtggaccatggccatgaacgtgtacaagaagtatggcgcggtgccgaaggacctgttcccggagactgaatcctccaggaacaccggtgagatgaacgtgcagctgcgccgcatgctgcacaccgcggttgcgcatatgtacgctgatccgtccgcgatcgatgcgatcatcgccgatgcggtcgccgccggtcaccgtattctgacgattcacttgggcgagccgccgaagagcttcgattgggagtggaccgacaaggacggcgagttccaccgcgatggcgagatcacgcctgtcgagttctggaagaaatatgtgggttccgccgatttggaaagctatgtctgcctggtggacgatccgcgtcaggagcacgtcaagggcaagaagatcggcatcgagcatctgggcaacgtggccgggggagacccgaccgagtacctcaacgtgccgaaccagttcatgaaggactgcgtgcgtcagattcttcaggaacagggcattccggtatggttcggcgctgattgccatccgatgatggaccgtgagaacggcgcgtgggccaccgacctgttcgagtatggccgcgtgtatggcgtcgatttcgatctggacaaggaacagcgtgtccgtttcggcgattccgcgatgaatcacgcgatggcgttcgtcggtgtggatgtggatgaggatggccacaccacccgccgttggcgtgtggagaactcgtggggagacaagattgccgacaagggctacttcaccatgagcgacgactggttcaccgaatacgtctacgaggtcgccgtccccaaggtcctccttcccgctgaatacctcaaggccctagaagaacccgccaccatgctccccgcgtgggatccgatgggagcgctggcctaaggccagcgctccctgagccgacgcgccgttaagcaaacagtcctgtggactgtttgtaggcgcggctgaggccgtcaggccgaaggcacggcgaaggtagtattgagtccacgcggagcgtggtccgtaattgcagggccgaaggcgcgttggctatgtagcgcgcgaagcgcgcgtagccaacacgcgccgagcgttaagcgagagcccagtgggctctcgtagcgaggagaaaacgccgacaggcgttttcatttagatttagcccgggtcaaccagcccgggtttttcttttgtctttcccacgtcacccccacccattccaccatgcagtcgcccatccccatattccgtccccatccgttaaggtaacgacggtggcgctatcgcgctacgcaagcataatgatgcaggggaggaacagaagcgatggcaggtcttcgcggtccggatagttcgaaggatgcacagctgttggatgagcgcgccgtgtttccggagaccgtggatgtcaatattcgtcagcttgacccgattcccgctccccgatattttctgaaggaacttccgctcacgaacgagatgagcgatctggtgttgaagtcccgtcaggagattcgtgacgtgctgcatggccgtgacgatcgtctgctggccatcgtcggcccgtgttcgattcatgatccgaaggctgcgcacgagtatgcggagaggcttgccgccgtcaagaaggagcttgatgatcgtctggtcatcgtcatgcgcgtgtatttcgagaagccgcgcaccacgatcggttggaagggtctgatcaacgatcctgatcttgacggccagttcaatattcgcaagggcatgttcatggctcgcaaggtgcttaccgacgtgctggggctcggcttgcccgccgctacggaatggcttgatccgattaccccgcagtatatttgcgatctgatcagctggggcgctatcggcgcgcgtaatacggaaagccaggtgcaccgcgagctggcgtccggcatgtccatgccgatcggtttcaagaacgctacggatggttccatcaagccggcggccgattcgtgtttcgcggccgctttcgagcatcatttcctctccatcaatctggatggtcgtgtgatttccgcggagaccaagggcaatcccgactgccatctggtgctgcgtggttcctcgcatggtccgaactacgatgccgcttccgtggcccaagcgttggcggatctcaaggcttccaaggcttccggaccaagcgagcatggtctgatcatcgatgccgcgcacggcaactgcggtaagaacgaggtgcgcgaggccgaagtggtcgaagaaatcgccgcacgcgtcgcggccggcgaacagggcattctcggcatcatgatggaaagcttcctcaaggcgggcaatcagaagcccgcgccgctcgaccagctggaatacggcaagtcgatcaccgacgcatgcgtgccgtgggatcgtaccgagcagctgctgcacacgcttgccgacgcggtcgacgcgcgtcgcaagcttggctgatgtttctgcgccatcgttgctatccttgggaaaggaagcgacaaggagagcgagatcatgcagcagcagctgaatacgcctgaggatttacgtgccattaggcaggccatggatgagggcaagaatccgctggtggagaccgacgtgccgcgctgggaggaccaggtgggcatcagccgcatcgtgaaccgccgcgtgctggaattcgaagtgttgcccacgccggcgcaggtgttgggcgacctgccgttgagcgagcaggcgcaggagatcgtcgcctattcgcgtgatgagattcgtgcctgcctgtacggtcaggacgatcgcctgctggtggttgtcggtccgtgttccgttcacgatccgaaggccgcgctcgattacgcgcgtcgcctgtccgcgttgaaaggcgagttggatggcgagctgctgatcgtcatgcgcgtgtatttcgagaagccgcgcaccacggtcggttggaagggtctgatcaacgatccggatatcgacggcagctgcaatatcaggaagggcttgctgttggcccgccgcacgctgcttggcgtgcttgacgagggtttggcggcggccacggagtttttggagccgaccagtccgcagtatatttccgacgcgattagctggggtgcgatcggcgcgcgcaatacggaaagccaggtgcaccggcagttggcgtccggcctgtccatgccgatcggcttcaagaacgccacggacggttccatcaaggctccggccgattcctgcttcgcttccgcacaacagcacacgttcttcggcatcgaccatcttggccgcgccgccgtggtcaaaacgcttggcaatcccgactgtcatgtggtgttgcgtggttcctcgcacggcccgaattacgatgccgcttcggtggccaaggccatggacaccatccgcgccgaaatgccggccgattccgctgcggcacatgggctgatcgtcgactgctcgcatggcaactccggcaaggacgagcatcgtcaggcgcaggtggtgcgtgacatcgcgggccgtatcgccaaaggcgagcagggcatcaccggcatcatgatggaaagcttcatcgaaggcggcaaccagaaggccgcgccgctcggccagctcgtctacggcaagtccatcaccgacaaatgtctgagctggaacaccacggaacagctgctacgcgagcttgcccatgcggtggccgtgcgccgctggaagtgaccgattcgattcactatccgcgcgattgcagaaaattcgggaaacgcgaatcgcaatcgcgtaaaacaacactcaagacagcacgtaagacagggagggtgcaatgaccgcaatcgccatcattggcgccatggatgaggaagtcgccaatatcgcaacggcactgagcaacgtcaccgtcaccgaggaagccggcgtcaaggtgacgcgcggcaccctcgaaaccaacaagggcaccgccgtcaacgttgccgcgaccgtcggcggcatgggcaccgtcaacatcgccgccaccacgcagcatctgatcgacgctgaccagccggacgccgtgatcttctccggcatcgcgggcaatctcaacacgaatctgcacatcaacgacgtggtgctcggcggcaccctgcgctatctcgacaccgacatgcgattggtgggacagttcaagcccggcaccgccgaccggcccatcgaggaataccatagcgacgaccgtctgctcgaactggccgaccaggcgctgaacgacttgaacattcaccatatcgtcggcatcatcgccaccggcaactatttcgtcgatgatccgcagaaggtcgagcaggtgatccgtgagaccggcgcggacgcggtggaaatggaaggcgccgccgtcgcgcatgtcgccgcccgcaacgacgttcccgcattggtgattcgcgcgttgagcgacaacgcggacaccgactacgaggatttcaaaacgttcgacatttccgaatacgcggacaccgccgcgaaactgacggtgaacatcgccaaacgcatgtagcgttcatgtggcgttgcgaaacgcctaacgttgcgaaaagccgtttccacatcccgtttgccgcatgacccgtcatcatgcatcgtcatatcggcaaacgggacgtctcatattccgatatgctgcgtttcggaagatgaacggcaggaaaacttccggtggcgtgagagaatcgcatacgcgaaagcctctccgaaaccgctagtcttaaggaagaactgaggattatcggaaggtgaacgcatgacgttggagcagatgctggcaacgccgtcggtggttgcggcattggtggtcgtggccgtggtcgtgttcgtcgtggcgttcctgcttggccgcagacgaggcttccaggatgtgcaggacagcgtcgaccccaatgatccgagcctgttcggagctgcgaagaacacgtccctgttcggcccccgcgttcccgtgcagtccacggaacgccagctggtggccgtcatgcccgaagctttggtggtcgtagactcgctggccacggtccaatacgcatccccggccgcgcggcgcttcggcatcatccacgaccaggcgatggcgctcgcggaaatccgcgacatcgtgaaactggtctccacagacagcgtggtgcgcgaacgcgaactgaccatccccctgcacggccgcacgcgaacgggcgtggtgaacacgaacggcaaaggcgtcgaagccggcaagccgctgcccgaagacacgctctacctgcacgtgcgcgtcggacagatcgccgacaacctatttgcgattttcatttccgacatgagcgagcaacgccgtttcgaaatcatgcggcgcgatttcgtcaccaacgtctcgcacgaactgaaaaccccggcaggcgcgatttctctgctcgccgaaacgatcggcgacgcggccgacgatccggacgcggtgaaatacttctccggccgaatctccaaggaatccgaacgattgacggaactggtccaccgtctgatcgacctgcagaaagcgcaaagcgcggcagcgatgctcaacgcggaacggctgtccgtgctgcccgtggcacgcgaggcgctcgccgaaaaccaggtcaaggccgaatcgaagcacatcagcctggtcctgtccgtgaacggccggcaggtgctggtgcatgcgaacgccgaggaactggccaaggaagccgaacagaacctggacgtgttcgtggtcgctgaccatgagaccatcaaaactgcggtgaagaacctggtggagaacgccatcaactattcgccggaacataccacggtggccgtcggcatcggcatcgaatccggcaaggtggcgattcgcgtcgtggaccagggcatcggcatccccgcggcgtcgctcagcagaattttcgagcgattctaccgcgtcgatccggcgcgctcccgtgaaaccggcggcaccggcctgggattggccatcaccaagcattgcgtcgaggattgcggcggcaccatctccgtatggtcgcgtgagggggagggatccaccttcaccatcacgatgccgcaggcttcgggcgctgcggaacccgaccatccggcggattcggcgaatgataacacccgtgaaaagaaacagtccggccactccaccacaacagagaatgaggagaaccactgatgacgcgaattctgatcgtcgaggacgaagagtcgtaccgtgagccgctggtctaccagctcacccgtgaagggtacgacgtgtccgccgcggccaccggtgaagaaggattggaactgttcaccaagggtggtatcgatctggtgctgctcgatctgatgctgcccggtcttgacggcaccgcgctgtgccgtcggatccgcgagcaaagccgtgtgccgatcatcatgctgaccgcgaaaagcgcggaaatcgacaaggtcgtcggccttgaaatcggtgcggacgactacatcaccaaaccgtattccttccgtgagctgctggcacgcatccgcgcggtgctgcgccgcaaccagatggtcgccgaatccggagaagccgccgacgacgatattccgctcgtatgcggtgacatttccatgagaatcggccagcatgaggtgacggtccgcggcgagaacgtgttcttcccgctgaaggaattcgaactgctggaatacctcatgcagaacaagggccgcgtgatgacccgccaccagctgatcgaccgcatctggggctccgactatgtcggcgacaccaagacgctggacgtgcatgtcaagcgcgtgcgcgccaaaatcgaggaggacccgggccatcccaagtatctgaccaccgtgcgcggcctcggatacaagatcgatacgccaagcgaatgatgatgaaaggcttggtatagcgcgcattcgcatcgtgcttgcaaagaacggtgaacggaaggaacgtcgaacggcgaaggtgtcgtagactgttcatcttccgttcaccgtttttggtttggggcgagtgaaacgcccaataggctggagattgtcatgaagaacgatggcgacaacagaaaatcgaaaaatcagaaacatacgccatctgaatgttgacagagggaaaagaataatgcgtaactccattctcgtacgctccatcgccgctgtgtccggcattgtgatgctggcttccgtcgcggcttgcggtgacaacatcaccgcttccaccgattcttcggccaagtccgataccaagaccgaaaccgtttccggcaacttctccggcgctggcgcttcttcccagcaggccgccgtcgaagcttggatcgccggcttccagggcaccaacccggacgccaaggtcgcttacaacccgtccggttccggcgctggcgtgtccaccttcctgaccggtgcaaccgcatgggccggctccgacgcctccctcgccgataacgaggtcgagcagtccaagagcgtgtgcgcttccggcaccgccttcgacatcccggtctacatttccccgatcgccgtcgtcttcaacctgcagggcgtgtccggcaagggcaagaccctgaacatggatgccgagaccatcgccaagatcttcgacggcaagatcaccaagtggaacgatgacgccatcaagaagcagaacccgaaggtcgatctgcctgacctcgacatcaccgtggtgcaccgttccgacaagtccggcaccaccaagaacttcctgagctacgtcaaggacgccgctggcgacgcatggagctacgacctcggcgagaactggccgaacgaggtcggccagggcgccaagggcacttccggcgtgatctccaccgtgcagcaggctgacggcaccatcggttacgccgatgcctcccaggccggcgatctgggcaccgtggccgtgaaggtcggcgacgattacgtcccgttctccgctgaagccgccgccaaggtcgtggacgcctccccgctcgacgattccgccaagggtgacaaccgcgtggtcgtcaagctcgaccacaacaccaccgagaagggcgcctacccgatcgtgctggtctcctacgacgtcgcctgcccggcatacaaggacgccaacaccgccaagttcgtcaagtcctggctcacctacgtgaccagcgacgaaggccagcagaccgccgcttccgcagccggctccgctccgatgtccaacaccctgcgtcagaaggtcgtcaagtccatcgacgccatcaaaaccaagtgagcccatcacagtggggcgatcgctttcggtgatcggtgactgaccgtaggtttcaggccgcagccgcgtaaaaaaacggctgcggcctgaaacgatacctacggacgatacgcaaaaccagaaaaatcgaaagcaatcgcaagcaaaccaaaaggagaacccgtgagttcgcaaagcaaaacggcacagcagccggtgagcggcaagaacgcggataaggtgttcaagggcgtggcctacgcctgcggcatcctgatcctcgtcgtgctcgccgcggtcgcgctgttcctgctgttccgcgcgtggccgttgatcggcggtgaccagaaggccaacagcgcgaccatcagcaacttcaccggcggcaaggcttccagcttctggggctacgtcggaccgctgctgttcggtaccgtgctgatttccgccctggcactgctgatttccttcttcgtgtcggtcggcatcgcactgttcatctcgcattacgcgccgaagaagctcgccaccgccctgagctatgtggtcgatctgctcgccgccatcccgtccgttatctacggtctgtggggcggtctggtgctggtgcccgccatctacccgttctggaattgggtggccaaataccttggctggattccgattttcgccggtcccgccgccaatccctcccgtaccgtggccaccgtgtccgtggtgctggccgtcatgatcctgccgatcatcacctccatgtcccgcgacatcttcctgcagacccctcgccttcaggaagaggcggctctggccctcggcgccacgaagtgggaaatggtcaagctcgcggtcctgccgttcggcaagtccggcgtcgtgtccgcctccatgctcggcctcggtcgtgcgctcggcgagacgatggccgtgctcatgatcctgtccccgggcctcaactactccgtcaagctgctgcaggcctcgcagaaccagaccatcgccgcgaacatcgccgcgcagtatccggaagccaacgatctgggtgtttccgtgctgatcggcaccggcctggtcctgttcctgattaccttcgtggtgaacttcatcgctcgtaagctcaccgagaaagcgagtgcgtgatgaccgccgcaaataacgacgcttcgccgatggacggcgctcccgtcatcgacttcgacaagttcaagccgacccgttccttcacctcagcgcgcaagcgcaaggacttcgccatgaaggcgctcatctcgtgcgcgttcatcgtggcgttgatcccgctgttctcggtgctgctcaccaccatcatcaacggcgtcaagaggctgaacctcaacttcctgagctacaacatgaccggcgtggtcggcggcaactcgaccccgtccggcggctacggcggcatcctgcacgccatcatcggcacgctggaaatcaccttcggcgccatgctcatctccatcccgatcggcctgatgtgcgccgtgtacctggtggaatattccaaccgtggcaagctggcacaggtcatcaccctgctggtcgacgtgatgagcggcatcccgtccatcgtcgcaggcctgttcgccttctcgatgttcacgattctgatcggccccggcaccatcaacggtttcgaaggctccgtcgcactttccctgctgatgctgccgaccgtggtcaagtcgtccgaggaaatgctcaagatcgtgccgcacgatttgcgcgaggcctcgtacgccctgggcgtcacgaagcagcgcacgatcacgaagatcgtgctgcgcaccgccctgccgggcatcgtttcgggtgcgattctcgccgtcgcccgcgtgatcggtgaaaccgctccgttgctgatgaccgcaggctacatcgcctccacgaacgtcaacctcttctccggccagatgaccacgcttccggtgtacgtctaccaggagtattccaagctcaacgcgaactgcccggccaacgcttccgcggcctgcgtcaccaccatcccgatggaacgcgcctgggccgcagcccttgtgctgattctcatcgtgctgatcctcaacctcatcggccgtctcgtggcgaagatcttcgccgtcaagtcggaacgctgagcgcggtcgaatagtcgaaaacataagaacaataaggaaaacaaatgggacaacgtattgatgtcaaccatctgaacatcttctacggcgacttcctggccgtggaagacgtgaacatcaacatcgaagccaacaaggtcaccgcgttcatcggaccttccggctgtggcaagtccaccgtgctgcgcaccctcgatcgcatgcacgagatcattccgggcgcccactgcgaaggcgaggtgctgctggaaggcaagaacctgtacgacaaggatgtggatccggtcgccgtccgtcgtgacgtcggcatggtgttccagcgtccgaacccgttcccgaccatgtccattcgcgagaacgtgctggccggtgtgaagctcaacaaccgcaagatctccaagtccgacgcggatgatctggtcgagtgggccctgcgtggcgccaacctgtggaacgaggtcaaggatcgtctggacaatccgggcatcggcctgtccggcggccagcagcagcgtctgtgcatcgcacgcgccgtggccgtgcacccgcaggtgctgctcatggacgaaccgtgctccgccctcgacccgatctccaccctggccgtggaggatctgatcaacgagctgaagaacgagtacaccatcgtgatcgtgacgcacaacatgcagcaggccgcccgtatcgccgactacaccgccttcttcaacctgaaggccgtcggccagccgggtcacctcgagtacttcaccgacaccaccacgatgttcaacaacccgcagaacgaagaagccgaacgttacgtctccggacgttttggctgatcgataaggccgattcgccaaaacgtagtgccaacccggtgggttggtgcgagtcagcttcagctggccagttaatagcgcttcgctgtgcgaaactctgtaattgtacgttttggctgatcggcagctccttttccccgcaaaccgacgttgagattgctctcggcgtcggtttgttgtttttcttgtggaagcgacacgcgctgttgagaatcattctcagttacggttatgatggattcaccgaagcatgaagcgtatgaaaatggaggaaccatcgtgaaccgttatgcaagaattgcgattgccgtactcgcttccgtcggccttctcacttccgcgtctgcctgcggaacgtcgcagaacggtgccggttccgcgcatggcgcgatttccgtcgtctcctccatcaaccaatggggcaccctcgccgagcagctcggcggaagcggcgtgcaggtgaccagcatcatcaactccaccaacgtggacgcgcacgactatgagccgaccacgtccgacatcgccaaactgcagaaggcacgaatcgtcatcgtcaacggcgccgggtacgactcatgggccgtcaaagccgcgcaatccgccaaatcgcaagtcatcaacgcggcggagatcggtggcgtcaaggatggcggcaacccgcacgtctggttctcggcggcggtgcgcaaagcggtcgcacaggccatcaccagggcatacgagggcacaaggcccgacggcaaggccgatttcgacaagctgaaccagcaatggcgttccaaggaagacgaggtcgcccgaaaaatcacggagaccaaacgcaaggcggatggcgaagcctatgccgccacggaatcggtcgccgaatatttggccggggacctgggcctcaaagacgcgacgccgaccggctacatgcgtgccacggccaacgaaagcgagccaacgccgaccgacatcaaacagttcaccgacatgctggaggccggcaaggtcggcctgctggtggtcaacattcaggaggagaccgagttgaccggcaagatcgtcaccgccgccaaatcgtccaatattccgatcgtggagctgaccgagcagatgccggagcagtacgattccctgacggactggatggccgcgctcgtcgacgcgttctcccaagccatctaatgcggatctgcgtcaaaccgatacgaaagtcgataaaaaaagggcgattccactgaaggaaccgcccattttccgtatgaaaaggactgttacagcactgcggtgatgatgaagtccagaatgaacagcacggccacgacccagatcaccggatgcacgtccttggcctgcttcttgcaggtcttgacgatgcagtaggtgatgaagccgccggcgatgccgtaggagatggagtagctgaacgccatgaacacggacgcgaagaacgccggaatggcttcggagatgtcgccccactcgatttccttcaaggaggaagccatcatgcagccgaccacgaccagcacgcctgcggtcgcggcggacggcacggcggagatgaccggggagaggaaggcggacagcgcgaagcagatcgccacgaccacggaggtcaggccggtgcggccgccggcggcgatacccgcggaggactccacgtaggtggtggtgttcgaggtgccgcagatggctccgatggaggtggcgatggagtcggcgaacagggccttgtccatcttggaggagaagccggaaccgttctcaagagccttctcgtcctcggcggagaagatgccggtacgacggccggtgccgatgaaggtgccgatggtgtcgaaggtgtcggacatggagaacgcgaagatggtcagcaggatgatcggcagcttcgacacgtcggagaacagcgccgggaagccatccttggtgaagatcacgccgaaggtctgcggcagctgggcgaaggtgtcggcgatggacacggagttggccatggtggtctggcccatcggaatgccgacgaccgcggtgacggcgatggcgatcagcatgccgccgcgtaccttgagcacggtgagcacgatggccagcaccaggccgatgatgaacagccagatggtcggattgttcatgacggcaaggcccggggtggcctgcacggtgtcgccgctcttggccgcggacttggtggtgaaggtgaagaaaccgacgttgaggaagccgacgtaggccacgaacaggccgatgccgccgccgatggcgttctgcagcacttccggaatggcctggatgatcatcttacgaatcttggtgacggtgatgatgatgttgatcaaaccgcacaggaacaccatgcacagggtttcctgccacttgaagccgaggccgaagcacacggtgtaggtgaagaacgcgttgaggcccatgccggcggcctgcgcatacggaacgttggcgaacaggcccatcacgagcgtgccgatgatggccgcgatgatggtggcgaggaacacgccgccccacggcataccggtcgaagacaggatctgcgggttgacgatgatgatgtaggacatggcgaagaacgtggtcaggccggccatgatctccgtggagacggtggtgccgttctccttgagatggaagaatttctccattttctcttttctcatctttcttgggttggtaggcgcgtgccatatggtggcgtgcgccggcgagaatcgcgactcgcctgggacatgcgtccctgaacaaagcaaacgtagcacctatgtaagtcatggaaatttcgtgcgattggtaaggggttgcttttgcggcggcgcgacacgccggtctggattagtccaaacgggtcagtaaattacccacttgtaaaccacagaccgttggttggagcgtgcaagcgctcacgaagtttggttcgccaagccagcgcaggttgaagaacatacgcccaccaagggctttccgcttagcggtcgaatgttgctctgcctgcgtgcagggctttttttattgccctgcgaggtgttccgaatctcacagtcaacggttgactaaggaaggaacgccatgaagaggcccgaaaaggaagcggtggtcgctcagcttacggacaagttccgtaacgccgacgctatctacctgaccgagtaccgcgggcttaccgttccgcagatctctgaactgcgcgaaaagctaggccgcgatacttcctacactgtggcaaagaacacgctcgttcgcattgcagccaaggaagctggcatcgaaggtcttgatgaacttctcgccggcccgaccgctgtgaccttcgtgaagggtgacttcatcgaagctgcgaagaccctgcgtgacttcgccaagaccaacaaggcactgatcatcaagggcggcttcgctgatggcaccgtctacgatgctgaaggcgccaagaagctggcagacctcaagtctcgcccgcagctgctcgccgagttcgccggcgacatcaaggctacgatgtccaaggccgcgtacctgttcaacgctctgccgaccaaggccgtgcgtacgatcgatgcgctgcgcgagaagcaggaaaaggctgcctgatttcgctgcggctcgccgcatgaatgaagcaaccacaaaaaagaaaaacaattgttttaggtgacggccacctcttcaattcagtccgtcgccaagaatgaaaggaagccattatggctaagtacaccaacgatgagctgctcgaagctttcggtgagatgactctggttgagctctccgagttcgtcaaggccttcgaagagaagttcgacgtcgaggctgctgccccggtcgccgctgttgccgccgctccggctgctggcgctgctgctgaggaagagaaggacgagttcgacgtcatcctctccgccgttggcgacaagaagatccaggtcatcaaggccgtccgcgctatcaccaacctgggcctggctgaggccaaggctctcgtcgacggcgctccgaaggctgtcctggagaaggccaagaaggaagacgccgagaaggccaagtcccagctcgaagaagccggcgccaccgtcgagctcaagtgattcgcgcggcttcaagccgcaatcaccaagctgtaatggaaaccccgtttgccgtaaggcagcggggttttccgcatatggagcatgactcaggcatgttctaaaatgggggaattaggcgaaagttgtcaatttatcggttcggaatccttactttcgcgatgaatcatgacacaatggcagatagtgtagtgcgaaaggaaggccgacaacggtgagcgaggatcgacgaatgacgcggcagtggaccgtcaaagttgacggaaacaacgtgaaaacgcttcatgacggcgaaagcgtggaaatcgggcgcaaaccgttgcgcccgctgtcggatgacgggttcgctcgtctcgacatcatggatccgggcaagtccatgtcgaaaagacatgcggtcctctccgtcgacaagcagggcaattgctccgtacgagatctgcattccaccaacggctcgttcgtggtgacgaacaacggccaactgatgcgcctgcccgcaggcgaggacatcaagctgcccatcgactcgatgaccctgcagttcggcgacgtgcgtcttacgctcgaatccgcattcgaacacgatgacgaggatgacgacgccacctccggtgtctcggatgatacaagccagccggtttcgaacctgttcgaatacgcggtctccgacgaggctccgcaggaaccggatgcagccgacatgtccgtggacgacatcctcaatctgcgtgccggcgagccgacgacgttcttccacgcgcgcaatgtcaccgaccgtgccgatgctctgcaccaggcggaacgtcagaccttcacgccggagcatgccgacaagccggaactcgaagatgcattcccctcggtctccttggttcaggaaaccgtcgtggccgcggacaagccccgcgacctgttcgccgacgccgcagcgcaggccgaggctgaagctgagatcgaggccgatgcggccgattccgctgatgcggctgcgaccgatgccgaggtggctgccgtctcaaccgagacagccgctcagcccttggaagcatcccatgacggtaacaagaacaacctgattccggtggacaagctgttcagcgcgcgccccagcacgccaatcgccgtcgctctgcccgacaggaacgacactggcgataacacaggcaacgttgacaaggctgacaatgcggctgacgcgtccgcccaggaacagacgcagtccgccgaacaatcgcagatggcggaacagcccacatcggaaacggccgaacagcagcccgccgaacagcagtcgaagccgatgcacgctacgcagccgcagacggaacagccgggaacggtgaccgcggaagacgacgacgagcggttccgcccgcaaaacagccaatcgcagcccgcgccggacgaaaccgccgcattcaagccgatcttcgaaccgggatcggtattcgaccgtgtgtccaaaggcggcctcgccaagcaggagcagaccatcgaggtcgacggcctgacctccgatgacgccaaacgcacggatgatttcacagtgcagttccagatggcgcgtcatccggaactgttgccgttcctcgccatgaacccatccctatacgatgacctgtacgcgtggttgggcgcattgggcaaccaagacatcgatgcggctttggcacacaatccgggatatgaggaataccgcaaggcagtagggaagtgagtcggtatatgagcgaaaacgaagagacggccaccgcgttggaccgtatccgcggatggcgtgaggagtatcgccttggtctggcaccatccccgcttgaggatgtgacgcaactgagcgcccagcttgacctgacgcatgcgcacccatcgggcatcgcgcagctgttcgccaaaggacacgtcaccttggactcgttgttccgagacaacggcatgctgcgcgccgcgggcaggcgtgtggaacgcgtgctcgacgaccgtgacgcgaaaagccgtgtcagcggcgtcggcgaactctccttggtggtcggcgtggccatttggaaaggcaaccagatgccggtgctcatgtatccggtcgaagtgcgcaaggaaggccgcaacatcgagaacggcaccgtcatcgcgttcaccggacgagtgcgtctgaacgcggccttcgccgccgtgatgcgtgaaaacaacgtgacattggacgagaccaagctcttcgatggttcgaattacgaaagcggcacccccgaaacgtccgcggtgttcgcggccatcacagcgcgcgcgtccagcgttttccccgatttcgaaatcgaacgtcacatcatcctcggctgcttcatggacccgtcctcgcagatgctggtggaaagtcgccagatcatcaaccagctgtcccaaggcccgacaggcaacaccgttctggacgcgctcgccgggaacaaggaagccgcggacgcgctgaaagacgcgcagattcccgaatacagtccgttcgacgccgatccccatggcgaatacgagattggcgacgttgacaacaccgtccgatacgcggcgcagctggccgcatccgggcattcgattttcgtggacagcgcgatcagcggcaacacggccgaacaggccgcggcaatcgcctcccgttgcgtgatgggcggacacagcgtgctgtacgtgccgtgcgtcaccgaccaaaagcgccgtttcatgcagacgatcgcggccaacgagatgagcggccaattgctggacatcgccgatgacggcgccaatgcggcaatcgaccgtcagctgatagccgcagtcggtttccaatccggcgtcgcgacttcgcgtttcgaccagatctccgacgaactggtgggcgtacgctcccgcctggcccgctatctgggcgacctgcatggcgtcagccaggaatggggcgtgtccgcataccagaccatccagaacctcgcacaaatcgccgtcctgcccacgcatccgaccacgcatgtgcgtctgaccaagcagtccgcccattccatcgcggacaagatggaggaatgggcccagaagctgtatcgcgcgggagaactcggcgaatacaccatcggcgcgcaggacaccgcctggtacaaagcctccctgtattccgaagaggaagcgatcagcgcataccagcgtgtggtcgagctgctgcgcaaggtgctgcccgccacccgcaaacaggtgtccagcaccgtgcagacctgcggcttcccgattcccaccaccgcgcaggagtggggacgccaggtcatggtgctcaagaacctgcgccgcgtgctcgacgtcttccagccggaaatcttcgaacgcgacatcgattccatgatcgaggccaccaagcccaaggcccagcgcaaggccgaaggcagctccatgggattctgggaacgtcgccgccatatcaaggaggccaagtcgatgctgcgcgtcggcgcgcaggtggagaacctgcatgagacgctgctcgtggtggccaagcaggccgaacagtggcacatgttcgttcctcacggcggatggccggtgctgcccgccaaactcgacgacatcatcaacacgcaggaccagctgacgaacgatatgaccgcgttgaacgtggcgctcgccaccacaccgcagggcggcaatctggacaccgtcgacctcaaccaggtggaagagcgtctgaaggccctgtatgacgacaagcaggcgttggatacgctgccggaacgcgcccgtctggaacgtgagttccattcggccggtctggatgagcttgtggcggacctgagcaaccgcggcgtgccgaacgacgccgtggccggagaactgcagctggcgtggtggaccacggctttcgaagacatcgtgaagtcctccgccatcatttccaaccaggatggctccgccatgcaaagcgccgccgaccgattcacccaggtggatgtcgaacacgtgcgttccatcggaccgatggtcgcccaagagtccgtacgccgtctgtgcgacatgcttttctcccgcacgcaggaagccaatctgctgcataccacgcttgccggttcccgaaacgtgccgttgaacaggctgcgcagggagcatccgcagattttggccgcggcaaagcctattctggtggcaacgccagccacgctcgctgccatcaccgacccggcgccgcttgccgataccgtcatcatcgatacggccgcgcatattccgtccatcgagctgctcagcatcatcgcccgcgcgaagcaggtcgtggtgatcgcgcaccgcaagaccgtcacatccgatggcctgcagcgactgatcgcactgctgccaagcgtgaagataaccgacaggccggttcgccgtgcgccgaagctcaacgccttcctcgaatcggaaggatacggctccgtgccgtgcgatgtggcgcgtgaaggataccaaggcgaagtcgcgtaccatttcgtgccggacgccaacggtgtgccggtcatcaattccggcctggtcgaatcaagccagcaggagatcgacgaagtggtgagcatcatccgcaagcgcgcggccggtttcaccatcgttcccgcatcgtatgtgcttaccgtggtagcgctcacgcacacgttccgcatccgtctgggtgccgagctcaagtcgcttgccaacaaagacaaggccatgggcatgttcctgcgccacgtgcgcatcgtggacatcgtcgatgtggccggcgcccacgccaccgacgcgattcttgcgatgtgctacgccaagacctcgcacggcaggctgctgcagcagttcggcgcgctggaatccgacggcggccgaggcatgctgctggacgctttggcggtaccggaccgtcatctcgacatcgtctcgtccttcgcatccgacgatatggacgacgagcgactgcatcaggatggtccgaaggcgctcaaaaccgtgctgcgttgggccgaacagcttgatgacagcatggtccgcccggcgatcaaggagtccggagagaacgtgctcttcaacgatctcgccgagaggatccgcgaacgcggcttggacgtggccgtcgattacggtttcgatgacggactcaaactgccgttggtggttggtctgaaaggcgagccgttcgctttggccgtgctcaccgatgacgcgcagttcatgggactgcaatccaccagggaacgccatcgcgtgctgctgcaggacatcgaatcgcttggctggtcggtgatgacggtatggagcgtcggcgcgttcgtgaaccccgataaggaagtcgaccgcatcgtggcacgactgggaagcctgtaccgggaggaacggtgagcgccgagcatatcgaaaacgtcatggagcatgacgattcgcagacccagtccgagacgcactccacacccagttattccgccacgcggcggaccgcacgcaagcataagcgcgtggtccgccaaggtacggaactgttcgatgccgatggcgtcaaactcgaaccttcggacgtgctcaccaagcgccaacgcgaggcggatgacgacaagcgcatcctaaacgagcttccgccacattgggcggtcttctccgaacgcggccgctgatacgtccagccgggtgccagctatcgattaggattatcagccattaattgatggtggcgatgaccgcactgtattcctgaacccgcaacacgacggccgcctcattgggcggcatggcgaacaccgcgatggtattgccttgcgcatccttagccggtttgccggtcagcagcgcttcggcgcagatcgtgtgtaactgcgcatccacaccaccgtccggcatatcattagccatgccggacggcgtttccgtaccgttcggcatatccgcgacattcggtgtgccggactgcatctcagcatctgtcatggtggcgctggaaagtgtcaccttgtctccgggaatcaaaccgccggccacacttgccaaacgcacttcgatactcgtatggccctgcggcacaacgggggacgcacgggccatgcccgacataagcacatcgtgcgcgccgatgcccacctgtgcgatcaagccgacggcgtcgtcaagcgtatggaaggcgttgctcagcgagccatcgctcggcgcctcacgtaactccacgtcttcgcgtgtgatggccgtgcctttggcgacattccgcaccgcgaccacaataggctgcgtggcgatggctgcgcgtacgcattgcagcgtggcgaataccgtcaggccagcgcacaatgcggcgaggaaccgatgcaggcgtgcgttgcttcgtctggcttccaacgatgcggcagtcgaaccatgacggtctcgttgcagacgcgtcgtgcgcgcggtccgtccttccgaagccgtcgatgtgcgcaaactcgaatgtggccggcggtccatcaaggaatgaaaaaaggtcatcatgcatgcatgatgacctgattgttatgaccacggcaagcggaatccggggttgtggtcggagaatgggagttatccacaatctccggcgtgtcgcgttggattccgcgcctgtgggtcacttggatttgtcggtgcggtagaagccggaccccttgaactcgatcggcaccgcggaataaaccttgcggacctgctcctcgccgcattccgggcatacggtaatcggatcgtcggtgaatgactgctgctcggtgaagtcgtagttgcagttcttgcaacggtaatggtaagtaggcacgatatcctcgctttacgcacaatcccaaatttcttaacgggacatatcctagtacgttccctgagacggccccgcaaccgtcctatcctcggacatcggcataaccatccggcgtgagcacgccgtcgacgggaatatcatgcggctcatgcggcacggtctcgtcggtcggctcccaaggccagcaaacggcgaccacgcgcgcggtgctgctacgatgctccaaagcgcggtcgtaccaaccgccgccgcgccccaatcggaaaccatgttcgtccacagcgaacgctggcacaatgatcagctcggccgaagtgagaacttccggtccttccgctgcgttttccggctcctgcgggcgatgtgtgttgatggaaccatcagcattgcgctggtcgcgcagatcgtcaagaccgttcagctcactccagccgacttccatgccagcacccagacgcggcaccaaaacacggcaatccgtgtcgaacatcgcttcgagcaacggcatcatcgatatttcactgcccatcgaggcgaaggccgcgacggtcgatcgcggtcgaatcaacgacgcttccaatgcgtgttcggcaagcagccgtcccgcttcgcgacgctggtcggcggacgtccgctttcgtcgttcgatcgcagccgcgcgccaatgccgtttcagctcgcgttgttgcttacacatgtccatatcgttcgttgtaccacggttcgattgcgtggaaaacggaacatggggtatgggtggggcacaatggaagggtgacgattttgcaatccttgagcgacatgatgcgtcgtccggggaataattcctttgaaatgccggaattcatccaatcgcacagcatgcgcgtcccggtgagtctgcgcccgttgacgggcgccgactatgacgagtggaacgaggttcgctggcgcaacgatgcctggctcaagccgtgggaatccggcgatccgctgcacggcgcgcccatcacctacaaggaatggatgaaacaactgcggcgcaacgaacgggccggtaccggtgccgtgttcgccatcgaacagcatggccgtatcgtcgggcagatctcgttgggcgcaatctgctacggcgcgatgcgttccggcgtggtcggctattgggtggacgagcgttgcgccgggcgtggctacgcgccgatggcggtggcgctgttggcggattgggccatgttcgacccggccggacctcgactgcatcgcatggaaatcgacattttgccggaaaacaagcggtcccgtgccgtcgcacgcaaggtcggagcaacgttggagggggtgcggcgcgcgtatatgtacgtcaacggccaatggcgcgatcatgaaagctacgtattgatggccgaggacgtgccaaacggtttcaccgcgcgtctgatgacagggaattcaccctcctgattcgacacgccggggaggactcgcctcgaatgtcggaatgtcacctattcttatgacatatgggttatgaatcgttaagcacggtggtcgtgcttgcgatcgttgtcatcctgatgctcatttggttgcccagacggacgattaaaggcatgaagagggtgatcgaacatcgcgaggaccgcttttcaccgtcgttgcatctggtggatgccgacagcggaacgcgattttccgatgagaccgtcgcggcagcgaaaggggtactgatgcagtccacagaggcgcacaaaggcgcaacatccgaagaacggatcgcggaaattcgcgcccttcgtcacgccgcggtccgcaggaggcgcgccatcgccgtctcattgctgacaatcacggtcgttgtgctggtctgtgcgttcgcactgcacttcagcccgctgttcgcgctcattccggccgcgttgctggccgcggtgctcgcgttgggtgtgcgtgcgtccaagcaggccgtggcgtgggagcggaaggtcgccagataccatgccaaggtgaagaagcgtgtcgccgccgaacgcaaacgtgcgcaggcggagcaggcggaacgtgccagactgcgcgcgcaggagctggccgaagcccgcaaggtcgtcgacgagcagttgaagaccgatgtcgttcccgagggggagattcgccaggcgatcgcccgcggcaaggccgatcgggacgccgcggtgaaacggcgcaaggaagagatgtcttccaaggaagagacgcagactgccgagaaggccgtcgaccagacaaccgaacgtgcggatgccgcgcccgctgacgtcaaggaagtgggactgtccatccacgatgagcgagacaatatggccgaagaagccaaaaccgttgccgtcaagtccacgcaggacttgatttccttctcgttgggtgcgcctcgcgacggtgccgacgttgaggtggatgctccggaaagcatggagatcaagtccaccaaacaagtggccaaggccgtgcccgtcgaaacgccttccgacgaggctgagccgttgattccgccaaacgacgcaatgggcagcatggatgccgatgaggccgccgcccgcgtggatgagggcgtgcacctcagagaggtcgacgttccgggattccacgatgccgaagtacgtgccgatgtggaggctccggatgtgacttcggactccctaggcaccggcctggaggccattctggcccgtcgtagcgcctgacgaaacgcttgaaccgttttttacaaagcctggaaccgcatggtttcaggcttttttgataatttctctcagagcgttagcactcgagttggcagagtgctaataatcgcgctaggataagtcacagcgcgaaaggacgacgccgtaagtgatcgtcagcctcttgctagcgggtcccggcgcggtaagtatcgatttctctttagaaagaggaggtccacagtgtcgatctcactcacaccgttggaagacaagatcatcgtcaagcaggcggaagccgagacccagaccgcttccggtctgttcattccggacaatgccaaggagaagccgcagcagggtgaagtcctggctgtcggcccgggccgtcgtaacgacgccggcgagcgtatcccggtcgacgtcaaggtcggcgacaaggtgctgtactccaagtacggcggcaccgaggtgcactaccagggcgaggattaccttatcgtctccgctcgtgacatcctggccatcctcggctgagactagcgcgtagctgtcgaaaccccgtttcccgtatattgcgatttgcaaggctcgggaggcggggtttctgcgttgttcggcgccgatttgcgcaaaacgttggaatttcaacgatttgcgccgtttttggctgtcgcgacacgccgtatttgcataagtcggccggtctgtggcatactaaacgggttgccggttggggttcaaccaaacaggcagcacggcggatttcccaagcggtcaaagggaactgactgtaaatcagtcgcctcgtgcttcagtggttcgaatccactatccgccacgcctcgatagctcagtggtagagcacttccttggtaaggaagaggtcgtgagtccgattctcactcgaggctctcatggcgggatagctcagctggctagagcgtacgactcataatcgtaaggtcaagagttcgagtctctttctcgctacaaaggccgacggaatgtcggtatagcaacgaaccacaagaggtgaactaaatggcaagcaagagcgccgacattcgtccgggcatcacgctggcatgcaccgagtgcaaggagcgtaactacatcacgacgaagaaccgccgtaacacgccggatcgtcttgagctcaagaagttctgctcccgctgcggcaagcagaccgtgcatcgcgagacccgctgagcggaatcaagctttcgaaacccgaccaatttggtcgggttttttgttactctggagcgttatgactagttttgcagatctcaccaccatcggtgtgggcggtcctatcgccactttcctggaaccgaccacgcgcgtcggcgtcatcgaagctgttgaggaagccgattcccaaggactgccattgtgcgtgatcggcggcggatccaacatgctcgtatccgacacgccgttcgaaggcgtggtggtccgcgatgcgagacgctccatcggcgtgttggatgaggcggctccggtcgaggatgatgggcgtgtcgtccacgtgaacgccgaagccggctgcaactgggatgatttcgtcgattactgcgtccgacttggactggaaggcgtcgaaggcttgtccggcattcctggcaccgtcggcgcgtcggtcgtgcagaacatcggcgcgtacggtcaggaggtcgccaccagcgtcgacagcgtcgaggtttgggatcgtaaggaacgtgcggtaaaggcgttgcgcaacgatcagctcgccttcggctaccgcatgagcgcgctgaaagccagcatgtacagcgctccggcgactccggccgcggaatttttcccgacgccgcgatacgtggtgctgtccgtcacgttcgcgttgcggcacagcgatacgggcgtggtcggttacggtcagctcgccaaggcgttggacgtcgccgtgggcgatcgcatgaacaccgcggacatccgcaacgcggtgctgaaggtgcgtgcggctaaaggcatgctggaagacgcgcatcgctatgcgtcgccggccatgcagggcaccaagaagacgaatctggtcgatgtcgctcttgaatcgcaatccaagcagaacggcgatgacggtccggacttcaaccgccatagctgcggcagcttcttcatgaacccgattctcacgccacagcaggccgagacgcttcccgaagacgcgccgcgcttcgacgcggcattgccgggcggcgggcagggcgtcaagacctccgcggcctggctcatcgaccatgccggcttccataaggggttcaaaatcaacgaaaacgctccggctggcctgtccacgctgcatacgttggcgttgaccaatcgtgggggagcatcagccgaagatatcgcccgcctcgccaaaaccgtgcaggacggcgtcgaggccgcgttcggcatccgactggtgcccgagccggtcgtcatcggtatgaatcttaaatagcgtcacgcacgccgtcaatgtgacgaaaacgacttatacttgcgccttgtgctctagaaggtggagcgtgaaaccgcgcgggcggaaagaagagaaggacgagacatgaacgtatttcgcaagaaatccgtcgaacagacgctggctgaaacaggtgagtccggccatgcgctcaaacgcgatctgacctggtgggatcttgccatcatgggtgtggccgttgccgtgggcgcaggcatcttctccatcggcgcgcaggcggctgccttccatgccggtccggcggtggtgctgagcttcctgatcgcaggcgtcgtgtgcggcgccgccgtgatgtgctacgccgaattcgcctccatgattccagtggcgggttccgcctacaccttcacctacaccaccgtcggcgagatcgtggcatgggtgattggctgggatctgatccttgaaatgctcatggccggttcggtcgtctccaaatactggggcgtgtacctcaaccagttcttcgagctgatcggctggaacatcaacaccaacatcgccatcggctcgttcaacttcgacctggctccggtcatcatcgtcgccttcttcaccgcgctgctggtgatgggcaccaagatcggcgcccgcgtggacggcgcgctcaccattttgaagatcgccatcgtcgtgttcatcgtggtcgtcggcttcttctacatcaaggccgaaaacttcaccccgttcattccgccgagcgaacccgcagcatccaccgacggctccggcgtctccgcggtcatggaacagccgctgtggcagtgggccacaggcatggcccccagcatttatggcgtgaccggcatcatctccggcgcggcactcgtgttcttcgctttcctcggcttcgacgtcgtgtccaccgcttccgaagagaccatcaaccccaagaagaacgtgccgctgggcatcggcgtgggcctcggcctgatcatcgtgctgtacaccctcgtggccatcgtcaccacgggcatggtctcctataaggaccttgccaaacagtccgatccgtcactggccgtcgcgttcaagatggtcggcgccgactgggctgcgaagatcatcagcctcggcatcgtcatcggcatggccaccgtggtcatggtgctgctgctcggcctgacacgcgtggtgttcgccatgagccgagacggactgctgccgcgtggcctgagccataccggcaagcatggcactccggtgcgtctgcaaatcatcgtcggcgtggtcatggcgctgatcgcggcctgctgcaatgtcggcatcctgtccgacatggtgaacatcggcacgctgtcggcgttcacgctggtggcgatttccattccgatcatgcgcaagaagcgccccgacctggaacgttccttcaagattcctggcaatccgtgggtgccgattctgattgcgctcgccaacctgtggctgatggtcaacctgagcgtgctcacttggatccgtttcgtggtctggctcatcgtcggcttcgccatctacttcggctatggctaccgtcatgcccgtctcggtgccggcgaactcgaagttgccgcgcaagagtaatctggaacagtacacgttgttgttgaggaggtaagcatgccgtatgttgttgcccagccgtgtgtggacgtcaaagacaaggcctgtgtggacgagtgcccggtcgattgcatctacgaaggctcccgttccctgtacatcaatccgaacgaatgcgtggattgcggcgcatgcgagccggtgtgcccgaccgaagccatcttctatgaagacgatctgccagacgagtgggcttggtacaaggacgccgcagtcagcttcttcgccgaagttggtgatatgggcggcgcttccgcagccggcccgatcggcaaggatccggagcaggtagctgctctgccgccgcagaaccagtgagcatgtcttggctgatgcgtccgccgtccgtattgcgcgtaaagcggaatattcgcggtcgattttaaccggtttgccgctgacgtttgcacacgtcagcggcaaaccggtttttgtatggaacggttgcatgtgccggcacgtcgattgccgtatgctggaacatggttgtgatttccgcttgaaaaggagccttacggatgggttttcatgaattttcatcgccgtacgactggtcccgcatcgcgtcgtacaaacgtacggcgaaagccgcgttcggtggcatggtcgacctgtccgtcggttctcccgtcgaccccgttcccgattcggtgcgtaaggcgctcgcggtctcgtcgaacgacccgaacgcgtacggatatcccgttacggcaggtaccgccgatttgcgtgacgccattcacgagtggttcgcggccgcccgcaatgtcgatttgcgtgcgatcggcgccgatgcggtgccgacggtcggttccaaggaaggcgtcgcgttgatggcgtcgctgctgcatttcggcgagggcgatgtcgtcgtgcagccgaaggtgtcgtatccgacgtacgagatcggcacgcagttggccggcgcgcaaacgctgaaggtcgacgacgtggcggatgcggattcctggaaggatgtgccgggcgtcaaggccgtttgggtcaattcgccgtgcaatccgaccggtgaggtgctgtccgcggaacagatggccggtattgtgcgtgccgcgcgcgcgattggtgccgtggtgctgtccgatgaatgctatgcgttgatgcaatgggaagacgacgttgcggaagcggatgcggatacgcttgcctccacgccgtgcgccttgcgcgccgatgtgtgtggcgggtccgccgaaggcgtattggtgctgtattcgctgagtaagcaaagcaacatggccgggtatcgtacggcgcttatcgctggcgatcaatcgctgatcgggccgatggcggcataccgcaaacagatcgggcagatcattcccggaccggtgcaggctgcgatggccgccgggctgcgtgacttcgacgcggtcaagacccagcattcccgttaccaggagcgtctgggcatgctggtgagtgctctgcgcgcatacggatactgcaccgacatgccgcaaggcgcgttgtacgtgtgggtgaaagccaagtccggcgactgctgggaggatctgcgccagcttgccgaaatcggcatcgtcgccagccccggcgagttctacggagcgccggaatacttgcgattctcggctacggccagtgatgcggcgatcgcctccgccgcggaacgattggcacgttgacggtttgctgacgatggccttttgacgaacgaaagcgttgaaaacaaaaaggacctccgattcactcggaggtccttcattatggcggagtcagagggagtccaacgcccatgcgtcttatggctatgtgcagctgttgatgtcgctgatccaggagtggcgtgcgctactcaagcgtccggaactaccattcatattcgcccaattgccgaactatactttggaacccgattgcgattggccaaggctgcgtgatgaacaacggcgcgctttgacgttgtggaacacggcgatggtggtgacgatcggatatggagaggataatgacctgcatcctttggataagcgccatgtcgcgcagcgcttggcaacggctgccgagtcgttggtttatggacgtgatcgcgagccgatggggccgcttcctgtcatggcgattcacaaggatgacggcattgagatctccttcatccatacgggagggggattggtctgcacaggcgacgtgccttttgacatcttggagccgggaggctcgatatatcgggtgaaggctcgtcggtacgattgctatggcggtaacggaaccgggcgttcgagtggcgcagtgagagagctctccccagtacagtgtcagtttgtcggccaatgaagcatcgatgataacgctattgccggggacagcgtaaatagtttttgcagttaatcgtgtttgggcggaagcctgtaatttcctgcgtttggaatacttaaatctattcgaaagtttcgtaaatagttgcatatagaactttcgtaacaaaaaatttaagcatttagttaagcgatttgactttcttgaaagtcaaatcatataatcaaacagtgctttggctgaaatgctaaagcatttacgaaacatgaagatgtgtgttcgtgcatgtcgctaagggagaaagactttgtattcccacatccgatattggataaggagatgcagcaatgaagtttgaataccatgtcaaaccaaccggcaacgatgctgcgtgcggcgacacggagcatccgttcgccacgatttccaaggccgcgcagatggcctctccgggtgatacggtaatcgtgcatgaaggcgtataccgcgaacaagtcaatccgagacgcggcggtctgagtgaacatgagcgcatcacctactgcggagccgaaggcgaagcacggccggttatcaaaggctcggaatgcgtgcagggctggacggaattggccgatcatccgcatgtgtggacggtggtgcttgataatacgatgttcggggatttcaatccattcgcgaccccgattttcggtgactggctggaaatgcccaagttcggcaaggatccggacaaacatcttggcgatgtgtatctcaacggtgtttccttcttcgaatcgacgacgttggaaggcgtatacgatccgcagccgcgtgatacggatgaggatttcgcgttgaagattccctgccccgtgccggatgtggaccgtacacgttatgtatggcatgccgaagtggacgaaaatgccggcaccacaacgatctgggcgaatttccaaggtgccgatccgaatgaggaactggtggaggtcagtgttcgtcgcacatgcttcttcccttcccgcaaccatgtcaactacatcaccgtgcgtggctttgaaatggcgcaggccactggagattgggcgccgcctacctcgcagcagtggggcatgatcggcccgaactggtcgtatggctggatcatcgaagacaacgtgctgcatgacgccaaattctccgcggtgtcattgggcaaggaaatctcatccggcgacaacgagtgggcgaaaaccgagcgcaagaccggttaccagtaccagttggaggccgtgttcaaggcccgtcgcatcggctgggaaaaggggctgatcggcggtcatatcgtacgcaacaacgacatctacgagtgcggacagaatgccatcgtcggacatatgggcagcgcattctgccgtatcgagcataaccatgtccatcacattgcgttgaagcgtgaattcttcggatgggaggtcgctggcatcaaattccatgccgcattggatacggtcattgccaacaacaacatccacgactgctcgctgggcatgtggatggattggcagacgcagggcacgcgcatcacgcgcaatgtgttccacgataacgtccgtgacctcatgattgaagtgagtcatgggccgtatctggtggacaataacgtttttgcctcgccggtgatgttccagaactggtcgcaaggtggtgccttcgtcaacaatctgatttgcggcggcattgaaccgcataccgtccccgaccgttccacgccgtatcactatccgcacaccaccgaggtggccgggtgcgctgtggtatccggcggcgatgagcgttggctgaacaacatgttcgcgccgcaaccggtgaaaccgaccgtcggtgaatatggtttgtccgcctacagcgattgcccgatgtcgatgcatgaatacttggaacgccagcgggccatgtgggcagatccttcgcagggtggtggcgagcgcaatcctctgcagtctctatacgcgggcggcaacatctatctgtccggcgcacaggggctgaacaagcaggaaggtgcggccgacgattcggagcgcatgcaggaggacgccccgttcttcggcggcaccgcctccacgagcgttgcatgtgatgagcccatgccggtgacattggtcgaagaacccgatggactgtacctgcagtgcactgtgccacaggccgtcaccgataccagaatgcaggtcgtcaccagcgatatgctcggcgtgcctcgcatcgtggaggaacgctatgaacagcccgatggcagtgactatgtgctggacaccgacttgctgggacaagccttgacggcaacggaacgcaaggccggggcgttgaatggtcttgtctccggagagaatcacatccgaatttgggaatggaacaactgatatgacaaatgcaaccgataccaacaagacattgggcgagtccatgttcgcacagtgcggatatgcccaggacgccatcgataagcgcgtgtcacaggtctggcatgaaattttcgaaggtccgaacaaattctattgggagaacgacgaaggtcttgcctatgtgatggacaccggcaacaacgatgtacgtaccgagggtatgagctatgcgatgatgatcgccttgcaatacgaccgtaaggacgtattcgacaagctgtggggctgggtaatgcgtcacatgtacatgaaggacggtcatcatgcgcattatttcgcatggtcggtcgcgccggacggtacgccgaactcgaatggtcctgcacctgacggcgaggaatatttcgcgatggacctgttcctcgcctcccgtcgctggggtgatggcgaggatatctacgaatattccgcatggggacgcgagatcttgagatattgcgttcataagggcgaacgctacgacggcgagcccatgtggaatcccgacaacaagctcatcaagttcattccggaaaccgagtggagcgatccgtcctaccatctgccgcacttctatgaagtattcgccgaagaggccgacgaagaagaccgtccattttggcatgaggcagccgccgcaagccgtcgctatctgcaggcggcctgcgacgagcggaccggcatgaacgctgaatacgcggattatgacggaaagccgcatgtcgacgagtccaatcattggcatttctattccgacgcctaccgtactgcggcgaatatcggactggatgcagcctggaacggtccgcaggaagtgctgtgcgaccgcgtcgccgcgctgcagcgattcttcctgacccacgaccgtactagcgtctacgccatcgacggcaccgccgtggacgaggtcgtgcttcatccggtcggattcctggccgcgaccgcgcaaggcgcacttgcggcggtgcattcggcccagcccgacgcggagcataatgcccgtgaatgggtgcgcatgctgtggaatacgccgatgcgaaccggcacgcgtcgttactatgacaacttcctctatgctttcgccatgctggcgttgagcggaaagtatcggtatgaatgatgattacctcaactaatcctatggtctacacggattttcctgatccagacatcatccgggtcggggacgtgtattacatggccactacgactatgcatttcacacccgggtgcgatattctgcgcagctatgacctagtgcattgggaattcattgcgcacgcattgaatatcgtggcggatacccctgaagaacgtttggaatgtgaaggtgccaacgcctacggtcgaggcatgtgggcgccgtcactgcgttaccatcggggcacctggtatgtgttgttcgccgccaacgatacgcataccagctatctgctgacggcggacgatccatgcggcccatggcgaaagcgtgagcttgacggcttctattacgacagcggactgttctttgacgacgatgatcgagcctatgtcgtacatgggcagtcgacattgcgcatcacggagttgaatcctgaattaagcgggccgatgccgggtgggctcgaccgggtcatcgtgcaggacgatccgcaggctgaccttggttatgagggcagtcacctgtacaagcatgatggacgctattacgtcttcacctgtcacttcccgcaaggcaagggcaaaacagaagcctgcttgatggccgaatccttggatggagctttcgaagtgcgtgaaattatcgaagacgacctgtccttccacggttacggagtcgcgcaaggcggtatggtggacactccggacggcgactggtatgcattcatgatgcaggaccgcggcggtgtgggacgcgtgccgatactgatgccgatgcggttcggcgaggacggattccccgtcgtcggcgagaacggcaaagtgccgcagtcggtcagcgtgccggctgcaagctgtgccgaacctgtcacgcccatcaacggcagcgaattcatagcccggtataacgccgaaggcggagtcgatgccaactgtctgcagccatactggcagttcaatcacatctcacataacgaatactggtcactgacggaacgtccgggagcattccgcctgcattccggacgcatcagctcgaatctcaatcatgcatggaacacgctgacgcagcgcacgatggggccggtgacggtggccgaagtcaccgtcgacgcgtcgacattgcatgatggcgacttcgccggattggcggcgttccaaggatgctattcctacatcgcgcttacgcgaaggaacggccgcacgatgctgaccgtccaatacaagccggcgaatgacgattccatcttctccgataatgattgggacagtccagccgtaacggatgcggaaatcatggcggatgcggattgcatgcgtctgcgcgcggtatatgatttcaccgattgcaaggatgaagtgacgttcttctaccgcgatgcggatacgccggaatccgaatggtgtccattggggacagcgcaccggatgatcttcaaaatggatcatttcacaggttgccgtatcggattgttcctgtattcgacaaaagagaccggtggaatcgccgatttttacgactttgcgtattcgacgccgaatacgaaggaaagagagcaatgaagcgacaggtcatagtggcgcaaggaactgtcgaaggcttggcggctgaggatcagggcatcaccgtgttccgaggagtcccgttcgcccagcctcccgtcggcggtctgcgctggcgtgcgccgcagccggccttgccatgggatggtgtgctgcaagccttcgatttcgggcctaccgcgatgcagccgacgccgggcgcctccgatgatttctatgatcgtgaatggggcaccgatccggccgtgccgatgagcgaggattgcctctacctgaatatttggactccggcattacgcggatatggcgcggatagcatggtaacttccgaaaagctgccggtcatggtctggatctacggcggagcctatcaatgtggcggcacatttgaaaaggaattcgacggcacgcatctcgccgcgaacggcgtcgttgtggtcagtgtggcctatcgcctgaatgcatttgggtttatgacgcaccctttgcttcatgaggaggccgtagaacgcggcgacggcgaaccatatgcgaatttcggattcctggatcagcgtgccggaatccaatgggtgaaggaaaacatcgcgaagttcggcggagatccggaaaacatcacggttttcggccaatcggccggtgccgccagcgtcttggcccagatctgctcgccgatgaatcatggcctgtttcagaaagccatcatgcaatccggcgcaggcttagggtatttcaatgcgcggcaggacacgctggagcatgcgcaggccaacggaatccgtctgttcgaagcattgggtgtctccacgctggagcaggcccgtgcaatcccggcccgaacggtattggaagccgccgagtccctgcctgttccaccggacagcggacgtgaagatgactggtcgatgatcgtcaattgggtgccatgcgtggacggcctgttccttcccgatcaggaggagcgtatcgtcgagggctgcaaggccaacaacgtcgacatgctggtcggcaacacgaccaatgagttcatcgcttcgactgaagatgggaagcctgtgcatgtcggccagctcggcaatctcacgctgattcgcaaatggaccgcaagcggtgggaccgcgccatactactatcatttcgatgtcgccatgctgggggatgatgccggagccttccactcgtccgatctgtggttctcctttggaagccttgcgaaatgctggcgtccgttcgttggatggcattacgatctggcaaggcgaatggggctgtactggaccaatttcgccgccaatggcgatcccaacggaacggaccgtgacggaacgccgcttcctgtatgggatccttgcatcggtgaggaatgccccgccatgcatttgtgccaagaaccgggcatgcggacggattggcttaccgaaacggatcgaaaagcattcggcctgtgacggcatgccgttgatgtataaatgctgatatgtaaacagggacggtctttgtggatcgtccctgtcgcataatggtttgccgttgcacgtgcaggaggatttcgagactgattatccgacttttcaccgtttccgtcgtctggttcgtcggtggcatctcgcggaggctcgggccattaaagaccctgttcggcgttgtgcaggctaggagctgtttgaagtgttctaggccggacgtttcgccgtataggggcgtgtctgcgtggattccgtcggatgtggcgtctcaattgttggacgttgcggtgagcgtgaacgggggtgattatgaggaagactgaacccccgctcatgaccattgccgacacgatggcctatttgcagtgcagtcgtcggctgtcttgttgggtacccaactcgggtaccttgctgggtaccggaaatgttggcattggcgtacatttccgtacattctctgtttgcgccgtatgtcttgaaatcgttggtattccgccgttttggcatgaaaaaaagggcttccggatttctccgaaaaccctcaaggcggagtcagagggattcgaaccctcgagccgctaaacacgactaacaccttagcagggtgcccctatcggccactcaggcatgactccactgttgcgttacgacgcaacagcatgtaactatagcatctatccgcgtgcgaaacaccatattgtgaaaaaatgagagaaaaacgtgtggtgatgtcagtgggactcgaactcgtgagccgtgtcgagcggtctcattgatatgcgacacgccggtatgcccgcaggtttcgccatattcgaacatttgttccaaaactgccgaatcgttgtctatcatggaatcatgagcacggcaccaagaatcgcagcggccaaacgtgactggggtcacgatgaggtcggatgcacggtgctgcatatcgacatggacgcttttttcgcatccctcgaagtggcgcggcatccggaatacgccgacaaaccggtaatcatcggcatcggcaaccgttccgtggtgtccgcggcgaactatgaggcacgcaaatacggcatcaattcggcgatggcaagctcccgggcaagaaaactatgcccgaacggcgtctttctgccggtggacatccactactaccgtgagatgtcccgacgtatcttcacagaggtgttctcccgcgtcaccgatcgcatcgaacaggtttccgtggatgaatgctatatggacgtctccggcgcgctgctgcggtggaaaagtccccgcgccatcggagcttggatacgcgatcaggtcgccagacggtaccacatcacctgttccgtcggcatcgcggcgaacaagcttgtcgccaaaatggcttcgaccaatgccaaaccggatggcatgctcatgatccccgtggccagacatgccgaattcgtgcagatgatgccgttgcgtggcatacctggcatcggtccgtccttggagaaacgactgaacgcatggggcgttgattccgtggctgacttggcgaagatgagcatggaatcgcttgagcaggcgacggggtcagccatcagcgcgcgcgggttgtacatggcggcacgcggattggatgaccgccctgtcgcaccgcgtgcgcaggggaaatccgtcggcgcggaacgcacgttcgacaaggacacccaagacatgcggcaggtgacatccatgctccgctggtgttgcgatgatgtggccggcacgctgcgcagacgagggttgatggcgcgtaaggtcatggtgaagctgcgattcccggatttgagctatgcgacgaaaggacatacgctggactgtccgacggatgcggcaagcatgctgtatccgcaatgtgtcgcattattgctggccatgatgggcatgccggaaagctctatcgacgccatttccttgaccagaccggtgcgacttgccggcatgagcgcgggcggtttggtcgaagcggcggatgcggcggttcagctttcgcttgatgacatgcttgaagagcagaacgaggcgcagcggggtcgtggaacggataccgaaccgtcgacccaatcggaacggctacgcggtgcggaagcggcattagacgcggtacggctcaaatacggtaaaggaagcgtgcgtcttggcatatggcgtacggggccatcaggtaatcttgaacattgagagtgatgtggagcatgagaagaaacagggggagtgccatgagatacagggacaaggcggtgcatgcccgcaacccggaagtgctggttgcagggcgtcgcaggctggccatcgtcgcagccgtcgtgcttgttgtattgctggcggtaggtgggtggttcctgacgcggtgcttgcattcatcacagtcccaagccgggcagggggccgcaacgcagatggacgtggccaagcagaaaaagcatgtggtgaaaaaggccgagccgaaggaacatcacggcaattcgccggactgtccggataccgattgcatcgccatgatggtcaatggcgatctgctgttccaccctggtctgtgggacaacttcgccggtcccaataccgcggcgacggacggtacggcctatgacttcaccagtctgttcgaaccgatgcgcaagtacatcgatgcctccgatatcgcggtgtgcgaattcgaaacgccgattgcgcctcgcggtggcccctacaccgggtatccggtgttcaacattccctcggaggtcgccgacgcggccgccaaggtggggtatcgcgcatgcacgcatgcgtcgaaccattcgtgggatcaaggcgcggatggcatcacacgcctgtgggataccctcgaccaggacggcatcgcacagacgggctcctacaagaccgaggaagactctaccaaaccgctggtcatcgattccccgaccggtggcggcaaactgggcctgatcgccggtaccgtgtccctgaacgcgcaaacccccgattatgattggcgcgtcgaccgtctgcgcgagagcggcgatccgaaccatcaggccgacatcgacaaagccgtggccaaagccaaagaggcccgtaaacaaggcgccgacgtggcggccatcgccatgcattccgtgcaggaatatcttgactacgccgactcgtggcagcagtccgaagcgcatgagctggccgacaccggtgcattcgacgtcatctacggtgccggatgccactgcgcgcagcccgttgagaactacaacggcacatggatcatctacggtctgggcaacgcggtgacggtcacgtcctacattccaggcaacgaggtcaacaaccaaggcgtgacggcccgcgtccaattcgccggcaagaaaggcgtggccggctcatggcgggtcaatcgcatcgattgggtgccgacggccaatgtgcgtcaaggccaataccagtggtgtccgatttcggacgaccatccggatggagcctgttggaacgaaacagaagatgccaatcagagacaacgtatctggaacgtgatctattccatgggcgcggaccagaacgtggttcgagagtggaacatcaccgcagaacaagctggttcatctggaaagtagtttcccgtggcagaatatgcctcgtattcgttaatcgacctgtatggagcgtttccgctcgtgatgtgaggtaaagatatggatggagttttcgagacccagccggaccgtgccgacttgccgctggtggtcatgccggtggtcatcgaatcgatgatcggaccgttcaaacagaacttcacgatgctcgaaaacgtggcccgcgtgcgcatgtacgaggatttcacactggacgaggacaccatcgtggaacgctgcaaggatgccgacgccgtcatggtcatcggattccactgcgccgatgccatcctcgacaggctcgacgccaagtgctatgcgttcggaggcaccggcgtcgccagctacatcaatcttgagaaaaccaaggaacgcggcatccgcgtctgcaacgtgctgcattacggcgatcacgccgtcgccgagcacgccatggcgttgctcatggaactgaccaggcacgccggagcgcttgatatgcaggtcaagcaaggcgattgggacggtgccgacggtttcgaactgttcggcaagaagctcggcatcatcggactcggcggcatcgggcagaccgtggccggcatcgccaacgctttcggcatgaaagtatccgcgtggaactcccacgtgccggcacaggtgttcgagaacctgaatgtcactccggtggaagacatgaacgagttgatctcgaattcagacgtggtcagcgtgcatatgccgttgcttgactccacccgtggcatcatcacggcgaagaacctcgacgcgttgcgtccgggaaccctgttcgtcaacaccgcccgcgccgaagtcatcgaacccggcgcactgctcgcaagacttcaacgcggagacattccggcggccttggacgtgttcgatcatgagccgcttgccgccgacgatcctttgtgcaagattcccggcatcgtgctcaccccgcacatcgcatggcgcaccgacggcgcgtatatcggcatgaccaagcaggtggtccaatccatcgccgccttcttcaaggggaggaattcaacgtcgtcgtctgaaaaaataaccgggaagcagcatatgcgcgcggtcggtgaggttaggtaggttgaacagcatgcagaccatactcgattccgccgatcggccggcgcacgacgccttcgtcgaaaagaaatcggaattcatcggagacgcctgtcatatcagctcgttggatgaggcgctcgctttcgttcagacgatccgtgaccagcatccgaaagcccggcatgtcgcctatgccgcggtgtgtggtggatccgatggacgtcttgcggaacgcatgagcgatgatggcgagccgtccggaaccgccggcaagcccattctcgacgtgctgcgggcaaacgaaatgactgattgcgtggtcgcggtcacacggtatttcggcggtatcctgcttggttccggcggcctgattcgtgcgtattccacaggtgcgtcaattgcggtcaaggctgcttccaaggcgaaaatcgtaccgtgcggcgaatatcaggtaactcttgattatccgcagttgggcagcttccagaatctgttgtcaacggtggaaggcgagcagaccgacgcgcagtacactgaccgcatcgccttgactgtggtggttccgcaggaacaggcgaatgtcttcgaatcccgagttgtggaaactttcaacgccacggtcgttccgcaactggtgggcacgtccaaccgtccggtcaaagtatgagttcacgttgtgagccgcatgcatatagtgtcgtaaggtgaaaatatgagtgatgagaacgagcagcatgagaatgattcgcaggccgacgcctcgaacgccgatgagaccgtggatttcgagccgttgaccgccacatacgagcggctccggcattccactgattccgccgcattaagcgagttcgccagacgtccgctgccggaccggagcgaccaggcggcgttctcccgtgccaccgcattgcttgaggctgtggccggcaacgcgcatacgccggtggaggaccgcgtcttccttgccgaaaccatgccgttcccgaacattctggtcaagctttccaccgacgagtctcctgaagtacgcaaagccgttgcgggaaacgccgatgacaagaactggctggtgggccgactgaccaaggatgagtcgcccgaagtgcgtgccaccgcgctgcgcaacaaacgtacgtcttggaaaatgcgtcttgaaggcgccgaagattccaccatggattccgacacgcttgatttcctgggctcgttgggaacgcaggtcgaaccggacgctccggtggtgcttgcgaccatggtgcgcagggccgtcgccttgaatccgaatgtttccgatcggatgctccagcagttggcgcaggacgcttcaagcgacgtgcagaaggccgctcaacggcagcttgcggaaaaataattgcatacgttgtcatttttatgagattcctgcgcgtggtgcgcatgttttggtcctagactgggaaccatgacagaacagaccgaaaacgcaacgcgtctcgcccgtccgctcattcgtctggcaaagctggtgggtgtcgccaccagctacgtcggtatgagccatgattaccacgaaatcgaagacgatgttctggtggcggtgctcaaggcgcttggtattgacgcttccaacgatgaggcgatcaaccagtccatcacatccatcaagtccgaacgcgaaacgcgcgtggtggctcccaccgtgctgcatatcgtgggcaaggaaagcaaggtggaggtgcacggcggcatgttcgatgtgccggaagcctccatcacgctggaaaacggcaagcaattcacgggcaaaatctcccatgagggcggtgagaaaatcgcccatgagattgatagcagcttcttcttcacgtcgtatctcgtcctgcccgccgatctgcccgaaggctatcacaccctcgaggtcactgtcggcaacgaggcggagactgcaaccgttatcagcgctcctgagaaaatcgaactgctcgatgatatgaagaacggctccctgtgggggtggatgagccagctgtactccatccgttccaagggatcctggggcgtgggagacttcgaagatctgaagaccatgctggtcgaggccaaaaagaagaccggctccgacttcatgcttatcaacccgatgcacgccgcggagccggtgcctccgctgacgccatcgccgtatctgccgatttcccgccgtttcatcaatttcagctacatccgtccggagtccatgccggaatatctcacgctgtcccacgaggacagggctgaagtcgatgcgctgcacgagcaggtcgaatcgctgaatgacgacgcgcggctgatcgatcgcgacgccatgtggcgcgtcaagaagcatgcgctgtgggtcatctacaaggccggccgaaccaaggctcgccaggccgaattcgaccgttacctcgccgaatgcggagacgagatcgaatcctacgccacctggtgcctgtgctacgacaagtggggagctccctccgacgacgccgataattgggtgcgcaaatacaaccgtgattccgaagaagtcgcgcagttgcgtgagaagttcccggacacccttgagttctaccgctggcttgagtgggtcgccaccgatcagttgcacgcggcgcagcaggccgcccgcaaggccggtatgaagatcggcatcgtcgcggatatggccgtcggcgtgcatccggcaggatccgatgtgtggtggaatccggaacgcttcgccaagggcgccacggtcggtgccccgccggacatgttcaaccagcagggccaggattggagccagccgccgcttaacccgatcgccctcgaacagaccggattcaaggtgtaccgggatatggtgcatgacatgttcgccaatgccggtgcggtgcgtatcgatcatatccttggtctgttccgcctatggtggattccggaaggcaagcccgccactgatggcacatatgtgcattacgattccgatgtcatgctcggcattctcgcgcttgaggcttcccgcgctggtggcgtggttgtcggcgaggatctgggtgtcgtgccggcctatgtgtccaagtcgctgtccgaacatggcattctcggttgtgccgtggaatggttcgaacagatggacggtgtgttccgcactccgaaggattggcgtccgtacgcactggcgtccgtcaatacgcatgacatgcctccggcggccggttacctcgaatatggccacgtcaagttgcgtgagcagctcggcctgctgtccggtccggtggaggaattccagaagtccgcaaccgccgagcacaatgccatgctgaacatgctggtcgaggagggctatctcgacaaggctgctctggatgacgaagccgccaacgaaaacgagattgtcgacgcgctgtaccgtggtctgaaaggttcgccctgcaagctcatggccgcctccatcgtcgacgcggtcggtgagaagcgcacgcagaaccagccgggcaccaataacgagtatccgaattggcgtattccgctggccgatggcgaaggcaacgtggtgccgctcgaaaagctcttcgacgaaccgcgtctgcaagagatcaccgccatcatgcgtggctgatcttctataggcgattccatggggtgtccacaggtccgacggtctgcggacacccttgtttttcgtgttgccgaatgtcaaggcaggcgatatactagtagactgttgtgtttccctacggggtccttcaaagcgcttttcccactcgccatcgaggactttcagggagcccacggataatgagacctgaaaaacggcattattccgcgcccaaccaacgcgtgtaatgctgatggatggtccggaacacaatatatagaaaaggtacatcgtgaaaactttcactccgaagccagctgatctgactcacgactggtacgtcatcgacgccaccgacgtggtgctcggtcgtctcgccactcaggcggcaaccctgctgcgtggcaagaacaagccgacctacgctccgcacgccgattccggcaaccacgtgatcatcctcaacgccgacaagatcgctctgaccggcaacaagttgggcaaggaactgtacatgcactccggtcgtccgggtggcctgcgtcgcgatagctacgcccagctgctcaagaccaaccccgagcgcatcatcaagtctgccatcaagggcatgctgccgaagaaccgtctggccaaggttcagctggatcgtctccacatcgttcgcggtgccgagcatccgtacgctggcatgaagccgcaggttttcgagatcgctcaggtctcgcagcaggctaagtgaaccgaagggagataagaaacatggctgaaaacaccaacgactccgcggttctcgagaccgaagaggagctcacctcgtacaccaccgagaccaacgctggcgctggcaccggtacttccaccatcgctccgggctacggcaccggtcgtcgtaaggaagccgtcgcccgtgttcgcctggttccgggcaccggcaagtggaccatcaatggtcgcaccctggaagagtacttcccggccaagctgctgcagcgtgaggtcaactccccgatcgttctgctcaagctcgaaggcaagttcgacgctatcgtcctcgttgacggtggcggcaccaccggccaggctggcgcaatccgcctgggcgttgcccgcgctctgaacgctatcgatcgtgatgcgaaccgcgccgccctgaagaaggctggcttcctgacccgcgacgcccgcgtcgtggaacgcaagaaggctggtctgcacaaggcacgtcgcgctccgcagttctcgaagcgctaaagcttacagcaagctttattcgaaacccctcggaaattcgttttccgaggggtttcttggtattcgaacgattcaggcagagcttgatggaatcaggcggtcggcatctgcctcatcgcactgatgctcaacgccgggagcgtccacaatgtcggatcgtcttccgacaatccatcgtcggcagattgcagatttgcttcattgtcttgcatctgccagtacatcatattgatgcggtgcagatgattgcgcagtctacctgccggcttgttttccgactctgcgtcgaattctgatacccgttcgatggacgttcccaaaccgggatattcgccgacgatctctgatgaagaccagaccatctcccattcaatgcctttcggaagatggaaacgtgtgacttcgtcggaaccgttgatcagaattagcaggctaggctcgtcgggggagagcagctgcatggcgaacgagcgtacggcaggattcgtccaatccgaatcgtccggcatctgcccgttcggaagataccaatgcacgcgatcggatttcttcagcaaaccgattttgctcaggcgcgtgaagaaatcctcatgactgtacaaatcgtgggatttccgcaacgtgattaaacgtgacgttagattgaattgcttcaattccggcgtttgctcggtgctgtatagccaatcccaatcaagccatgtaatgtcattgtcttgcgtgtaggcgttgttgttgccgttttgcgaattgccgaattcgtcgccggcgagcagcattggcgtacccaacgacagtaagagcgtgcccagcaggttcatggtggcacgctggcgctgctgcacgatgatttggtcgctgctggggccctcatgcccgaaattgatggaatggttgtcgtttgttccgtcgtggttgttttcgccgttagcttcgttgtgtttgctcttgtacatggtcaggtcggcggtggtgaagccgtcgtggcaggccacatagttcacggaggcggtcgaaccgcggccggggtcggtggcgaacaggtcggaagatccgcataggcgtgtggccatgtcttgcatggtcatttcgccgtattcgccgctgcgtgtgcgatccacgtcggtcagccagaatttgcgcgtgcaatcgcggaaacggtcgttccattccgcgaaaggaatgccgaattcgccggtgcgccagccgttcgggccgcaatcccatggttccatgatcattttgagattgccgagcagtatgtcggagcgcaaagcgtacaggaatggatggtagcgggtgaattcaccgtcgagacgtgccagcgtcgccgcaagatcgaatcggaatccgtcgataccaatgcgtttggcccaatagcgcaacgaatccacggcgaacgtggtgacgtgcgtgttggtgaaatcaagcgtgttgccgcaaccggtggtgtcgtacaggcggctgatcttgtctttggtgcgtcggtagtacgagagattgtcaaggcctcgccagcaaatggtcgggccttcgggacctgattcgcaggtgtggttgtaaaccacatccataatcacttcaaagccggcctcgtgcaatgcgcgcaccatgttgatgacttcttgccgtactgcggccgctcctgcctcttgcgagcgtttggtggcatatgaggattcgggggcgaaatatccgagcgtggagtatccccagtagttggtgcgtcctcgttcctgcaggaagagttccgattgtttggcttggatcggcagcagttcgatggaggtgacgcccagatcctgcaggtatgagagcgtggccgggtgtgcgaggcccgcgtaggtgccgcgaagttctttgggcagccatggcgcgttggcggtgaagcctttgacatgcagctcgtagataaccgttttgctccacggaacgtgtggatgcgagggttctcctgcgtgtttgtcgatggcgcggtcgtctatggctacggaaacgggcatgcgccctaccgagtcgatggtgctcatcggtccgaagggggagcccttgaccttgccgttgacgatttcgcattcgtaggcgaatgcgcctggatcgagtttcatcgatccttcgatgcctttggcgtatgggtcaagcagcagcttgtaggggttgaaactcacgccatgatcgggatcctatgggccgttgacgcggtatccgtattgcatgccgtcccatgcttgcggcacgtgcacgtaccacagtccgtagttgggaccgtccatgcggaacagtgtttcgcgaagattgagcgagggaatgcgtctggtgcagatgcgctgttttttggcctgatcgatgaacgtgagtccgggttcgttgaacagccgtgcggcgtcggcatagaaggcgctcggttggtcaagtggttcaagtacgcaaaaccacacttggtctgctgtttctgagcggacaacggcgtccgcgccaccatcgtcggtgaaatagagacctgggcgggttgcgtagcggtgcaaaggtgggttcttcataacctcattctaaacactttgaaattatctgttgacttgctatgtcgggaccatctctgccaatgtcagatcgatggttgctgcgctgccggtgagatgccgttctggctgttttcgatgatgatgtgcatgttgtgatgatgattttttaaaaaacaaaacgttgattttctgcggcacacgctttgcaaacaactttatgaaaagagatttgcaaaagaatttaagaaagtgtatagttttcaatcatcaggcagaacgatctgccggaacttcttttatagtggaaaggacatatcatgaaagctcttgtactgaccggtgtcaaggaatttgaaatccagaacatgccaacaccgcagatcgaacccaatgaagtgctgatcaacaccgcatatgcaggcgtgtgcggcacggatcatgacctgtatgacggtcgccccggatcggccgctgcggtgccgccgatcgtgcttggccacgagaattctggcatcgttgctgcagtcggcgctgacgtcaccaatgtcaatccgggagaccgtgtcgccgtcgacccgaacatctactgcggccagtgcgaattctgcctgacgcaacgtcctgaactctgcgaccatcttagtgcggtcggagtgacccgcaacggcggtctggcggaacaattcaccgcccccgcaagtgtggtctataagctaccagataacgtttccctgcgtgacgccgctgccgtcgagccggtctcatgcgcggtgcatggtctcgatctgctggaacttcgcccgtatcagaaggcgttggttatcggcgacggtttcatggggcaggtcttcgcccagcttctgcaggcgtatggcgtgcatcaggtggatcttgccggcattttcgatgaaaagttgcagcgcaacaaggagcagttcggcgtcaccgaaacgtacaacaccacccgcgaacagattccggaagattcctacgatgtaatcatcgaagccgtcggtcttcctgcgacccaagctcaggccgtagccgccgccaagaagggcgcgcaggtgctgatgttcggcgtcggcccgcaggaggcgcatttcgaaatgaatacgtacgacatttacaagaagcagctgaccatccaaggctccttcatcaacccgctcaccttccgcgatgccatctcgctggtctcctccggcaaaatgaacatcggaggcctgatcagccacgagcttgaactcgagcaggtgcaagacttcctcgacggcaagatcactggcgtttccaaggctgtcgtcaagattggtgcctgacatgatccgcgtgcttgagcgtttgggtgttccgcgaacgctgatgctggggttccttgccgtcgtcattttcatgaccggcgatggcttcgagcttaccttcctctccaaattcatggtggattaaggattcagctcctcccaagcgtcgctgctaatcacggtgtatggcttgttcgcggcgtttggcggctggtccgcaggcgtgcttgcttttgtgctgacgttgtttattcgtcccgaacagcttggaattagcgaaaaagtatcacgacatgacggcaaatgcacagccgacatcgccgcatagcgcatatcctaatcacaaaaggggaaaatcaatcgtattcatcgttatcaggaggtaattttatggcgaaagcaatgtctgaattcactaccgatctgcagcattccggcatgccggcgaaggatctcgacgaaaccatcgaattctatacgaagaagcttggtttcgaactggccggactgtttcataacggcgaaaatcgttgtgcattcctgcgttacggccatctgaccatcgaaacgtgggagggcgatccggctccgctgaccactggtgccatcaaccattgggcattcgacactcccgacatcgaagctgcattcgaaaacgcgaaggaactcgggctgaatttcaaagataacgaaatccagcatatcgacagcttctgggagcatggcatccgctacttcaacgtatacggaccgaacggcgaaaccattgaattctgtcagattgtcaaataactatcgttagatgattgccgtcaaataatcgttgaaaacaaatacaacaggcgaaacagacggaagcaaacaaagaagcgtgcgctgaaccttatatacgggttcggaacacgcttctttttgttatgcaatcgatgcgattaatatgtgcgcaaaagcggtcacatatcgcatagttcgcgtacgtacggctccacaaaacgcagggccgcgccgataatgtcttgatggtcgagcgccattcccttgcgcagggtgaaatccgtggtgccgaatggcgtatgttccaccacgcgttcgcgtagtccggccatatcgtcatcatcgagatattgtgctgcctcaccgctgatgatcacgtcaccggccagtaccgagcgaatattcgttaccgccagcgccacataatccagccattgcgagaatcgtttgcgatgctcctgctcgccttgttccaacaccgagaagaagccgggcaggctttcgccgtcttccatcagcgtttccggcgagcaatacgtatccatgcagccctgttgtccgcagtagcaggtgttgcctcctggaatcagcgtcatatgttcgattgagccattgcattggtttggcccttggtaaagcgatccgtctacgatgaccgcgcctccggggcgtcgctcgaggtagatgcagacggcatccttcagattgtggtcgaaccagagttccgccatggcagaagcgtcggaatcgtgaatcatcagcgacggatagttgaggccgtggctgagttcgctgagtttcaggccggtgttgttcatgattttgccgaaggtgatcgactgcccgtctgccgatacgatgccttgcatgcagaaggccacgcctagcaccgtgctgccttgtttcgccagttcctgcgcgaaaccgttgatgatgtcgttcatgcgctggtagtaggcgtcgttgttgcgataggggagtgtgcgctgtctggtggccacggatttgccgttcagatcaatggcgatggccgtgattcgtgtggtttggattcgcacgccgatagccacgctggagtgtgccgcgaattcgtagatttgcgctttgcgtccaccggtggatttctgcatctcgcctttgacgatgagcccgtcggcctccatggcgcgcagattctgcgtgatggttggcaggctgagccctaattcgtgttcgaacatctgcttggtggctgaaccttgggtgtagatgaacgtggtcatggccttgaaattggcttctttgactgatagggcggattgggctttcactggttgatccttcctgcgcaacttcttttccaagactacttcataaaagtcctttccttatgtctcgtgttggtctgagatatcaggtattgcaaaaaagtatcaaaaacagctgtgcataaaggattttctgccacttttctgcgtcgaaaatatatttatcaacaaaaaaagttgagacggtgacaacgacgttctaccaagaaaagagacatgttatgaagataggtctgccgcgcacgctattggccggcttggtcgccatagcggtgttcatgaccggcgatggctttgaattgacttttttgtccaaatacatcgtggaccagggattcagctcttcgcaatcgtcgctgatgttcaccatgtacgggctggtggctgcgcttgccggctgggcgtccggtgtgctagctgaaatgttcggtgccaaacgcatcatgcttatcggcgcgagcgcctgggtcgttttgcacctgctgttcgttggtgtggcgttgccgagcggcgtctatccgctgatgttaggcgtgtatgcgttgcggggtgttggctacccgctgttcatctactcgttcgtggtgttgatggcgcaaaccatcgatcctgccaagctcgcgtcggccatggggtggttttgggccgcctactcgttcggcatcggcgtgtttggcgcatatttgccgagtttcaccattccgatggtgggcgagtactattcgctgtggctttcgttgccgttttctatagctggactgctgatttgcctgctgatggtgccgaaaagcaagggttctggcaactcttccatgagcaatgcagacaagctgcgcgagcttagtcgaggagtcaccattctggtgcataatcgccaaatcgctttggctgcggtggtgcgtgtgatctgcaatctgacgttgtatggctttcccgtcatcatgccactctacttggccactaccaacaatggcggcggtgcttggtttaaggtttcgcaatggagccagatttggggattccagtttgtggtcaccattttcggcaatgtgttctggggtcgtatgggcgattcgcatggttggatgcggcaaatgcgctggtttggctgctggttctgtgtgatcggcacgctgggcatgtattacattccgcagtttttcggggcgaatatggtgcttatgtgtgctgatgcggttgttcttggattgggaatttccgctttcgttcctatgggagccgtgtttcccgcgttggcgttggaacataagggtgctgcgatttccgcgcataatttcgcttccggcctggctacgtttttcggtccgctgattgcgacggtgctggtttccactatcggattcggcggcgtgtgctggacgtatgcgatctgctatgcgatcggatcgttggtcacgttcggcattcatcctcatcaacccggatttgacgatcgcggccatcgcattgccgcgatcgagcgtaactaatcgcaattgaatatcaattgctcgatcatcatttttctcaaaaaacatcattatccacaaaggagaataatcatgaaggcagtcgttctcgaagagcagggcgtcatcaatgtgcgtgaggtgcctgacgtccccgcacctggtctaggcgagctgaagatcgcgccgcataccgttggtgtgtgcggttccgacctgcactattacactcatggtcgcgtgggcaaatatgtggtggagcagccgatgattctcggtcatgaggcttccggcacggtggttgaggtcggtcctggcgtcgaaggcttcaaagtgggcgatcgtgtggccatggagcccggcattccggatatgagttcgcgtgccagcaaactgggcatgtataacgtcgatcctgcggtgcgtttctttgccactccgccgattgatggctgcctgtgcgaaacggtgaaccatcctgcggcgttcacctacaagctgcccgacaatgtgagcttcggtgagggtgcgctgcttgaaccgttggctgtgggcatgtggtccgccaccaaggctcgtatcaagccgggcgatgtctgcgtggtcaccggatcgggtacggtcggcatgctgaccgcgtcgtgcgcgttggcaggtggcgcttccaaggtgctgatttctgatgtgtcggcaatcaaattggcgattgcggctcagattccaggtattattccggtggatctcaccaaagaggatctggtggagcgcgtccgtgaggaaacggggggttggggtgctgatgtggctttcgagtgctcgggctcgccgaagtcatacgagacattctggaagctgattgctcccggtggcgctgccgttatcgttggcattccggtcagtccggtggctatcgacattacggaactgcaggctaccgaggtgcgcatcgaaaatatcttccgttatgccaatgtgtatcagaaggccatcgacctcgtggctaacggtaaactgaatctgaagccattcatcaccgacacctatgcgatggaggatgccaaggcggcgtttgatcgcatggccgaggggcgtcctggagatattaagctgcagattaccgtgaataacgactgacgttacgcacgttacggaacgacgaaaggggtctaggccatgggtgctgttgtacaagtcaacgataatcggcatgggaagacggctttggctcagacctcttttggtggattcgtgccgaaaggtggaagttcgaacgattccggcgtattggagatcattgtgccggacgcgcaggcttcggtgcgttgggtgaagcatggctacccaagctcgttggcgaaatggcatcatcatcctcatattgaaattcatctgattcgggaaggtaccggattgatgatggcgggcaatgccgttgttccgtatgaggccgggcaggttgcgctgattggttcgaatcttccgcataattgggtgtccgacatcgctccgggggagcggcttcgtcagcgtgatgtggtgtgccatgtgcgtccggaaaccatacgtctgctgatgtctggatttccggaaacgtctggttttgcaatggtgttgaggcgtgcggggcaggcgttggtgctgagcggtgaatccgctcgtcaggccggttcgattctggaaagcatggaggaacatagtcttgcttgccgtgttagtgatctgattcgtgtgttggatgtgttcgcgcatgcctcagcagatgaatcctatacagtggttgcgtccggatacgatccggctgtatgcagtggtgcggaaagtgtggtcaacgatgccattgagtacatttcctcgcatctgagcggtgaaattagcctggatttggccgctcgtcaggctggaatgagtgtgtcggctttctctcgtctgttcaaaagggccgcaggaataaggttttcggattttgttcgacgattgcgtatcgggcatgcgtgcagattgctgacgaccacgaatcaaagcgtcgcgtcgattcgtcgtgcttgcggatatggaaacgcttcgaatttcaatcgtcgtttctttgaagaaacaggcgaaactcctactggctggcggaaaaaatacattggacggacaagataagtaaataaactttgtaaaagtttgatatgattgatatcatatagaaaatacttttataaaagatgaggaggtgagacttgagaaagtgtgtgtgatttatgataaaaagcaacaaaaacgctcaaaatgatgtttttaaagctttttctcttcacaaaagaacgcaatctaaacattaaatgaacagaatataatatttctcttgcgacacgacgcagtggaaaatcatattgcatactcactaaagtgtgtcctaggtcacaaaagaccagcaacgcgtccatccgcttcgaggcgggtggaataacgggaaactactttgcaaacccccaaagaatcgaggaggacttcaagtggcagacgcaaagaagaaggaagagccgaccaagccgactccggaagagaagctcgccgcagccgaggctgaggtcgacgctctggtcaagaagggcctgaaggctcttgatgaattcgagaagctcgatcagaagcaggttgaccacatcgtggccaaggcttccgtcgcagccctgaacaagcacttggtgctcgccaagatggccgtcgaggagacccaccgtggtctggtcgaagacaaggccaccaagaacatcttcgcctgcgagcatgtcaccaactacctggctggtcagaagaccgtcggcatcatccgcgaggacgacgtgctgggcatcgacgaaatcgccgagccggttggcgtcgtcgctggcgtgaccccggtcaccaacccgacctccaccgccatcttcaagtcgctgatcgcactgaagacccgctgcccgatcatcttcggcttccacccgggcgcacagaactgctccgtcgcggccgccaagatcgttcgcgatgccgctatcgcagcaggcgctcctgagaactgtattcagtggatcgagcatccgtccatcgaggccactggcgccctgatgaagcatgatggtgtcgccaccatcctcgccaccggtggtccgggcatggtcaaggccgcatactcctccggcaagccggccctgggcgtcggcgcgggcaatgctccggcatacgttgacaagaacgtcgacgtcgtgcgtgcagccaacgatctgattctttccaagcacttcgattacggcatgatctgcgctaccgagcaggccatcatcgccgacaaggacatctacgctccgctcgttaaggaactcaagcgtcgcaaggcctatttcgtgaacgctgacgagaaggccaagctcgagcagtacatgttcggctgcaccgcttactccggacagaccccgaagctcaactccgtggtgccgggcaagtccccgcagtacatcgccaaggccgccggcttcgagattccggaagacgccaccatccttgccgctgagtgcaaggaagtcggcgagaacgagccgctgaccatggagaagcttgctccggtccaggccgtgctgaagtccgacaacaaggaacaggccttcgagatgtgcgaagccatgctgaagcatggcgccggccacaccgccgccatccacaccaacgaccgtgacctggtccgcgagtacggccagcgcatgcacgcctgccgtatcatctggaactccccgagctccctcggcggcgtgggcgacatctacaacgccatcgctccgtccctgaccctgggctgcggctcctacggcggcaactccgtgtccggcaacgtccaggcagtcaacctcatcaacatcaagcgcatcgctcggaggaacaacaacatgcagtggttcaagattccggccaagacctacttcgagccgaacgccatcaagtacctgcgcgacatgtacggcatcgaaaaggccgtcatcgtgtgcgataaggtcatggagcagctcggcatcgttgacaagatcatcgatcagctgcgtgcacgttccaaccgcgtgaccttccgtatcatcgattatgtcgagccggagccgagcgtggagaccgtcgaacgtggcgccgccatgatgcgcgaggagttcgagccggataccatcatcgccgtcggcggtggttccccgatggatgcgtccaagattatgtggctgctgtacgagcacccggaaatctccttctccgatgtgcgtgagaagttcttcgatatccgtaagcgcgcgttcaagattccgccgctgggcaagaaggccaagctggtctgcattccgacttcttccggcaccggttccgaagtcacgccgttcgctgtgattaccgaccacaagaccggctataagtacccgatcaccgattacgcgctgaccccgtccgtcgctatcgtcgatccggtgctggcacgtactcagccgcgcaagctggcttccgatgctggtttcgatgctctgacccacgcttttgaggcttatgtgtccgtgtatgccaacgacttcaccgatggtatggcattgcacgctgccaagctggtttgggacaacctcgctgagtccgtcaatggcgagccgggtgaggagaagacccgtgcccaggagaagatgcataatgccgccaccatggccggcatggctttcggctccgccttcctcggcatgtgccacggcatggcccacaccattggtgcactgtgccacgttgcccacggtcgtaccaactccatcctcctgccgtacgtgatccgttacaacggttccgtcccggaggagccgaccagctggccgaagtacaacaagtacatcgctccggaacgctaccaggagatcgccaagaaccttggcgtgaacccgggcaagactccggaagagggcgtcgagaacctggccaaggctgttgaggattaccgtgacaacaagctcggtatgaacaagagcttccaggagtgcggtgtggatgaggactactattggtccatcatcgaccagatcggcatgcgcgcctacgaagaccagtgcgcaccggcgaacccgcgtatcccgcagatcgaggatatgaaggatatcgccattgccgcctactacggcgtcagccaggcggaaggccacaagctgcgcgtccagcgtcagggcgaagccgctacggaggaagcttccgagcgcgcctgatcgcaatatcgcaacgtaactccttatataaaagatgtgaagtgaagcgtatataagaagtcgtgcaaaaggagcctgatgggaaaccatcaggctccttttttatagtgagggggaagtggaccgtcgccgttaccttccgcgttcttcatcgaaagaagacgcgtgattgtgttggcgcgacaccgcgaaaaacgttggaaaaaccgcgacacgcgcgaattccatatgttcacccctgatgcttagataaagaagttgcctgattttagggctcgcaaattgtaattcaaaaagcgagcgtggcacagcggctcactccggtgagaagctgcatggctgcgcactgatgtggtatggccacggaacttccacggttccgggggtcttctgcgccggtgcccttggaagcaggctggtaaacagtaaataacgaatcgctagaaagggcggaaggcaatggcgggacagaaaatccgcatcaggcttaagtcctatgaccatgaggtcatcgaccaatcggcgaagaagatcgtcgaaacggtgacgaacgcgggcgcaactgtggttggcccggttccgctcccgaccgagaagaacgtgttcgtcgttatccgttctcctcacaagtacaaggattctcgcgagcatttcgagatgcgcactcataagcgtctcatcgacattgtggacccgaccccgaaggccgtggactccctcatgcatattgatctgcccgcagacgtgaacatcgagatcaagctgtaagggaggagggaaccattatgtctaatcgcactgcactgctgggcaagaagctcggtatgtctcaggtctgggacgagaacggtttcttcgttcctgtgaccctcgttgacgtgtccaccaacgtggtgaccgctgtcaagtccgaagagtccgacggctacaaggctgttcagcttggctacggccaggttgacccgaccaaggtgaccaagccgctcgccggccacttcgccaaggctggcgtcaccccgcgtcgtcacctcgctgaggtccgcaccgataacgccgaagagttcgagccgggtcaggagctgaccgctgagctgttcccggaaggcaccctggtcgacgtgaccggtaccaccaagggcaagggcttcgcaggcaccatcaagcgttggggcttcaagtcctatcgtcgtacccacggctctcacaagaacgagcgtcgtcctggctctgttggcgcatgcgccaccccgagccgcatcctcaagggcaagcgcatggctggccgcatgggtcatgtgaccaacaccgcgctgaacctcaccatcgtttcgtcggatgttgagaacggcgtgctggctatcaagggcgccattccgggcccgaagggcagcatcgttctcgtccgttcggcagtgaagggagcctgataaatcatggcaaacgttactctgaacgtcaccgataaccagggcaaggccaccggcaccgtcgatgccccggctgagatcttcggcttctccgctgaagaagttcagtcccgcatcccgctgatccaccaggtcgtcatcgcccagctcgccgctgctcgccagggcacccacgccaccaagactcgtggcatggtttccggcggtggccgcaagccgtggaagcagaagggcaccggtcgtgctcgtcagggctccatccgtgcaccgcagtggtaccacggcggcaccgtgttcggtccgcagccgcgtgactactcccagcgcaccccgaagaagatgaaggccgctgctctgaagtacgtgctttccgatcgtgccaatgccggtcatgtggccgttgtcgacttcggtgtttccgaagccccgtccaccaaggccgccgttgccgctcttaccccggtgaccgagaacaagttcaccaccgtggtgctctctcgcgagaatgtgaacgaatggctttccgttcgtaacatcccgaccgttcacccgatcttcgccgatcagctcaacacgtacgatgtggtcaccgctcagtacgtggtcttctccaaggaaggctttgatgctttcctcgctgcgaaggctgagccggctgcaaaggaggcctgattttcatggtcgctattcacaagcccgcacacgacatcatcctcaagcctgtcgtttctgagaagagctacgctctgtccgatcgcggtcagtacaccttcgtggtggccccgaacgcgaacaaggttcagatcaagcaggcaatcgaagagatcttcaatgtcaaggtgacgaacgtcaacaccctcaaccgcgccggcaagcgccagcgcacccgcaacggtttcggccagcgcgtcaatcagaagcgcgccatcgtgaccgtcgccgagggccagacgatcgacatcttcggtaactgaaggctagccgagaaaagttaaaggaagaactagattatggctatccgcgtttataagccgacgactgcaggccgccgtaacgcgtccgtctcggacttctccgagcttacgcgctccacgcctgagaagtcgctggttcgcaagctcagcaagactggcggtcgtaactcctacggccgtatgacctcccgtcatcgcggcggcggtcacaagcgccagtaccgtctcatcgacttcaagcgttgggacaaggacggcgtgccggccaaggtcgctcacatcgagtacgacccgaaccgttccgcccgcatcgcactgctgcactacgcagacggtgagaagcgttacatcatcgctccggaaggcatcaagcagggcgacgtcatcgagaccggcgctcaggctgatatcaagccgggcaacaacctgccgctgcgcaacatcccgaccggtaccgtggtgcacgcgattgagctccgcccgctgggtggcgccaagatcgcccgctccgccggtgctgccgtgcagctcgtcgccaaggatggcgcctacgctcagctgcgtatgccgtccggcgaaatccgcaacgtggacgctcgctgccgcgcgaccgttggtgaggtcggtaattccgatcacgccaacatccagcttggcaaggcaggccgcgctcgttggatgggcaagcgcccgatcacccgtggtgagtccatgaaccctgtcgatcacccgcacggcggtcgtacccgcggtggcaagccgccggtttctccgtggggcaagggcgaggttcgtacccgccgtccgaagaaggcttcgaacaagatgattgttcgtcgtcgcccgaatggtaagaaccgtaagtaagggagtgtcgagtagatgactcgtagcatcaagaagggccccttcgtcgacgcccacctgcagaagaaagtcgacgagcagaacgagaagggtacgcacaacgtcatcaagacgtggtcccgtcgttcgatgattacccctgatttcatcggacacaccttcgccgttcatgatggccgcaagcatgttccggtgttcgtcaccgaatccatggttggccacaagctcggtgagttcgccccgaccaagaccttcaagggtcatgtgaaggacgacaagaaggcacgccgctaaaggagagtaaggacacatggaagctaaagcaatcgctcgtcacgtccgcgtgacgccgcgcaaggctcgccgtatggtcgacctcatccgaggcaagaaggcgaccgaagccatcaccattctgaagttcgctccgcaggacgcatccctcccggtgcgtaaggtcctggagagcgccatcgcgaacgctcgtgtgaaggccgacaaggccggcgagccgttccgcgagaacgacctggtcgtgaaggagacctatgtggacgaaggcgtgacgctcaagcgtttccgcgcccgtgcacagggccgtgccgctcgtatcaacaagcgcaccagccacatcacggtcgtcgtcgctaacaaggaaggaaaccgctaaagatgggtcagaagatcaatccgtttggctaccgcctgggaatcactgagaaccatcgttccaagtggttctccgattccaacaaggttggcgaacgctaccgcgacttcgttctcgaagatgacgccatccgcaaggccatgagcaaggacctcgagcgtgcgggcgtgtcccgtatcgtcatcgagcgtacccgcgaccgcgtgcgtgtggacatccacaccgctcgtccgggtatcgtcatcggccgtcgtggcgctgaggctgagcgcgttcgcgccaagctcgagaagctcaccggcaagcaggtccagctcaacatcttcgaagtgaagaacgccgcactggacgcccagctcgtcgcacagggcatcgctgagcagctcaccaaccgcgtgaccttccgtcgcgcgatgcgtaaggcccagcaggatgccatgcgtgcaggcgccaagggtatccgtatcaagctctccggccgccttggtggcgccgaaatgagccgttccgagttctatcgcgagggtcgcgttccgctgcagaccctgcgtgccctcattgattacggcttcttcgaggccaagaccacttacggccgtatcggcgtgaaggtctggatctacaagggtgatatgaccgagcgtgagttcgaagagcagcaggcacagcagagcaacaaccgccagggtcgtcgcggcgatcgtcgtccgcgtcgcggccagcgcaacgctgctccgcagcagaacgcagcagcagaggctccggccgctgctgaggcacctgccgcaacggaaacgaaggagtgagctgagaatgcttatcccaaagagaaccaagtatcgtaagcagcaccgtccggtccgccgtggcatgtccaagggcggcaacgagatcgctttcggcgatttcggtatccaggctctggctccggcttatgtgaccaaccgccagatcgaggccgctcgtatcgccatgacccgctacatcaagcgtggtggccgcgtgtggatcacgatcttcccggatcgtccgctgaccaagaagccgctcggcacccgaatgggttccggtaagggtactccggaattctggatcgccaacgtccacccgggtcgcgttatgttcgagatcggtggcgtgtccgaggatgtcgctcgtgaggctctgcgccgcgcaatcgacaaactccccatgaagtgccgtgttattgctcgtgaaggcggtgacatctgatggcagtcggaactgcagactacaccatgaagaatctcaacgagaagaccaacgaggagatcgagggcttcctcaagaagtccaaggaagagctgttcaacctgcgcttccagtccgcgaccggtcagctcgaaaacaccgcccgcctcaaggcggtcaagcacgacatcgccaggatgtacaccatcctgcgcgagcgtgagctcggcatcagccaggcccccgaggcgaccgaaacgaaagctgaggagaagtaatggctgaagagcgtaacttccgcaaggttcgtcgcggttacgtcgtgtccgataagatggacaagacgatttccgtcgagctcgagcagcgttcgacccacccgctttacggcaaggttgtgcgctccactcgtacggtcaaggtccatgatgaacacaacgaggctcacattggcgacctcgtgagtattatggagactcggcccctgagcaagaccaagcgttggcgtctcgatagcattatcgagcgcgctaagtaaataagttcggcaaggctccgtgagtcaccccgcctgcttctagcaggcaggcggggtgcttggggagaaccagctcggctaaggagaatcaatgattcagcaggaaacgcggcttcatgtcgccgacaacacgggtgcgaaggaactcctcgccatccgagtgctcggcggatcgaagcgacgctatgccggcatcggtgacgtgatcgtcgcctccgtcaaggacgccatccctggcgggtcggtcaagaagggcgacgtcgtcaaggctgtcgtcgtccgcactgtcaaggaacaccgtcgtgtcgacggctcctacatcaagttcgacgagaacgccgccgtcattctcggctctggccgtgaaccgaagggcactcgtatcttcggaccggtcggtcgtgaactgcgcgacaagcgcttcatgaagatcgtgtccctcgccccggaggtgatctgacatggcagccaagattaagagcggcgacctggtcaaggtcatccgcggcaaggatcgcggcaaggaaggcaccgtcaagcaggtgctcaaggacgatcgtctgatcgtcgagggcgtgcagatcgtcaagaagcacgtccgcgccacgcagcagggccagcaggctggcatcgtggctgtcgaggctccgattcatcgctccaacgtgatggtcatcgatccggagaccaagcagcccacccgcgtgcgcatcgtcgaaaaggaagaggctcgtgacggcaaggtgaagaccgtgcgcgtacgtgtcgccaagaagtccggaaaggagctggcatgaccgataccactgtcgaagcgccggcaactccgcgcttgaagcagaagtacaacgagcagatcgtgccggagctggagaaggaattccactactccaacccgatgcaggtcgctcgcgtccagaaggtcgtcgtctccatgggcgttggtgccgcggctcgcgactccaagctcatcgaaggcgctgtcaaggacctcactctgatcaccggccagaagccgaagatcaccaaggctaagaagtctgtcgcgcagttccacctgcgtgagggccaggccatcggcgcctacgtcaccctgcgtggcgagcgcatgtgggagttcctggatcgccttctgaccatggctctgccgcgtatccgcgatttccgcggcatcaacggcgaccagttcgatggtcagggcaactacaactttggcctcaccgagcagtccatgttccacgagatcgatccggattcgatcgatcaccagcgtggtatggacatcaccgtggtgaccagcaccaaggacgacaaggaagctcgcgtgctcctgaagcacctcggcttccccttcaaggagaactgatatggcaaaaaccgctcttaagaacaaggcggccgctaagccgaagttcaaggtgcgcgcctatacgcgttgccaggtctgcggtcgtcctcactccgtctaccgcaagttcggcctctgccgcatctgccttcgtgagaaggcccaccgcggcgagctgcccggcgttacgaagtccagttggtaaatatcgacgctgaaggtccgcggcccgatcgcctctaaggcgtgagggcggcggaaaccatggcgagaaagggcgttagcccaaatgacaatgacagatccgatcgcagacatgcttacgcgtctgcgtaatgcgagcgcggcaaagcacgagaccgtggatatgccgtactccaagttcaaggcgaacatcgctgagattctgaagcgtgaaggctacatcaaggacttcaccgccaaggaagccaaggttggccagactcttgaggtcaccctcaagtacggtccgaacggcgagcgttccatccagggcatcaagcgcatctccaagccgggcctgcgtcgttacgcaaagtccgatgctctgccgatgccgctcggtggccttggcatcgcaatcatctcgactagctcgggactgctgacccagaaggaatgcctcgaccgaggcatcggcggcgagatcgtcgctttcgtttggtgagaaaggagagctgaaacatggcatcgcatattggtaagctccccgtcaccattccggctggcgtggaagtcaagatcgacggtcagtcctttaccgccaagggcgctaagggcactgactcctacgagattcctgaaggcatcaccgcagtggtcgaaggcaacgaagttgtcctcaccccggctgatgacctgcgtccgacccgtgcaaagcacggcctggctcgctccatcgtggcgggcatggtcaagggcgtgcacgagggttatgccaagactctggagatcgtcggtaccggttaccgcgcccagatgaagggtaagggcattgagttctccctcggctattcccacaccatcaccgtcgagccgccggcaggtatcgaattcgaactgccgaacccgaaccaggtgatcgtcaagggcatcgacaagcaggctgttggccagtgcgccgctaacattcgtaagcttcgtgctccggaaccctacaagggcaagggcatcaagtacgcggatgagcacattctgcgcaaggctggaaaggctggtaagtaatgagcgtccagattctcggtaagggcaagaaggtcgcgcttaagcgccgtcacgctcgtctgcgcaagcacatcagcggtaccccggagcttccgcgtctggtggttacccgttccaaccgtcacatggttgcccagatcatcgatgacaccaagggtgtcaccctggtgagcgaatccactctgaccagcgatttcgccggtttcgagggcaccaagaccgaagccgccaagaaggtcggcgaactgatcgccaagaaggctcaggacgctggcattaccgcggtcgtgttcgatcgtggcggcaacaagtatcatggccgcgtcgcagctgtcgctgaaggcgcccgcgagggaggtctggcactgtgagcgacaacgaaaaggaaacccaagtggctgaagaaactcagaacactcaggctgccgctgagtccaacaacgaggaccgcaagtcccgtcgtggccagcgcggtgagggtcgtcgtggcgagcgtcgcaaccgtcgtgaggaatctcacgagaacgagatgctcgatcgcgtggtgaccatcaaccgtgtgtccaagacccacaagggtggtcgtacgttcagcttcgccgccctcgtggtggttggcgacggcaagggcaccgttggtgttggctacggcaagtcccgtgaggtcccggctgcaatcgccaagggccagctggatgccaagaagcacatgttcaccgtgccgcgcatcaagggcaccgtcacccacccggtgatcggccacgatgccgctggcaccgtgctgctgcgcccggctgctccgggtaccggcgttatcgccggcggtgcagtccgcgccgtcatggaatgcgctggcatcaccgacgtcctgaccaagtcgatgggctccgccaccgccgtcaacgtggtgcgcgcaaccgtcgacgccctcaagaagctcgaagagccggaagagattgccgcacgtcgtggcatgtctctcgaagaggtggctccggacgcgctgctgcgtgctcgcgccgaaggcatcgccgaggcccgcaaggctcgtgaagaggctcaggccaaggctgctcagaaggacggtgagtgatgactaacctgaacatcaagctgcaccacggtctggtgaactccactccgaagcagcgtgctgcggctcagactctgggcctgaacaagatcggcaagaccgtgactcgtgaggatactccggcccttcgtggccagctgcaggtcctccgtcacctgatcaccgtcgaggaggctgactgattatggcagacattctgcagatgcatgacctgaagccggctccgggtgccaacaaggatcgtatccgcgttggccgtggtgaaggctccaagggtaagacctcgggccgtggcgacaagggcaccaagaagcgctatcaggttcgtccgggcttcgaaggtggccagctgccgctgtacatgcgccttccgaagctgcgtggcttcaagaacccgttcaagaaggaataccaggtcgtcaacgtggctgttcttgcggaactgttcccgcagggcggcgagatcaccgtggctgatttggttgccaagggtgccgtccgcaacggcttcccggtcaaggtcctgggcgacggcgaggtttcggctgcctacactctcaagggtgtcaaggcttccgcttccgccaagtccaagatcgaggctgctggcggctccatttccgaggattgattccaacggaatgtagctgactgaagctcagacatgaggcttcccccgctttagagcgggggaagcctcattcgtttgcagtcaaaatgcaatcatgcatggaaaaacaaaaaacagacgaataatgacgaaaacgccatatcggtagacgccgtacgctagactcgagcgttagagtctgtttttgcacgtgtgcgcaggtgcgcacgacgatggaaggaaccccaggtgaggacgttaatccaggccttgaagaccaaggaattgaggaataaaatcctcttcacccttggtatcatcatcatttatcgtatcggttcattcatcccgacccctggcgtcgattacaccgtcgtccagcagtgcgtcggcaagatgaacaacgcttctgagaactttatcggtctggtgaacctcttctccggcggcgccatgctgcagctgtcgattttcgcattgggcgtcatgccgtacatcaccgcatcgatcgtcatccagctgctgcgtgtggtcatccctcgtttcgaggcactgcacaaggaaggccagtccggcgaagccaagctgacccagtacacccgttatctgaccatcggccttgccgtgctgcagtccaccaccattctggtgaccgcacgttccggcgcgctgttcaactaccagtgctctcaggttgttccggacggttccgtgtggaaccttgtggtcatggtgctcatcatgaccggcggcaccggcctcatcatgtggatggccgaattggttaccgataagggcctcggccagggtatgtccatccttatcttcatgtccatctgctccggcttcctgccgcagctgtgggagatcggctggggcaccaacggcaccgatggcaattggggcaagttcgccgcggtcgtcggcaccctgctggtcatcatgatccttgtcatctacgtcgagcttgcccagcgtcgtattccggtgcagtacacccgccgtatgatcggccgcaagatgtacggtggctcctccacctacctgccgctgaagatcaacatgagcggcgtcatcccgccgatcttcgcatcctccatcctggccgtgccgacgctgatcgcgcagttcggcaattccgaccagtcctgggtcaagtggatcaactccaacctggccaacaccacatccgtgtggtacatcgcactgtacgcgctgatgatcgtgttcttctgcttcttctacacggagatcaccttcaacccggacgagaccgccgacaacatgaagcagtacggcggcttcattccgggcatccgcgcgggaagcgccaccagcaactacctgagctacgtgatgaaccgtctgaacacggtcggcgccgtctacctgctgttcgtggcgcttatcccgacggtgctcatcatggcgctgaacctgaacaccaagctgccgttcggcggaaccaccatcctgatcatcgcaggcgtcggcctcgacaccctgcgccaggccaaggcccagaccgaacagttccagtacgctggcttcctgttcgaggacaccgaccacaaggaaggtaagtaaccacttgaatcgtgatgtcgtttccgttgatcgggagcggtatcacgatttttatgttaagtaatccatcatccgaaaatccccgttgaggggaatgaacgaaacggagaacaacacatgcgactgctgatcatgggcccgcagggcgtaggcaagggcacccaggccgctctgctgagcgagcactacggaatcccggcgatctccaccggcgatatcttccgctacaacatcaagaacaagaccgagcttggcgtcgaagcgctcaagtacatcgacaagggcgagcttgtgccggacgagctgaccaacaagatcgtcaaggaccgtctggccatggacgacgccaagaacggctggattctcgatggctatccgcgcaacgcctcccaggtcgaggctctcgacgccatcctgggcgaactggacaccccgcttgacgcggtcgtcgcactggatgcagatcacgacgtgctcatggagcgtatgaagaagcgcgccgaaatcgaaggccgctccgacgacacccctgaagccatcgccaagcgtcttgacgtgtacgccaaggagaccgcgccgctgctggacatctaccagaagcgcggcctgctcaagacgttcaatggcgtcggcgccgtcgacgagatccaggccaccatcgtggcggagcttggctgaaggaaaaaccaagcagaataacatatttccaacgaaagcgggaatcgcgacacgccgaacgtgtcttgattcccgctttcgtgtattcttgcaagttggtgtgtcttcgggcacgcatagtaatcgccaaggaacggaacgaggctcatggctaaagacggtgtgattgaagtcgaaggacaggtagtggaagcactgccgaacgcgatgtttcgtgttgaactcgaaaacaagcatatcgtgctcgcaaccatttcgggcaagatgaggaagaactacatccgcatcctgccgcaggatcgtgttgtgctggagatgagcccctacgacctgaaccgcggccgtattacgtaccgttacaagtaaaggtacacaagcaaaggaaaaccatgaaggtcagccctagtgtgaagaggatctgcgagaactgccgcgtgatccgtcgtcacggccgcgtcatggtgatctgcgtcaacccgcgccataagcagcgtcagggctgagagcagatccagcggcataaacagtacaggcgctgagtcacagcccgtgaaagcgggatgaaccccgggtacgcaggcccgggccgggaaaccggacgactcggtgcaagacctgcggaaaacagaaggaatcgcaatggcacgtcttgccggagtcgacatccccaatgagaagcgcatcgagatcgccctcacctacatctttggtgttggtcgtactcgtgccaaggaaacgcttgccgcgaccggtatcaatccggacattcgcgtcaaggatctgacggatgagcagctgattacgctgcgtgattaccttgagggtaactacaagatcgagggtgatctgcgtcgtgaaatcgatgcggacatccgccgtaagatccagatcaactgctaccaaggccagcgtcaccgtaagggacttcctgtgcgcggtcagcgcaccaagaccaatgctcgtacccgcaagggcccgaagcgcacggtcgccggaaagaagaaggccaccaagtaatcggtggctgacagttcaagccacgaggcgtaagcctcatcgtttgaacatcaaagcaaattcgttattaggaaacgagggtcaatggcagctcaaaagcaagccgcgcgcaagccgcgtcgccgcgaccgcaagtcggtcccggttgggcaggcgcacatcaagtccactttcaacaacaccatcatttcgatcaccgacccgtccggcgcagttgtgtcctgggcgtccggtggcgatgtcggcttcaagggctcccgtaagtccacgccgtacgccgctggcatggccgccgaatccgcagcccgcaaggctatggagcacggtctcaagaaggtcgacgtgttcgtgaagggcccgggttccggtcgtgaaaccgccatccgttccctgcagtccgccggactcgaagtcggttccatcaccgacgtcaccccgcaggcacacaacggcgttcgtcctccgaagcgccgtcgcgtctgagcactagaagaaatcatcaatccaacgccgcttatggccggtgagtgcaccaccggcctgaagctgaaaggataaccacagtgcttatcgcacagcgtccgacacttaccgaggaatctctcaaccctcagcgttcccgcttcaccatcgagcctcttgagcctggtttcggctacacgcttggcaactcgctgcgccgtaccctcctgagctccattccgggagcggctgtgacttcggtgcgtatctccggcgtcccgcacgagttcaccactctgccgggtgttgaagaggacgttaccgaaatcctgctgaacatcaagggcatcgtgctcaccagcgaatacgatgagccggttgtcatgtatctgcgcaagagcggcaagggcgaggccaccgcgggcgacatcaccccgccggccggcgtcaccatcgccaacccggacatgcatatcgctaccctcgccgaggatggcgaactcgagatcgagttcaccgtcgagcgtggccgcggctatgtgcccgcccagatgaacaagcaggataacgccgagatcggccgcattccggtcgactcgatctactccccggtgctcaaggtgagctatcgtgtggaagccacccgcgttgaacagcgcactgacttcgacaagctcatcctggacgtggagaccaagccggctatctccccgcgcgatgcagtcgcatccgcaggctccaccctggtggaactcttcggtctgtgccgtgagctcaacacccaggctgagggcgtcgaggttggccctgctcctgtggcagaggaaaccaacccggagatgaacatcccgatcgaggacctgaacctcacccagcgcagctacaactgcctgaagcgcgagggcatccacacgatcggcgagctggtcgcccacaccgagcaggatctgctcgatatccgcaatttcggtatgaagtccatcgatgaagtcaaggagaagctccagtctctgggactcgccctcaaggcttccccgctgggtaacttcgatgccaataatctcgaaggtggcaccttcttctcgccggaagacgagtgatccgccacttttgacctaaccgcttcgttggattcggacgttcgggcaactgcccacctgaatccaacggggctttcaaggagaaacaatgcctacaccaaagaagggtccgcgtctggcctccagcccggctcatgagcgtcttatgctcgcgaacatggccaccagcctgttccagaacggccgcatcaccaccaccctgccgaaggccaagcgtcttcgtccgctggccgagcgcctgatcacgctcgccaagcgtggtgatctgcacaaccgtcgtcgcgtgatgcgcgtcatccgcaacaagtccgtcgtacacaagctgttcaccgagatcgccgagcagatggagcagcgcgaaggcggctacacccgcatcgtcaagattgctccgcgtcgcggcgatgccgctccggcagccatcatcgagctcgtcaccgagccggtgagcccgaagcaggccgtggtgaaggaagccgaagccgcaaccaaggttgccgctgccgaggctccggaagccgccgctgaagaggctactgctgagaacgccgagtgaatcgctcttagctgattgaaggccgggaatcgcaaggttcccggcctttgccatatctgctgccaagactgtcgcgccacatgcctcactatgccagccatttgctatgctcaatgccgtgagactacgcatcgatttggcatatgacggtaccggcttctacggatgggcgaaacagcccgaaatacgtacggtacagggcgaaatcgaacgcgtgctgcataccattcttcgcgtaccggaaggagacccgaccgaaccgctgcgccttaccgtggccggacgaaccgacaccggcgtgcacgcctcgcatcaggtatgccatctggacgtcaacgaggacgtgctcaaacgctgcgtcggccacatggacgtgccgcccgtcatcgcgcttacccgcagacttcagcgcatgctgccggccgatatcgcaatccgcggcatcgcacccgctccggacggtttcgacgcgcgtttctccgcgttggaacgtacctacgtgtaccgaatcgccgataggtcaagcgaggtggacccccgtaccagaaacttcgtattgcatatcgacgatgaacttgacctcaaatccatgaacgaagccgctgcgatgacgatcggcctgcacgatttcggctcgttcgccaccccaaatccgggcggcaccaccatacgcgaggtgaagaccgcgtattggcgtcgcgtgccgcagcggacgcttatcgacgacggcatgacgatgggggagcggtaccgtacgccgaccgtggaatcgggcctcgtctgcttcgtgatcgtcgccgacgcgtttgcacgcaatatggtgcgctccctcgtcaacggctgcgtgcaggtcggtatcggcaaacgttccctcgactggtttgcaggaaaaatggcggctccgctgcgcgaaggctccacaggaccgatcgcgccgcaaggactgacgctggagcatatcgaatatccggccgacgaccagctggcggtccgcgccgaagccattcgcgccaagcgcacactgtagctttattgcgattgtcacagccaggttacgggcgcttgtcatgtccattgccgagacattgtcgtaacagaccgtttcgttttccggaaacgctggttcgttaggtttttcttccatcaaggcacgatgcctcagattggcatgcgttcgcatggggtggaagggagcgcggaacgatgattgaatccgccgcacgaaggttggcttcggaactggtcgatcgtcgggagtcgatcaaccgggagctgagccgtaatggcgtacggttcggcatctacaagaacggcgagtaccatgaccggctgtttccgtacgatccgattccgcgcatcatcgaatcggacgaattcgacagaatggaagccggactgaaacagcgcgtcaacgcgttgaacgcctacctgcgcgacatctactccgacaagcaggccatcaaagacggcatcgtgccggaagaatacgtgtacacgtccgcgggatactttccgcaagtcaacggcgtgacacctccgggcggcgtgttcgcgcacatcgccggcgaggacctggtgcaggggcaggacgggcaatggtgggtgctggaagacaatctgcgcattccatccggtgccagctatctgctgttcgcccgcgatatcgaacgcagaatcacgcccagcctgttccgcaacgtacgtgtgcgcgacaatcgcgattatccacgactgctgcgccaatccatggatttcgtctccaccgacggcatagcagtggtgctcacccccggcaggtacaattccgcgttcttcgaacatgcatacctggccgagaaaaccggcgcggcgctcgcgttccccgaagacctcgaagtcgtggacaacaaagtgtacttcctcgactatgccggcaggaaacaccgcgtcggcgtggtctaccgccgtctgtccgacgaatatctcgacccgttcgcgttcaacccggattccgtgatcggcgtgccgggaatcctgtccgcctacaggtcgggcaatgtggcgatcgtcaacgctccgggcaacggcgcggccgacgacaaggccatctactatttcgtgccgaacatgatccgctattatctcggcgaagagccgattctgcacaatgcgccgacctacatgccgatgttcgacaaggaccgcaaggaggtactcgaccggctcggcgaactggtcatcaaggatgtggcggaagcgggcggctacggcgtcgtgttcggctcatcgctcgaccggtcgcaacgagaggaactggccgaacgcatcaaggccgaaccgcgccggttcatcgcgcaggaggtcatccaattcaaggacatcgacgtggtggaccccgaaaccggacagatgagctcacgtaaatgcgacctgcgcgccttcgtggtgaccggcaagaacacgcacgcatggtattcgggactgacacgctactcgtccataccgggccagatgatcgtcaactcatcacagggcggcggtttcaaggacacctgggtactggccaaagagaccggcgtggagcatgattacgcacccggctcggaggtcgtgcgcgtgctggaacagtcccgcaagcactcgctggcactcgtcaccgcgtcgaaggccgacaacctgttctggctcggccgctacacggaacgcgtattcaccacgctgagccaattcttccccttctacgaccgtgtgatggacacggatgtggacgcgttccgaccgttcgcccgcgcgctcgacctgccggaggatttcgaggatttcgacgcgttcatccacagcttcctgtacgacgagaagaatccggattccgtacgcagcgccatcgtctacgcgttcaacaacgcggtgattctgcgccccgaacttggttctcgctcgttgcagcaggtggagttggccatgagctccatagtggaggcatccgaatacggcggcacggacgcggatatcttcaaacaccgcgacatcgcggacaacatgctcgccttctggggaggtgtggagaattcccccgtcgaaccgactctgaaatcgttcattttcgtgggcaaatatctggaacgtctggatctgtacacacgattcggatattccgtggaagagctcaaggcgccgctcgccaaactgggcagctacatcctgccgttgaacggtctgccggtaccgcaatgcttcgccgaaggattgcgctggctggtcggccagctgccgcagcggggatatgcggagcttgcggaaaaactggggatgctgctgaaagatttcgatgggcgcatctccacgaaggatctgaaggatctgggcatgctcaacacgatggacatggacgccgcgcgactgtgaagaatacgtgccacagccatcgcacggtgcgtgtataacggctagaacaaggcccacggcgtggaaaacgccgaaggaacgacaataatcgctgaggagacgatgtgaagaaactggtgtttgactatgagatgaagctctcattcagctcgcccgtgaccgaccatcgcttccaactgcgctgcattccagccaccggcccacgccagcaggtgatcgacgtggcagtcaaaatcgaaccggatgtggaactcgaaaccgccatcgattccttcgattccgtggtgatgaccggattcattcccgaaccgcacaccatgttcaactactcggtgaccggcatcgccttcgtggacaacgcgcatatcaaatccgaaatctacaagccgctgtaccgcttcaattcggcgttgacagtgccggggccggccatcgaagcgttgatcggcatctgccatgaacgcatcgtgtccctgcctgccgactgcacgccgatcgaccaagcccgtgaggtgatggacgaggtgttcaaaacgttcgtctacacgccggcctccaccaccatccgcaccaccgccgaggaagcgttcgctcaacgcaagggcgtatgccaggattacgcgcacgtcatgctgtccgtgtgccggcacgtcggactcactgcccgatacatcgcgggattgctcggcggcgagggcgccacgcacgcatgggtcgaaatctaccatgatggacgttgggtcggtttggaccccacacacaaccgtatggtcgacgacaactacatcaccatcgcccatggccgcgattaccgcgactgcatgctcgacatcggcatcttctccggctgcgacgtcaagcaggaccagtgggtcaacgcttccgtgcacgagcagggatactgattccccgacgttttctcgatgccggattccgtatttcggcagatgcaaagcagataaacaaaaaggccgaaacgccattgtttcaaccttcattgcatgcggataaggcgagattcgaactcgcggaggggttcgccctcacacgctttcgaggcgtgctccttagaccgctcggacacttatccattcgtcacctgaaaacaagcaacttgataattgtgccacagtggtggcgattgtcaaatcggactggctgcaacggtgtgatttccggcgtgtcttgatttgcgcccgactgtgcgtccttaggcgaacagcgcttcgtcgaaggaaggatagccccaatcaagcgccaattcgacacggtccgcaatcagaccggcaagcacgcccagggattgcgctcgcgaatccgtcgactgttttgcattggtgacgcgtgactgggaatgatcgttcgcggcattggagcttccggcgattgccgttatctcgcttcgcgcgcagttcatttcgatggtggcgtcggtcggtgccgtaaggccggtggcggaatcgagcatcgtgtcggggtgggcgagcaaggcggtggcctcgtacgttttcctacgatcgtcaatggcgcccgagaaggatgcgaaccgttgcgatgtggtcttatgacgatcgctgatatccagcgtcgcatggccgctgttgcgggccgccagcacttccatggcgaatccggcacggtcttcgtcctgcgcggcggtggcaagggacttggaatcgacgtcaagcgattcgacatcgtcaaaacgcgacagcgtgatcggcgcgacggccaccgacagttgatcgcccagtgcgcgagccatatgacgtgcctgcgcgctgcgcaacgtgccttcggcaaaacgcgccggacattgcgccgcggtgttcgtccatgcggagaccgcctgctgcgccgagaaatagcggcggatgatgtgctgatgctggtcgtgtgcgatcttgttatcggcggtggcatcgaaataggccttctcgcacgggctttgccgttgttcggcttcagccctgcctgcgatcctgggcatggagcatgccgtcagcgccggcatgaggatagcggtgcaaagcaatgcgcagacgcgtttcgcgataaaagaaaccgagcggaaagaaggggtacgtgtctgcatgaatcattagactaatatctgactgtgaccattgggccatgcgctcggaataacttcatataggaggtcttggaaatatggaactggacctggcaggaatgcaccagctcgccgctgggcagggaattgatcccgagacgctggatgccgcactctcggaagcattgcgactggcatatctgaaaacccctcacgctgcgaagcacgctcgcgtcgagcttgatccgcgtgcgggaagcttcaccgtatgggcccaggacgagattcctggcgagccgactgaagacgatccccatcccgcgccgactctgggcgaggaatacgacgacactccgcacgatttcggccgactggccgctgcgaccgctcgtcaggtgatcagccagctgttccgcaaggccgaggatgacaaggtgttcggcgcgttctccggtcagaagggcaagctcatcaccggcatcgtgcagcaggacgtcaaggacacatccaacgtgcacgtggccgtcggcgacgtcgaagccctgctgccgcgccgcgagcaggtgcccggcgaacgctaccgtcacggcgaacgtatccgcgtgtacgtggtgaacgtggcccgtggtctgaagggcccggaaatcgtggtgtcccgttcccatccggagctggtccgccgcctgttcgaacgtgaggttccggaactggtttcgggagccgtgtcgattatggccatcgcccgcgaggcgggcgcccgcaccaagatcgccgtccgtgccaacaccgaaggcgtcaacccgaagggcgcgctgatcggccccggcggagcccgagtgcgcgccgtcatggagaacctcggtcctgagaaaatcgatatcgtcgactggtccgcggatccggcgaaattcgtcgccgcggcgctgtctccggccgtcgccaccggtgtgcaggtgatcagcgagaagaacaagacggccatcgccttcatccacgatgaccagctgtccctggctatcggcaaggaaggccagaacgcacgtcttgcggccaagctgaccggctggaagatcggcatcgaatccgctgaggcgcatgccaagaagatggccgaatcggcggaccattccgatggggaaaccgaggaataaacaacacttccggtagacaacaagcccgtggacgtacaatccacgggcttgagtatgctggactcgacaatccaaagcgtgacggccatgctgtcatgcccagggaaaagacgaggtatcacgaacatggttgcacgatgagaaggaacaagctcgccgtgaatcagtagcggtcgcgcccgtatgcgcgcggcccaagataggagaattgagtgccgaaagcacgcgtatatgaacttgccaaggaacttggcgttgacagcaaaaccgttttaagcaaacttgaggcgatgggcgaattcgtgaagtccgcatcgtctaccgttgaacctcccgttgcacgcaagctgaggaacgcattcgcgtccagcggacagggcaacgcatctgattccaagaagccgggccatacggccaagaagcctgccgaaccggcatctcattccatgccaaagccggccgctccgtcagcaccgaagccggctgcccccgcagcgccgaagccgcgtcatgccgcttccaagtccgatgccccgaagccgggtcatcgcgcgccgcgtccaggcgaatcccgccagcatggcaatcgtcctaacggcaacgccccgcgtccgcagggtggagaccgccgccagtccggtcgcccgacggccgttccgggagctcgcccccagcatggcaacgccccgcagggcggcaacaacgccaacggcgcgaagccgcacaccccgggaccgcgcccgggcaacaatccgttcagccgcaagcagggcatgcacaccccgactccgggtgatattccgcgtccgcatccgatgaaccgtccgagcgtcaacaatggcgaaggacgtcgtggcggccgtccgggtcagggcggcggccagcgtggcggcttccgtggtcgtccgggtcagggcggcgcgaagccgggccagtggggccagcatcgtccgggtcagggcggcggccagcgtcccgccggcggcggcaatcgtttcggcggcaatggcggcggtttccagggcggcaacagcgctccgagcaatggtccggcacgtggtggccgcggccgcggcggcgctgcaggcgcgttcggacgtcagggaggcaagtcctcgaaggcgcgtaagaaccgtctggcgaagcgtcaggaattccaggagatgaaggctccggtcatcggcggcgtgcgcattccgaccggcaacgggcaggaagtccgtctgcgtcagggcgcgtccctcgccgatctggccgagaagatcaacgtcaatccggcggcgctggtcaccgtgctgttccaccttggtgaaatggccacggccacccagtccctggatgaggccacgttccagatcctcggcgaggaaatcggctggaacatcaagatcgtgtccgccgaagaggaagacaaggagctgctgcagcagttcgacatcaacctggacgaagaggaactgcaggaggacggggatctgaagccgcgtccgccggtcgtcaccgtcatgggccatgtcgaccacggtaagacccgactgctcgacaccatccgccgcaccaacgtcatcgaaggcgaagccggcggcatcacccagcgcatcggcgcataccaggtgaccgtcaaccttgagggcgagccgcgcaagatcacgttcctcgataccccgggccacgaagccttcaccgcaatgcgtgcccgtggcgccgaactcaccgacgtcgcgatcctcgtggtcgccgccgacgacggcgtcatgccgcagaccgtggaagccatcaaccacgcccaggccgcgcatgtgccgatcgtggtggccgtcaacaagatcgataagccgggcgccaacccggacaaggtccgcggccagctcaccgaatacggtctggttccggaagaatacggcggcaacaccatgttcgtcgacatctccgcgaagcagggcaccaacgtcgacaagctgctcgaagcggtgctgctcaccgccgacgccgagctcgacctgcgcgccaacccggatatggacgcccgtggcgccaccgtcgaagcccgacttgacaagggccgtggcgccgtggctaccgtgctggtgcagtccggtaccctccacatcggcgatgccatcgttgccggcacctcctacggtcgtgtccgcgccatgctcgacgagaacggcaaccacatgcaggaagccggtccgtccaccccggtgcaggtgctgggtctgacctccgtgccgaccgcaggcgacctgttcctggtggcctccgacgaccgtaccgcacgtcagatcgccgagaagcgtcaggccaccgagcgtgcggcccagctggccaagcgccgcaaggtcgtttccctcgaaagcctcaaggagcagttcgccaagtccgaggtggatatgctcaacatcgtcatcaagggcgattcctccggttccgtcgaggctctggaagattccttgatgaagatcgaggtgtccgacgaggtcggcatccaggtgatccaccgcggcgtcggcgccatcacccagaacgacgtcaacctggccaccgtcgacaaggccgtcatcatcggcttcaacgtccgtccgaaccgccaggtggcggatctggccgaacgcgaaggtgtggagatcaagtactactcgatcatctacaaggccatcgaggacatcgaagcatccctcaagggcatgctcaagccggaatacgaagaggtcgtcacctcccactccgagatccgcgagatcttccgctcctccaagttcggcaacatcgccggcgtcatggttcaggacggcgaggtcaagcgtggtacgaagtgccgtatcctgcgcaacggcatcgccaccgtcaacgacctcgagatctcctcgctgcgtcgtttcaaggacgacgtcacctccgtcaaggaaggctacgaggctggcatcaacctcggcaccttcaacgacatcgagatcggcgatatcatcgagaccttcgaaatgcaggaaatcgagcgtaagtagccgagtgcttcgagcttcgcatcgataactaggtaaggaacgcccacagccggttcacgactgcgggcgttccgtgatacaacaagaacttttcaccaaaaggacagcaatggcaggaaccaatccccgcgccgcgcgcatcgcggcgttgattcagcgtgtgatcgcatcgtccatggaggcgcagctgcacgacaagcgactggccaacgtgaccatcaccgaagtgcgcgtcaccaacgatctgcagatcgcgaaagtctactggacccagctcggccacgaaggacacgagcagggcgaacgccgccgcgcgcagcaggccctgaaccaggccaaaggacgcctgcgttccctggtaggcaccaaggccggactgcgactcaccccgcaactggaattcatcttcgacgaagtgccgggcgaggcccatgagatcgaggacatcctcgcgctcgcacacaagcgcgacgaagaactcgccaagtcccgcgccaacgcgcaatacgccggcgacgccgatccgtacaagcacgacgagcccgatgatgacgacttcgacgatgatgacgatgtcgaggtcgaggattgggacgatgacgacgaagcctgacaactccggtctgctggtcatcgacaagccgcagggcgtcaccagccacgatgtggtcgcggcggtgcgtggcgccctgcacatgaaacgcgtcggccatgccggcacgctcgacccgatggccaccggcgtgctggtggtcggcttcggcaacgccacacgtctgctcaactacatcgtcgaccacgacaaaacctacctggccaccatcagactcggccagcgcaccaccacggacgacgccgacggcgaactgctgccgggggagggaactatcgccgaattcccttcacgacagaccgttgaagacgtcatcgcccatcatttcaccgggcgcatcgagcaggtgccgaactcctattcagccatcaaaatcaacggccagcgcgcctatgatctggcccgagaaggcaaggatgtggacctcaaggctcgtccggtgaccatctcggaattcagcgtttcggcagtgcgatacggctatgcttcgaccacatgcgcgggatcaccgcttgccgatgccatcgaaatcgccccggaggaatcctggcatgccgaaaccgacgggcaaaacgaaccgaacatgcagccagtcatggaactcgacgtgaccgtgacctgctcggccggcacctacatccgcgcactcggccgcgatctgggcgccgaactcggcctcggcggccatctgaccatgctgcgccgcatccgcgtcgggcgtttctcggtgaacatgccaaacgtcatgaccgcccatacggaagccaaaaccttcaccaaccgcgaaggcatcgaagtgacacgcaaccgtgcggtgcttgacgatgccgagcatgccgttgaccacgcactcgacctggtcgccagcgcggccgcttccatggacatgcttcccgtcaccgaacaggaggcgacggacctgcggttcggccgtagaatcgcccacgacatccatacgaccatggccgcgtacgttcccgaaaccaacgatctggtggcgatcgtggaacgcgccaaacgtggcgagaccaagccggtcgcggtcttcaactgaaacaatcaagaccggccggcacgcaatacgaacacgacaaacacacggacaatacgcaaagaaggacacatgaagacgatcacgcttacccccgatgccagcggcatggtggattggccgaccctgagcaacgacaagaagtccgtggtgaccatcggctcattcgacggcatgcatcagggacatcaggcggtcatccgccgtgtggccgaactcgccgaacaggagcaggcgttctccgtggtggtgctgttcgacccgcgtcccgcgctggtgcacgcttacgccgccaaacatgacggtcaggaaccgcccgcaggcacgcctgacacgcaggcgctgaccagtgtgaacgaacggctgcgcgccatcgacgccatcggcgtggactacacgctcatcgtgcgctacaccatggcattcgccgcgaaatcatatcgcttcttccttggccagatggtcggcaaactcggcatgcgcacgctggtgctcggctccgacgccgccatgggcgcgaaccgcgccggaaacgtgaaggccattgagaatctggcgctcgccaccggcgtgttccagctggaggtcgtggacgatttcggtccggggctgacccgagtgccggtcaatgcgaagccggtgatgccgtccgaacccggcgagccttccgaccctctggagggggcttccaaggccgaacgacgcgcatggagcaagaagcatcaggccaaggaggtgcgcacgtggagctccaccaatgtgcgctatctgctgagccaaggccgtatcaaggacgcagacgcgatactcggccacgcgcatgccgtggaaggcaccgtggtgcatggcgaggaacgcggccgcaccatcggattcccgaccgccaatctgagcgagaacgtcgccggatacctgccggtggacggcgtgtacgccggctggctggtcgatttgggggagaagtccgctgacggtggcgaagaagccggggagaagccggccgacggcgtatcgcagcagtatgatgcttcgtccgtcaacgcgcgcgtggacatgcagtcgccacaccgctggccggcggccatctccatcggcaccaagccgacgttcaacgaggacggtgacgccgaacgcgtggtggaagcctacgccatcaccgatgactggttggacctgtacggccatcaggcgcgcgtggaattcgctggattcctgcgcccgcagatcaaattcgattcggccgacgatctggtggtcgagctgaaacgcaacgtcgaggagacgaagcgcctcaccgcttgagacggatcggttcgattgatttgattggttcgattgacgcgaatcattgacgccatccgtgttttgttacccaaacgggctttcccgggttgcaaaaagcggatggcgatgccgtttgggcatcggcgacctatcgcagaatcgcggccaacgcgtcctgcaacgtatccgcctgcaccacgcccattcccggcacggcgacgttcttgcgcagcgtcggcacaacggcggtggtgaaaccaagacgcgccgcctcacgaagccgatattccagtctcggcaccgggcgcacctgcccggtcaacgaaatctcgccgatcgcgcacgtcgtgcggggaatcggtttcgatttcgcagcgctcgccaacgcggccacaatcgccagatcgcaacccggctcacgcgcctgaccgccggcgattgtggaaatgtacaggtcgttggccagcagattgatgccaccgtgacgatataacaccgccaccagcatggcgatacggttggagtccacaccgttcgccgcacgacgtggcgtcggcagcaccgacttggtgaccagcgcctgcacttcaatcggcagactgcgatgcccatccaacgtgaacgtcacgcacgtgccatccacctgcgtcgccgcagaaccattgccggttgataggaacaggccggacggatcggtcacctcctcaatgccctcgccgctcatatcgaaacagccgacctcatcggtcggtccgaaacggttcttcactgcacgcagcatacgcaacgcggtttcggcatcgccttcgaactgacagaccacatccaccagatgctccaacgtacgtggacctgcgatcgaaccatccttggtgacatgacccaccaaaagcactggaatatcaagggttttggcggtgtcaatcagcgcgctcgccacttcgcgcacctgcgtggatccgccggagatgccatcgacgtcctgcgagacgatggtctgcgccgaatcgacgatggccaacgccggcttgaactgttcgataagccccaacaccgtggacagatccgtggtggaggcgagcagtagattcggctccatggcgccgatgcgcgacgcgcgcatgcggacctgcgcctgcgattcctcgccggaaatatacagtacggtattgcgctcggtggcgaacgccgtcagcctcgccacattgccggcggtttccagcagcaatgtcgatttgccgatgcccggctctcctgcgatcagcgtgaccgatcccggcacgatgccaccgccgagcacgcggtcgaattccgaaaatcctgtggcgattctggagatgttctccgtgcctatgtcggtgatcggcctcgccgcggacgatgcgaccggatgcgattgcgtgcgcgaggtccgtcccggagccgcggtacgcgagcctgccgcgggacgggcttcatggaattcctcaatggtgccccattgaccgcattcggggcagcggccgagccacttcgggccgctccagccgcattcggaacagaggaattgcgaggacgtctttgccatatcgccgacaatacggaggttttgggacaagacgttcgcgggtggcgtactcgttgcacagacattgcgctgaaaaccgtttcgggaactggattccatgacttcgaggggatggttgcgcgtcttatggctgtgaaagaatgacaagcatgtctgatacgcagaattcctcttcgcatggcaaattgattgccgccgtcgtagcagccgcgcttgtggttgtgcttgctttgatttccgcatttgtgtggcctggttgggccttgaacaagaacggacaggccggtcaggccggtcagacgagccagcaggcttccacttcgaacggtacggacggcgacaagacggagcccgccaaaccgtcgatcgatgccgtggcattgcccgacggggccagcgagctgctcaaggccatgccggattccgtattgaattacgcgcgtaccaaggctgacgccagcacgacgtggtccagcacctctcccgtcgaggaatacgcgttgacgtattccaccggcaagaaaggacaggacgtcacgctggaagtgggccagtggaacgacggcgacaaggcgaaatcccagtacgacacgctggctgaagccatgaccggcaaggagctgggaagcggcaacgtgaaggtttccggcaagacgaccggcgcctacagcgccaaagccgatccggacgacgataccaaggccgttgccgtgtggcgcaacgatacggtggttttctatgccaccggcgcgaagaacgacatccagcgtttctaccagcagttccccctgtaacgtcgacggaatcgtctcgatggcgaatcgcggccggctgatggaatatcacgcggaaaacgaaacgtgattttccaccatatgaatgtctgcgcgcgtattcgtccccgaagcagtgtagtattgggcaagttgcaaacttttaccctttgagtttaaggaacggaggctgagatgggctcggtcatcaagaagcgccgcaagcgcatgagcaagaagaagcatcgtaaactgcttcgtaagactcgccaccagcgcaagtagtcttcaggcgcgtgtgaagcgtccgctcaaacaaaatcccgcgattcctttcggagtcgcgggatttttgctatctgcgcggcggtgtcggccggtatattccacaccagccgacacgcctgcctgtcaggatctcacttgttggggttgtccatcacgcgcgggccgttcggatcgccgacgatgacctggtccaccatgttcaggaacaggccgtgctcgaccacgccgaccgtggtgatgaggtcctgcgcgagctcctgcgggtggtcgatgcgctcgaggtgcagatccaccacatagttgttctcatcggtgcgcaccggctcgccgttcgcgtcgagacgcagcaccggcttgtagcccttggcctcgaacttcttgacgacctggcctgcgccgaacggaatcacctcgaccggcagcgggaacttgccgatggtgtccacgaccttggactcgtccacgatccacacgatcttgttggagttggtggccacgatcttctcccacaggagagccgcaccgccgcccttgatgccgttgaagttcttgtccacctcgtcggcgccgtcgatggtcacgtcgatatggtcgacgtcatcgatgttgacgatcttgatgccgtagccttcggcctgctcctgggtgcggcgggaggtggtgacgcccgtgaactcgaggccttcctccttgacgcgacgaccgagctcgtcgaccaggaaacgcacggtcgagccggtgcccagacctgcgatcatgccgttctgaatcagctttgcagcctcgatgccggccgccttcttcagcgcgtcctgctgtgccttgtccatgatcctccttcgatatggggttaagaccgtctccatactatcggatgcgttgattttcaaggcgcgaatggttggttgcgggagcaggtgtctgttttggactgcggaaaagttttcacggaatgtttcacggtcctgcgtgaggtggcgtgcaaaaaaagacgcgcatgaaatgacatgtggggagcggcttgcgtaaagcggctccccacatgtctcgctcagctatgtttgaccgcgaacggcgcctcgtccaataccagcgtgccgtcacccatcacatagccttccacggcgatatacccacggatgagacgtggattgccgtcgaaggtcgggctggattccggtgggggagtgaaccgcaccgtacccgacaccgacaggcccgatgggcttggacgatgcggcagtttcggcagatcctgcgattgcgatgaagctgcctgttccggtgccgattcttcgtcgtcttgcgattcgctgcgcgattcgttcgcattctgcggtacggccgtgctgtccgtgtccgtgccgtccgcgttgccagtcaccggcttgtcgttctcgtcgccttcacggggaaaatagtcgggtttgaccagcatctgcgcataggattgatgcggttcaccggattcgtccgttttcccggattcgtccggttcggctggaccgcccgcgtccgggaagctggattcgggtatgaccttcgtcgcttcggtctcaagcattgtggtggtttccgccggttcggtctcgagcacggtcgtttccaccgcatcatctgcgtcgtcatcggttgtctgtccgaaatccgcaaggtcgtgggaaacgccttccggctccgccagcatgctggcgatcgaacgcggcttcgtgctgttgctggaattggcggtatcggcaccggaatcgccggtgccggtcgtggcggaatcgccttgtccgcgtcccatgtggtattcggcggcgctgatcgcaccatccatcagcatcctcgcatcctcgggaacatcggtgccacgcgaatactcggaagccagcagcgactgccatccttccaacggcagatagccttcgcgcacatgcgaacggcaatcgcccgcatacgtgcgtgccagctcgtccactttctcgttgcccgcgttgccggcatgacccttgacccacacgaatcgcaccgaccccgccctatgcgcgatctcattgtcgatggcgcggatcaaatcggcgttcttcaccggtttcttctgcgaattcttccagccgttgcgcttccaaccctgcacccacttggtggagcagttgatcgcatactgcgagtcggtctcgatcaccaggtcttcggaaccgggatgcgctcgcaacgcctccagcacggcgcataattcgccgatctggttggtgccgttcgtcgcgccgccggcatcgcaatcgccggcatgctcgtgccccggcttgccgcctgccgcgggctcgtggtcggcccaggcccaacccatcggaccattcggattgccaagcgcggaaccgtctgttgaaaccgtaatcgtcatgcttctaccctacgaaagccgcgcgactcgccgtttgcccgtcataccgcatcgtccgccatgcggtatcgcctatcgataccgcatggcaacggcatatgcgattagtcgccgagacacagcatgacggaggcgcggaacatgccgtcgctgtgctcgaaggaggccgtgccatggtgccgttcggccgtctctcgtacggtggcggtgcccagccccgtgccaccatgtttggtcgagacgagatcgccgtcgatctgttcgatgctggtatcggcttcgccgtacgtgttgtccaccgtgatgaacagggccgccggagggccggaacgataccggatgcgcactttgagccgcctctcgccctgcgtttgctgggtgatggcctccgtggcgttctccagcagattgccgaccatggagcataattccgcgttgttgatgttgatgtattgcggcaccgccgctttgacgtccacatccgcacccaaatgccggacccaatcgcaatagtagacaagcaccgcgttcagcgacgcatgctcgcaatactgcattggtgccggttgcagcagccggtgtttggacatctcatccagatatgagcggatgccatccatgtcttcagccgcggccaacgcctgcagtgagtggatgtggtgacgcacgttgtgcttgatctgacgcgcctcacggatccgctcgttcatgtgttgcagctgcaacgtctgcaaagcctcataatgctgtcgcctgcgggccgcgagcagacggtccgactgctgaatcatgtaccagatgaggaaatacgccaacaccatgaaacaggaatagaccaccgccacggtgaacgcgatttccagcatatgcgagtccagcagcgtggaattgtccgccggcatgcaccacaccacaatcgcggacgaaacgaacggaaacagccagataagctgccagaagcctttgctgatggatggggaatcgaatgtggctggaatcgaatcatgcagcggatgccaaagcgagaccagtgcgatgacgtcaagcagcagcagattgaccagtcccggccagccgacgcggagattggttgaatccgcgccaagaacggccacatcgatgacgagcgacagatagtagacgatcgccaccatgtaggaagccgtggccacaatcagcaacagttgccgccatggcagttcggtcagccatcgcaggaccagcagcacaagcggcgcggtcggaatgaccgtccacagtgatgggatgcccagagtgccgcacagcacgccgcatagcaggaaccagaccagtccgatggacatgaacagtgtgccgttacggcgtggattgtccatgtgactccatgccatgatgaggcacaatgccaggccggacaacgcgttgagctgctctccgatggcgaagaacagacctgacggggtggtttgggcgatgccgttccggatgatttcgccgagtggtgcgaacatgtcagtcctccgtacgcatgcgggtgaacgtgtattccgcgtatgcgcggcaggtggtggtcaccgccgttttcgtgatgggaatgcgtttgccgcctttcatgacgaactgcgcgttggtgatgccggacacgtagtcgaagttgacgagcacgcctcgcgcggtgcggtagaagttgtcgaacacggtgagccgtcggtccacatcggagaaattggtgcggattttggtctgggtgccgtccgcgaacgtaaattccacgtagtgcgcgttggacagggcgtatgcgatgagccgccggtccatggtcacggccggattgccgaacgccacatgccagctggaatccaccgtgccgggcgactgcgcctttgccagatgggtgaccggcggttttgccttcagctgctcctcgacgcgttccatggtggcttcgaaggttttgcgattgacgggcttgagcagataaccgctcgcctgcacctcgtagccgagcaccgcgaaatcggtgctggacgtgatgaagacgatcgcgcagtcgtcgttctgattgcgcagcagccgcgctatgtccaatccggtggtggcatgcggcagattctcgtcgctgagataacagtcgagcagcagcaggtcgtaacggctgttcttccagctttcgatgaacgatttcgcgtcggggaaaacgtcacagaccgtttgcatggcattcctgccggcggttgcgccgacgttccggccgttgaagtattccgcgcacatggtggcgatcagttcgcgttcggcagggtgatcctcgacgatggcgatgcgcacgttccctccttgctgtgccgtgattgcgcggatgacgttccggctctgcttccaagcgtaccgggagagggaaatacggggtgccgcggagcttgcgtttcatgccagaaaagcacgtttcgtgccatacggcggatatcgacaacgaaaaagacccgctccatacggaacgggtcttttcgcgctacgccttgattacttggcggaacgccgtatcactcggccagagccttgtccacgacctcggtggcctcggcgagcaccttgtccagagcctcaggggattcgaagctctcggcgtacaccttgtagatgttctcggtgccggacggacgggcggcgaaccagttgtccttggtggtgaccttcagaccgccgatcttggcgtggttgcccggagcctcggtgagcttggcggtgatgtcctcgccggccagctgggtggcctcgacgtcgtcgccggtgagcttggcgaacttctgcttctgctcgagggtggtcggggtatcgacgcgcttgtaccagctttcgccgaaacgctccacctgctcctggtgcagctgggccgggttcttgccggtcttcgcggtgatctcagcggccagcaggtccggaatcaggccgtccttgtcggtggtccacacgcggccgtccttacgcaggaaggacatgccggagctttcctcgccgccgaacgcgacctcgcccttgaacagcgggtccacgaaccacttgaagccgaccggaacctcaacgagcttggcgtcgatggaagcggccacgcggtcgatcagggaggaggagaccagcgtcttgccgatgccggcgccttccggccagcccggacgattgccgccgaacagatactccacgcacacggcgatgtagtggttcgggttcatgacgccccagttcgggcagacgatgccatggcggtcggcatccggatcggtgccgccgaccagatcgtacttgtcccaagcgccgttgttgagggaatcgaccagacccttcatcgcgtacggggagctcggatccatgcggatcttgccatcatggtcgatggtcatgaagctccaggtcgggtcgacctgcggacgcaccacgtcgatggtcaggttgaacttctcgttcatcagcggccagtagttgaccgaagcgccgccgagcgggtcgatgcccaggcgtacgccggaggagcggatcacgtcgaagtcgatgacgttctccagatcggccacatagtgctcacggaagtcgaaacgctcgaccagatcggacttgacggcctgctcgaacggcacgcgcttgacgttcctgaaatcgccgagcagctcgttggcgcggtcggcgatggcgttggtgacgtccgccggagccgggccgccggtgaccggatcgtacttgaagccgccatcggtcggcgggttgtgggacggggtcacgacgatgccgtcggccaggccttcgccggtgaagcgctgggtgccgtcggcggcgcggttgtgggtcaggatggcctgggatacgaccggggtcggggtgaagtcgtcacgggagtcgatgcgcacggtcacgccgttggcgacgagcacttcgatggcggtcttccaagccggttcggacagggcgtgggtgtcgcggccgatgtacagcgggccggtgacgccggccttcttgcggtattcggcgatggcctgcgtgatggccacgatgtgggcctcgttgaatgaggtcttcagggacgaaccacggtgtccggaagtgccgaaggagacgcgctgctccggaacgttcgggtcggggacgacgtcatagtactttccaatgacctcgtcgacattgatcagatctgctggggtggcgggcattcccgcattttttgcaaccataccttcattgtgccacgagtttgcgcggaacgcggaaagccatcccacaatgtgcgatgaatacgttttctttttgacgtctcggcgtgtctccagtatggaattggggtttcagtgtcccgatgcccgacgatttgcgcatcgcacgccgatagtgtatcgtttctaacgaattcgactcatgcagggttgcaagtcaacatttttagacgcaagacctggaatgtggcattggtttgccatgttccgggtctttttttgttgcaaaaaagccgcgctgcgtcatcgaatcccatcggaaggaaatagaaaggaatcaggatggctgactctctcgcatcgcagatcatcactgcgatcggcggacctgaaaacgttcgcagtctgacgcattgcgccacccgactgcgcttcgagctggcggacgcgtccaaggtggaccagaacgccctcgaacatatgaagggcgtgcttggcgcggtcccgcaaagcggtgaccgtttccaggtcgtcatcggcggcggcgtggccaccgtatacgaaaacatcatgcatctgcccgaaatggcgaacgccggtgccgcctccgcatccggcgaaggccagaagagcaacgccgacgtcaaggccgaggcccgttccaaggcacgcggcaaggtggcatggctggactccttcttcgagtatctcgccgactccttccgcccgatcctgggcgtgctgctcggcgcctccatcatcatcgccctggtcaacctgctcatctcactgaacgtcattccgaatgacgaggcctccgccggctgggtgttcgtcaaggccatctggaagggcgtgttctacttcctgccgatcatggtcgcctacaacgcctccaagaagctcaaggtcgatccgtggctgggcggcgccatcatggccatcctcatgaccccgcagttcaccagcctgatagacgccaagaccaccacgtgcgtggagaacgcggctctgggcaccaagtcctgcaccgccaacatcttcggcattccgatggcgttgagcgactacagcggcaacgtgttcgtgccgctgctcatggctgccgtgctcgccctcgtctaccacggattgaagaagatcattcccgaaagcgtccagctggtgttcgtgccgttcttctgcatgatcatcgtcggcgcgctgaccgccttcatcatcggcccgatcggcgtgtgggtcggcaacggcctcggcgtcggcctggcttggatgaacacccatgcaccgttcatcttcgccatcatcatcccgctgctgtacccgttcctcgtgccgctcggcctgcactggccgctcaacgccctgatgctcatgaacatccagacgctcggctacgacttcatccagggcccgatgggcgtgtggaacttcgcctgcttcggtgccaccgccggcgtgctcttcatcgccgtgcgtgacaaggacaaggacatgcgccagaccgctctcggcgcgctcgcagccggcctgcttggtggtgtttccgaaccgtccctgtacggcatccacctgcggtacaagctggtctacaagcgcatgctcgtgggctgcggccttggtggcgtcgtcattgccgtcctcggctggctcttcccgtccgtcaccgccgccggccagaccgtgcatggtgtgaccaccaccgccttcgccttcacctcgctgctgaccattccggtcttcgaccagatgtgggtgtacgcggtgtccatcgcggtctccttcctgacctccttcttcctgatcatcaccttcgactaccgcaccccggaacagaaggctgaagtgctggcccgcgccgccgccgatcagaaggccgccgctccggcggtcgaagccaaggaagccgctccggctgccaccaccgccaccgcgactgctaccgccaccaagaccgaagctccggccgctgccgccgccgcgaccaccgtggtgaacgctccggtcgccggccacgtgatcgccctggacgaaaccggcgatccggtgttcgcctcccgcgcgctcggcgaaggcgtcggcatccagccgaccgacagcgaggtcgtggccccggtctccggcgtgctgcagaccgtcgccgaaaccggccacgccttcggcatcaaaaccgatgacggtgtggaagtgctcgtgcacgtcggcatcgacaccgtgaagatgaacggcgagggctttgtcgtcaaggtcaaggccgatgagcgcgtgaatgccggcgatccgctggtttccgtcgactttgctaaagtgaaggacgctggatacagcaccaccacgctgatgacggtgctcaacaccgccgccctcacctccgtcacgccgaagaccggcatcgacgtcaaggcaggggacgaggtgatcgacatccagcgctaacctgtcacacagaggcgaaaaaggggtcgacgtggacgttcttcgcgtattcaacaacaatgtcgtattggctagagacggtgatcgtgaggtgattctcacaggccgtggaataggcttccaagccaagccgggacaacatgtggatgacgcgaagatcgtccgtcggttcatccccgtcgatggcaaggatcccgaccacatggcgcaacaagtggccgggatcccgcccgaaatcatcagactcgtcacggacgccatgaaccgtacggggctgaaagaacaggcagacaagcagccaaccctggtcatggcgctcgccgaccacatctgcggcgcgatacaacgcgcgcaaagaaaacagaacatcgaatatccgctcgaagcggaagtacgttccctatacgccgacgaatacgccaaaggcgtggcgatggtcgacgcgatgaacacgtatttgggtggcgcgttgccccgcagtgaggcggtggcgctcgccttgcatttggtgaatgccggattctccggcggcgacctgtccgccacctacaccatgaccggcatcatccagcagatgatcgccgtcatcgaaggcgcgtacggcatcacgcttgcgcaggacagcgtcaatgtggcgcgattcatcacgcatctgcgttacctgttcgtacgcatccaccagcatgagcagctcgacgatgagccgcaaccaatcatcgaatcaatcaaaacctcatatccgaaggcttgccagtgcgcaaggcagcttgccgtggtggtgaagatgcgtcttggttccgaccttacggaagccgaaatcgcctatcttgccctgcatgtggcgcgcgtgaccaacggagtgaatcggcaggtcgactgagtttccggtatcttccgatattcagcagcccgttccgcgcattcctgacggttcctaatcgttcgactgttcggccggctgcccgcttgcctgttcggtcggctgcggtttcgttggcgtagccgacatattcgcgttcaacgccagtatgccggtatcttcggaagcggcctccggcacgcgcacgcatagggcctgacgttccacgctgaaacggatgtgcttcgtttcaggcagcatatcgccatccacctgcgccaaaacaggcctctccaaagtgatttccgcgctgacgccctgtacctggtcgacggtggagttcgtggacagcggactctgctgagctttgccggtgatggtctggtgcagcacgtcgccgaacagattcgcccaaccgatcaggccgccggacgtgtcgatgatctcgtagtcgaggatgccatcgtcataggaagcttcgggcatcagcgaaaacatggggatctggccgcaattgcccgccatgaacgtgcggaacgtgagaccacgcgtggaatgcgtgctgccgtcggcgctggtgatggtcacattgcccttgtacttcggggcgaacagattcttcacgcccgacacgaaataagccagccagctgatgttcttcttcaattccggatcggtgtcgtcgatcatcagtgcgtcgaaaccgatgccggcgatgatgaggaacgcatgcccgtggtcggtggtctcatcatccagaagggtcagacggcccacatccaccagacgggagccgtgcgacgtggccacggtgagcgccgcatcgatatcgtccacgggaatgcccatattgcgggcgaacagattgccggtgccgatcggcacgatgcccagcgcatgcccggtacccgacagcgcgctcgcgacggtacgcaccgtgccatcgccgccgacagccaccaccacatcggcaccatggtccaacgcttcgaacgcgcaggcgcgaccgtccttgtcgagctgcgtttcgatgaattcgatctgggtgagatgcttcgcctcgcagaactccttgatatgctgcttgcgctgttccgcctggggctttgaaggattgactatgaacgcgtaatgcacttggtcatcgtcacgcttgtcaagcttctccgcgagcgtacggtgcttgtacgcgcggtatccgaagaaggcggccgcgcatacggcgaccacggcgatgatgacgagcaggacgataactggcataggcatgcctctattgtctatgcgattgcgcaaaaagacgaattcgacatgaaaaattcggcgttccctcacgttatatccaaaaatgagaacgatggcgtcagtgtctgctttcggcactaggctgggaagcatgcttgatattcaattcattcgtgaacatgctgacgttgtcaaggaatcccagcgtaagcgtggcgaatcggtcgaactggtcgacgaggtgctgcgctccgacgaggttcgccgttcctctctgaaggaattcgaagctgcccgcgcgcagcagaaggagatcggcaagaaggtcgccgccgcccccgccgacgaaaaggccaagctgatcgccgcaaccaaggaactctcccagaaggtctccgaatacaaggccgcagccgacgccgcagccgaggaatacaccaccgccatgtggaagctgtccaacatcgtcgagccggaagctccggaaggtggcgaggacgactacgtcgtggtcaagaaggtcggccagatccgtgatttcgcagccgaaggcttcgagccgaaggaccacctgacgctcggccgcggcgtggccggtatcgatatggagcgcggcgtgaaggtcggcggctcccgcttctacttcctgcgcggccaggtggcccgcatgcagatcgccatgctcaccatggccgtcgaccaggccgaggaacacggcttcaccctggccatcaccccgacgctggtgcgtccggaagtaatgcgcggcaccggcttcctcaactcccacgccgacgaaatctaccgcctgcgcgagccggacgaccagtatttggtcggcacctccgaagtggcgctcgccggcatgcacgagaacgagatcctgaaccttgagaacggcccgctgcgctactgcggctggagctcctgctaccgccgtgaagccggcgcagcaggcaaggacacctccggcatcatccgcgtgcaccagttcgacaaggtggagatgttcgtctacgccaagcaggaggactcctacaaggagcatgagcacctgttggccatggagcaggaaatgctcggcaaggtcgaggtgccgtaccgcatcatcgataccgccgccggcgatctgggctcctccgcggcacgtaagttcgactgcgaggcttgggtgccgacccagggccgttaccgtgagctgacctccacctccaactgcaccgagtatcaggcccgtcgtctgaacatccgcgaacgtatggaggatggcaacacccgcgccgtctccacgctgaacggcacgctggccaccacccgttggctggtcgccattctcgagaaccaccagcagaaggacggctccatcgaaattccgaaggccatgcgtccgtacatgggcggcaaggaagtcatcgagccgaccaagtgggaagcctgattttccaagacgttcgcgtctgatatgaatccgtgaaagcggcgttggcatttgtgccggcgccgcttttcgtatgttggacggtcccagtgccgtttgtgtcgttctgggcagatgcgtgtgcggttttctgttggaagcgacggggatggaggctgtgccaggtgtcgcacttccgcgcactgtggtatattggcgtttcgtgcgtagcagcgatgttaggcgcaaagggtagatgtctgagcggtctaaagagacggtcttgaaaaccgttgaggtgcaagcctccgcgagttcgaatctcgctctgcccgcaccaatcaagggcttaccgaaggatttttcggtaagcccttttccatgccgtttatggcgattgtcgttgtcgtggcggcaacgtcacacaatccgtcgatccgcggcccaacgggtgagctcggaacggttcgacagctgcagtttgcgcagcaccgagctcatatgggtctccacggtcttgatggagatgaacagttccgaagccacctccttgtacgtgtagccgcgcgcgatcagccgcatgacctcctgctcgcggttggacagccggtccagctcgtcatcgtggatcgggccgccgaacgcgccgttcgcgctcgggccgttctggaaggcggacagcacgaatcccgccaatttcggcgagaacacggcgtagccctcatgcacctgcttgatggaggacaccaggtcgtcgccggaaatagtcttcgtcacatatccctgcgcaccggcgcgaatcaccgaaccgacgtcctgcggcgaatcggaaacagacagcgcaagaaacacggtattgggggagtaaggccgtgatttcgtaaggatttcggtgccgccgccgccctcgccgcccggcacatgcacgtccagcagcaccacgtccggtttggtctgcgcgatcatcgccaccgatccttccacatccgcggcctgtccgaccacgtcgaaatgcggctgcaacgtggcgatcacgcccgcacggaacatttcgtggtcgtccacgacggcgattctgatgcgctgttcccactcgctcattcctgctccttggttcgattgattcattgccgcacctgctgcatgtgccgtgttcattgcgccgattgcacgcccgtatcgccgtccgctgtggtggtcgtagcgctgtccgcatcctccgccgctcctgaaatcggcatgtgcatgcgcacctccgtgccccagccgggcctcgacacaatctccactgtaccgccgcggcgcttgatacgtccgatgatggactcgcggatgcccaggcgattcgctggaatggcgtcgacgtcgaagccgtcgccatggtcgcgtacgaacacctccaccagcttgtcgccggcctcgcagtagacggacaccggttcgccgccatgcgtcacggcgttgacgagcgcctgctgcgtggcatccaacaacgcgtcggtctgcgcgctcggccgcgcgtcgcccaccgtcaccacctcgatcggcttgccatgcgtgtcctccacatgcgccgcgatctgcttcaaaccggcgttgacggaacgatccgacgtggtgcgctcctgatatagccattcgcgcaactcgcgttcctgctgcctcgccagtgaaaacacggtctgctggtcatcggcatgcaactggatcagcgccagcgtctgcagcacgccgtcgtgcaggtgggcggtcatgtcggcgcgctcctcctcgcgctccttcagcgcgcgctccgtgcccaaatcacgcaccagcgtcataatccacggcacaatcgccagcaacacgccgacaagcagcgccaaaccggcgacgagcatggtgaacgtggcgtgccgtgcggactgcataatgcgcacgtgggtggcgatgtagatcgcgtacgcgacgaaaatgaccgcgatgccgccgagcatcgtccataattggccgtccttcgcgttgaaccgcagccaggagacgccgacgccgaccacgccgagcagcaacggcacaatcagcgtgccttcaatgcctttcgccgccatcgccacgcataggcccagcataagcagtcccgccatggccagcagcgcgggtctcggcgcgttggcgaacatctgttccaggctttcggacgattgtgctccgctgccggattgcatgccgtccgcgttgccgtcgctgtcttgcgattgcgcgccgccgtttccgacgttccttaggtttcttacgttcctcacgttgccgtgggacagcggcgcgttctcgacgggctggctgccggcgatgacgtacgcctgctggaccgggtctccgacgggtacggtgatccacagaaaaatataggcgatcgcgcccgcaccgaagaaaaacgtggtgaccacgaaaatgaaacggatgagatgaacggacacgcccagatgtatgctgatggccttggccacgccagcgacctcgcggccgtacgtcgggcgcagcaatggcagtcgcgccggcttggacggcacgggacggccttcgcgcagggcctgttcgtagcaccagcgcatgtagaccgcgctggcctggtcgtactgttcctgcgtgtaccgcggtttggctaaggacttcatgcttccattgtgccctgtcggggatgccgattcagggctttcagctggtgttcagggcagattcagggtgttccccgatacgtatgacggctgcggattgctgtaatggagatatgagcaacgcaaacaacaatccgcaaggcggcagtgccgctggttctgccgaaccgcaatcgcagccacggccgccgatgtatcagccgcagccgaatcgcggcaatcgattcttcgcatggatccgctccagccggatcacgcgcggccgcaaccggtggatcgcaggcgtgtgcgacggcgtggcgcgccgcttgggatggaacgccaccctggtccgcgcgctggtgattctcacctcgctactgttcggcgccggagcggcgttctacgcattggcttggttcctgctaccggacgagacggatggccggatcctgtgcgaggagctggtcaacggccattgggattggaactgcgcgggcgcgctggtatgcgccgcggtggcgctgtgcctgcccggcgccggatggctggcgttcggcgtggccgtgctggtgttctggctgctggtgaaccgccagtcgtatgcggcgagctggcagccgccgcagcagggcggatcgtggcctgggcagcctgctcagcccgttcagccgggacggccggtgcggcctgcgcaatcgcaatatatgccgcagccgatgtccacgaacacggccaccactgcaaacatgcccggcacgccaggccagccgatgccgcagccgacgtgtcccgcgccttccggctaccagcagtacgcgcgtcccgtccaatcgctataccagacgtttcagcagccggtgaacccgcctgcagcgtttgccacggccaatgtgccgccgaccttcaccgttccgccgacggtggcggcgccgcagtcgaaacgcgcccgccgcaagccagccggaccgctgctggtactggtgacgcttggcttggcattgctggcgatcgccggatctggctggtacgccattacgatgccggttgattgggattacgccttgcgcgtgctgcgtctcgccacactgtgctgcggcggcatctgcctgggaatcggcgtggtgatcgtcgtgcttggttgcatgggccgtcgcaccggcggcctgcatccgctggcatggtgcgcggcgttcatggccgtggtgatgacgttctgcacgagtgcggtggcatgggaaagccgcgattggatgatgtcgaatgactaccaccgcacgacggtctccggcatcgtgacatggagcgacaccagcgacgcccagatgaaacgatacgaacagggactggtggtggtcggcaagaactacgccaacgatgtgctcgacatcgatttgagcggatatccggcagcgcatggcaagcacaaggtcaagctcaacgacggcacgtacggcgaaagctcatgtccgacagggaagctgaatctggtggtggtgaacgcccaggtggtggtcacgctgccggacggatgccagtggtcggtcagcgatccggacgacggctacaccaacgtcacggattacataggagggccggacgggattacgttcttcaacggcacgggcttcatgggcctgtccctcgacgagaacgatgattcgggactcggccatcatggcgtgaacaagggcgttccggcgctcaacggcaccaccgatttcgacgattccggcgatgatgatgcgggcgatgccggttcggatacggagaacgattcgcaggattcggtatacgccggcacggatctcgacaaggcattcaaaacgatctacgagaacaagtggtattggccgtcgatcgattcggacaaggctccggaggaaccggatctgtatgtcaacgtcgatggaacggtcggcggcagtgtcaccatgcagtacacgtccgacagcaagctgccagtgggaacgacgggcggccaatcgcatggcagcgtcgatggaaagaacgtcgggaaaagcgccagcggaaaggaaacgaaatgagtgacgagaaaacccgtgaagtgccgttgaccgacgtcatgggaatcgcggaggtctcggacgagcccacggaaaccctgccggccgtcgacgatccgggcgaggcgaagaccgaatcgttccagaagccgttcgacggcggtccggaagcgcagaggaagttcgaatcgcaggacgaggccgaatcgctggaaacctccggacaagacatgcgcggaagctttgcgggccgttcggcacgtccgaccggttccgtcaaatcggctgatccagccaaatcagccgagccggtcgacccctccaagcaagtgcgcatcggcaaaacggacggcgagctggtaatccgcccgtccggaccaagcaccggaaccatcgtgctgggcgtgttcttctgcctgatcggcctgatgtccatgctgtgcctgctgcccatcggcgcatggcggtggatgccgaatccctcgacgctgttcttctacgtggtcggcggtctcggcgcgctgctgctcatcatttccgtggtctgggccgtcgtcgccgcggtgcgtctgcgccgacgggaacgccagtcagcagaacagtccccagaaagccagcagcgccaacgatagcgccgccgacaccaccacacacgtggccacgatgacatggccggatccgatgcatgcttttccatcttttcctatatcgcatcggcttccggctgcggcatcgtggccattattcatatccgcatcgtcatctatgcttgcaatcgcgcgattcctagcatgacgacggcacgcgtccacgatgatttccgccaacagccaggcgaacgcgacaaggctcagccatgtgagcatgacgatggcatgccagttcttggcaagcgccgccgaattgtcggtcaacgagatcgcatcaatgatgacggtgaccagatacgccaggaacacgccggtcgtgccgacggcaaggagggtgttgagcgccagtgcgacgcgcatgccgaccgggaatcgatggtcggttattgcgattggacgtgccgcattcggttgtgtggatggacctgtcggtgtggtcgcatccgttgaaaacattgaagtcgaatccgttggctccgccggttccgtcgaagccgaatcgtgcgatacccgccgtgacgcacggcgctcgcgcacccagccggcgatgagcagaattggcgcgccgcacatcgccagcagcgcgcagagcaggcaaaccgcgattgcgccgacaatcacacccatcgacttcaccagcgcgggcggggtcttcagcggtgccgcgaccgtctgattcggctgcgttccggcgatcatcggcgttgcccagccgttcgcacccgtgccgctcgtcaccgcgttgatccaatcctccagatcgtgcgtgtaatgcggttccaacggcagtcccggaaccgtctgattcgaaccggttcgaagctgatggttcgcgtcataataccgcagcgtcacattcgtattgccagcctggtttgcggctttgatcagcagccgcgcgccctgttcgaccggcatggctgtgtccttgacgccatagttgataagcagcggcatggtaagcgatgtgcggtatttggccgcgtcgaaatccgcataggcgagtcccatgcgttgtgtgccaaggctggtgatgcgcggaataagctgcttgacggcatcgggtgcgcccgcggcggtcagataattggtggctgcgagcgtcatctgctgacggcccgaaacgaccgggggagaggtgaggatggcgaaggcaagatccggatgctgttgcgtcagcacggtggcgatccatgtgccttccgattcggcgtagatgccggtttccgatctgctcacgcccggccattttctcaggatttccagcgatttcgcatagtcgtgcgcgctggacacgtagtcgcggtgcagcatggtgtagttgtcgagccgcttgtccggcacgagagtggtgatgccggccgacgccatcgcgttcgccacgtcgccgaacgcctccgacgatttgccggtgcccgaaccgtgcaggaacaggcatgcgggatgatctgccggcgcgtcgagcggctcgcgaacgatggcattcacggttttgctgccgtccaacgcgaccgtgatatgcgtttccttggtgcggtacgcgccctcctgcggggttttgagcacggcacctgtggcctggtcaacggcttggatagcggtattggtcgtggtgagcgtgatatggtccgtgaacggctcgacctgccatttcggcgccatcgcattgccgagcgcgcataggaccatggtcagaagaagcgccagcgcggtagtcgccgcgcaggtgacgagaattcgtttcacaatgcttcgcacggtacgccactctagtcgtattcggcgtacgtggcgcggaaaacacggaatcatggggaatccgcggaacgatcgcaattcctgcgccgcgagtcaatgctcccgtgccgtaaaacaatacgaaatcaggggaaaatcgcaataatcccctccacaatccacctgtggatatgtggaaacccgtcggtttcgccgcacctttccgccaaaccgacgctgagcgtcctccagccgtcggtttgatattgcgatttccgccaaaccgacgcttaggccctcctcagcgtcggtctcgcggattgggggcgatgggatcgacgctgagatgggatttgggggagaaggatgggaaggttgggatggggctaggcgcgggcttcgtagcgacgggtgtagagcaccagcaggatgacggcgagcaggctgatcggcgcgcctgcgatgccggtgaaatggtaattcatcgccgtcgcggtcagtgccgctccgccgacgatggaaccgatcgcattgccgaaattgaaggcgatttgtacggcggcaccggcaatcagctcgccgccgccttcgcccgcctgcaccatcagcagttgctgtggcgatgaattgaagaacagcgcgaaaccgatgatgaacgtcagcaacgcggtggtcgcatgattaccaggcaacaggaagaccagcaacagtccgcacaaggcgatgccgtgcgatagcgccgcggtcgcgcccgccttccacaggtcggtcagcctgccgcccacgatgccgccgaccaccatgccgaggccggcgagcaccatcagcatcggcaccatcgtcgccgaccatccgccggttttctgcaaccacggcgacacgtagctccaccagcagaagatgcccgaattgccgaagaacacggccagcagaatcagccacgggccgggatgggtgaggaagcggaactgccccttgatgccggcgtccttgatcggatcgatggacggcacccacgaaatcaccacgacgatcgtcataagcgcccaggcggccagaatcgcaaacgccagccgccaggacatcgcctcggcgagcaacgttcccgcgggcacgcccagcatgttggccaccgtctggcccatcaccatcatggacacggattgcgcctccttgcccttgtcggcaagcgttttggcgatcagcgtggccgtgccgaagaacgcgccatgcggcaggccggaaatgaaacgcgccaccagcagcatcggcgagcagaaggagacggcgctgagcgtgttgccgaccaacgcgatggccatgaacaggatgatgagatgcttcggcggcaccttgcggccgaacaccaggatcagtgtgccgacacacacgccgatggcgtatgcggagatgtaatggccggccgcgggaatgctgacatgcatggcggtggccgtctggggcaggatgcccatcatcacgaattcggcggcgccgaggatgaaggcgccggaggccagcgccagaatgcttctcttcatggggattccttattttggattgtccgccgaaccagcacttggatggtgccaagcgtcggttcgatattgcgattcccgcgaaaccgacggtgagacggtgccaagcgtcggtttgatggaaaggcaaagaaaaaggcggaaccgaagttccgccttagttgtcgggctggcgggatttgaacccgcggcctcttcgtcccgaacgaagcgcgctaccaagctgcgctacagcccgtttggcaacagttggatatattacacgattgggcgctgtatgcaaggtcggcgtgtcgcgtgttgtgtagtggcttctcggtacacttggggcttatgactgagaccaacgaatcccaagagaatcagaacgaagaagaggccgcagttcccaccatgaccacggtggaacgcgccgaaatgctgctgcagcaggatgctgcgattcgcgccaagatcaacggcggcgccgcgctggacgaggccgtggacccgtccaataaggaattcggcccgctggcccacccggaacaggtgcagatgcgtgtggccaagcgcgccatgatgcttaaggaaggcatccagccgtacccggtgacccttgacgtcaccgccaccatcgaagaggtccgcgccaagtatgacggcaagctcgaagcgggcgacgagaccggggacgtggtcggcatcgccggccgtgtgctgttcctgcgcaacgcgggcggcctatgcttcgtgcagctgtccgccggcgatggcaccaaaatccagggcatgatctccaagaaggagatcggtgccgactccctgaagcagttcaagcagctggtcgatttgggcgaccacctgttcatcaagggccgcgtgatcgcctccaagaccggcgaactgtccgtattcgccaccgaatgggccatcgccgccaaggcattgcagccgctgccggccctgcacaaggagctcaacgaggacacccgcacccgcaagccgtacatcggcatgatcgcggacgagaagatccgcaacatggtgcgcaaccgttccaaggccgtcgcctccctgcgcaagaccttcgccgaccatgacttcctcgaggtcgaaaccccgatgctgcagaccgtgcacggcggtgccgcggctcgtccgttcaccacgcacatgaacgccttcgaccttgacctctacctgcgcatcgcgccggaactgttcctcaagcgttgcctcgtcggcggcatcgaccgcgtgttcgaaatcaaccgcgacttccgcaacgagggcgtcgacgccacccacgcgccggaattcaccatggtcgaggcctaccaggcctacggcaactacgacaccatcggcgcgctcgtcaagcagctcgtgcaggacaccgccatggacgtgttcggcagccacaaggtgaccctgctggacggcaccgaatacgacttcggcggcgaatggaagaccatcagcatgtacgactccctctccgaggccctgggcgaggaaatcgtgccgaacggcggcccggacaaccccggcacctccgtggagcacctgggcgagatcgccgacaaactcggcgtggaacgcgacgacgtggagaaccacggcaagctcgtcgaacacctgtgggagcacttctacgaggacaagctgtacgagccgaccttcgtgcgcgacttcccagtcgagacctccccgctggtcaagggccaccgctccaaggccggcgtggtcgagaagtgggatctgtacgtgcgcggcttcgagctggccaccggctactccgagctcaacgacccggtcgtgcagcgtgaacgtttcgtggcccaggccaaggatgcgctcgccggcgatgaggaagcctgcgacatcgacgaggacttcctggaggccctcggcgtgggcatgcctccggcaggcggcatgggtatgggcatcgaccgactgctcatcgcactgaccggcgccaccatccgcgagaccatcaccttcccgcttgtgaagccgctgaactgaggcggagcctcagttcaatattcggcttcacgcgaggcggtcgaagaggaagccctgtgggcttccgtgccgccggagccatccttaaaaaataaaagagcaattactaaagggcgttcccaatacgggagcgcccttttgcataccctcgcacacccaacatctaacatgagattcatggaaatatcgacttggattcgcggcgctcgcctgaaaaccctgccgctggcgatcgccccagtggttatcggggccacgctgtcgtggcggggcgtgtttctttactcgcagggtggcgatatatggcatgagccgtgtccgttcttcggcgggcagcatgacttgagcgaattgaaattcggctcgctggtcggcgaatgccagcgttccgcaggctggttcatcttggtggcggtactgtgcggttgcgtggcgttgttcctgcaggtcgccgcgaatttcgcgaacgactattccgacggcatacgtggcactgacgaggggcgtgccgtcgattccgcacggtcatttgcaaaaacaccatccgcggaatcgacttcgactccggaaatgcttccggcatcgcagccccagcatggccccgcccgtctcgtcgcgtccggcgtgagtccaaagaaagtacttgccgtggccggaatcaacgcgctgatcgcctgcctgtgcggtctggctgtcgttacattgaccggctactggtggttcatcctggtcggtatcgcctgtctcgtggccggctggtgctacgtcggcggcaaacacccctatggctaccactatttgggtgagatattcgttttcatctttttcgggctcgtcgccgcctgcggcacgatgttcgccctggccggcacaatctcgaccgaaggcatgctcggcggcgccaacgtcggcctcatcgccgtcgcggtcctgtgcgtcaacaacctacgcgacgtcgaaaccgaccgcacgcacggcaagcacacatggatgaccgctttgggccggcgcaacggcacggtttttgcgattgcgctgctgtccgtcgccgtgctgttgctcgccgcttatatactgctgctgtcgacgcctgcgatgccgacaatcgcaatactggcggtcacgtgcgcgatgtgcgctgccgccgccgtcgcgatcgcaagaaaaaaatacggcgaggcgctgccgctgtgcacgttctcctcactggcgctcgccgtaacgtacgtgtgttgcgtggtgtttgcctagcgctgcaacgacagtgcaacgaaatgaaaattgttgcaaaacgtggggcgtcaatcgtcggaaacggcttgttttgggtgtgccaagcggtagacttgcaagcatgacttacaaactagtactgctccgtcacggacagagcgcatggaataaaaccaatcagttcaccggctgggtcgacgtcccgctgaccgagcagggtgtcgaggaagccaagaacggcggccgcctgctcaaggagaagaacgtcctgcctgacatcgtcttcacctcgatgctgcgtcgcgccatcaacaccgccaacgtcgcgctggacgaggccgatcgcctgtggattccggtcaagcgcagctggcgtctgaacgagcgtcactacggcgccctgcagggcaagaacaagaccgagatccgtcaggagtacggtgacgagaagttcatgctgtggcgtcgttcctacgccacaccgccgccggagatcgatccgaacgacgagtacgcgcagaacaacgatccgcgctacaccggcgatccggttccggaagccgagtgcctggccgacgtggtcaagcgcgttgagccgtacttcaagtccgacatcgagccggagctgaaggctggcaagaccgttctgatcgccgctcacggcaactccctgcgcgccatcgtgaagatgctggacaacctctccgaagaggagatcgccaaggtcaacatcccgaccgcaatgccgctgctgtacgagctggacgagaacttcaagccgatcaagccgcgtggcgagtacctggatccggaagccgccgctgccggtgctgccgccgtcgccgctcagggccagaagtgagtttgttgcgattgggcgcgtgaatagtcgcggctgatcgcatgaaacacatacgaaaaggtgggaacctgtataccgtaggttcccatctttcgttattgccggcgcctttgtcggtaagtctttttcacgttgtatctgcgttttgctgatgtcgccttgcctgcgcggctcggcgggtgccgtgcggcgcaggcaaggcggacaaaacggaatcgcaagaacgtcagatcacgccgtattccttgagcaatgtcggaatatcagtggaatccagcttcttcacgatctgtttcaacacgcccctttcgatggggttgagcttcatatcggtgatcggtttgccgtctcgcagcatcaccgtggcgttgagcaggttgcgcacgtcgtagaccgaaccccacacctccggcacgccgcggtccacgtcgcacagcgtgtacacggcctccatgccggtgcgcatcgaatattcggtggtgaagatcgtgtcgcgcggcgtctccgcgaattggccgaggaatgcgaaattcaccgcgccatccggcaccacatcggggcggtcgccggcggaacgcggcatgaagaaggcatcgatgtacggcatcatcaccggaaccgtgttggcgtggttcttcgccaagtcggcgattttgtcggtcggcacgcccatgtggtacagccattcctcgcagatctcctcgccggtgcaatcctgcatcggcttcttcacatagttgccgggcttgtcggggaacagaccatacacccatacgcacagctggtccttcggctggtctcggaactgctgctggcgattcagcgtccagctcatcagccaattggaatcctcaacggtgacgatgccgccggtcaccacacgtccggagaacggatcgcgcttgcagatcttctggatgtatggcggaatctcgccgtccaacgtggtgacggtggcgctcatccacttcgaatgctccgggtcggagcagaacacgtccggatgtccgaagctcggatcctgcgccgcgatgcgacgccacatatcccaaccgccgccgggcttgatctccggagcccacgcggccggctcggtctgcgaacccatcgaggagttctccacgcagccgccattggtgatgaacaccagatcgttctcgcccaaatcgatgctgcgggtcgtgccatccgccttggtcaggtcgatgcgcgtggccatcttcttggtcggcgagctgaacggattgcgcggatacgcgccgtattcggcctgcttcctcaaaatcgtgtcctgcccggtgccggtgcgctggcgtacgggacccatgccgccgccaatcgcgaaatcgacgttctccaccttcacgttgtagtggaactgcacgccgaagccttccagatacttgatcatcggcagaatcatcgactcgtactggttgtagcgggtgaaccgcaacgcgctgaagtccggcagtccgccgatatggtggatgtagcggcggatgtacagcttcatctccaacgcgctatgccagttctcgaaggcgaacatggtgcgccagtacatccagaagttcgtatcgaacacctcatcgtcgaagaagtcggagatcttcttgccgtatagttcctcgttcggtgtgaagaacagctccatgatctccatcgacgccttgtcggacagcgcgaacttgccgttcgtgccgccgtccacgccgcgcgccttggtggaacggcacagcgaatagttcggatcgtccttgttgagccagtagtattcgtccaacacggacacgccatccgtttcgatggacgggatggaacggaacaggtcccacatcacctcgaaatggttgtccatctcgcggccgccacgcatcacatagccgacgccaggaatgttcgcgccatcgcaggcaccgcccggaaccgggtccttctcgaatacgtggatgtggtcgccgggcatctgcgcgtcacgcaccagatagcaggcggcggacagcgctgcaagacccgtgccgatgatgtaggcgttcttatcgtcgattccctcgggcttccttggccgggcgaacgcttcgtaattgccgttggaatagtacatgacttcctcctttggatgccgctgggcactattgtgccgcgtcgtgggacacaagtatacgggcatgaactggacgcgatgtctagtttttacgactatcggaggaatttcgcttataggtggcggattgcgcctgcatgcgaaagtgattttgcctatatgtggcagatttcttttggaaaaggatgttcggtggcgggatttttacccccttatgatgtttttggccgaggtcatctgccacatataagcgagatgggtggcttccaaacggaaaccacccatctcgtcaaggaaaatgcaagaagaggtgaggaaccctcagtcgatgtcggtgccttcgtcgcgggtcggctccttggacgggtcgaaaccggagacgatgaacatcacgcggcgggccgcggaaacggcgtgatcgccgagacgctccatgaagcggccgatcaggaccacgtcgatgagctgctggttggtgcccttccaatcctcggactgggccagttcgaaggtcttcttgtgcagagcgtcgagcttgtcgtcgttgagaatgatctgctcggcggtcttggtgtcgcggtcggtaagcatggaaaccacctggtcggccacattgtcaaggaacgcctgcatttcggcgaacagcggctgggcatcggccggcagcggggaagcaggataggtgcggcgggccgcttcggcgatgtgacgggccagatcgcccatgcgctcgaacgttgcggccagacgcagggtggagacgaccacgcgcagatcggtggccaccgggttctgcttggccagcagcttcacgcactggtcgatgacgctggattcgagggcatcgatttcgatgtcgccgtcgatgacggcctgggcggcttcaagattctggttcagcaacgcgtcgccggcaccattgattgccttgcgaacgtcttgcgccatgcggtcgaggtcatcggcgactgccttgagctcttcattgaagataacgcgcatatgcttgcctttcaaatgcttcacgtatgtcaatatcgggttcggatataacctctctcaagtgtattagggaagtggcggattcgcacgtgacggacgtgttgttccgccaatgttcaccggcacgttcaccctgcgttcacgaaaatcgcgccacgaccattcatcggggaacgtcagggtgtgcgagaatgaagacatgtttgaatccgtaggcacgtggtggcgcaatctgacacatcgccatggtgacgatcgcaacaatgatgatactttggacgacgcgacgaacacgttgctgtccatactgccgctggcctccatcgtggtcgacgagcatgacgaggtgatacgcgcgcatccggacgcctacgcccttggcgtggtgcgggacgacgccatcgccgatgacaccgtggcaagcgcggtgcacgaggtccgtgcccacggcggcaagaagcagttcagcctgaccacgaccacgttgcatgagccgaagaaggctccgaaagcagggaagccaaccatgcgggaggttgccaaacaggcgttgatcggccaatcgccggacaagccggtgaccacggtgtcccgcccgaactggctgaaggtgatcgtaggcaggctcaacgaacgctttgtggtggtgctggtttccgacgtgagcgaaaccgtccgtttctcccagatccgtgattccttcatcaccaacgtttcggagcagctcctcaagccgacgcagtcgctggaggagcttgcggacgcgttggaacatgactcggacaataaggccgcgattgaggggaacaccgtaaaactgcgccaatcctgcgctcgcatggaacatatggtgtccgacctgctgctgcttatcaaggcgcaggaaccgattctgccgacggcgagcaaccgtatcaacgtcatggaacaggtgaaaaccgtcgtcgacgcgcatcgcgacatggcgcaacggcgcggcatcgacattgaaatcgatggcgacgaatcactggacatcaacggggaaggcgagcagattcaggccgcggtcgcaaagctgctcgaaaacgccatcgcctattcaccggacggcaagggcataaccgtatccgtcaagccgaacgaggacggcaccaaagtgctgctcagcgtgcttgaccgtggttgcggcattgcgcagaaggagcaaagccgtattttcgaacggttctaccgtggcggcaaccagaatgggcattccgaggaaggcatcggtttgggtcttgccatcgtcaagcatgtggcgttgacccaccatggctccgcttcggtgtggagcgctccgggacagggcagcacgtttacgttggggctgccggtcgccagaaattagcggcgattgcagagcgttgggacacgccatatacggcaaagggccgcttccgcaggttggtgcggaagcgacccaatgttgttaccggttatttcgcgattggctgaaccgccggtcgggttattcgccaagacggcggtagtcccaccggtcgaaatgctcccaaaccagcatgagcacgccgatcaccgtgccggcggcgcacatggtctgcaatcgttcgacattgatgccgaaggccagcagaatcatgcagatcaccaaggcgatggcccataatgcggtgccgaacgtgaacaccttccgcaggtcgacgcgcaccggtttgggggagggtttgcgcacgcttgggtcgataatcggagcaaatttcataccgttaccttacctcggtgcgcgcgtcacaggtgctcggccacgtaatcgacgcacttcgtaagcgcctcgacgtcgctcggctccacggacggaaacacgccgatgcgcagctggttgcggccgagcttgcggtagccgttggtgtccacaatgccgttctcgcgcaacgcggcgaccacttgggaagcgttgatgctctcgtcaaggtcgatggtgaccacggcgttggaacgtgcgttttcgtcggaaacgaacggctgcgcgtaatcggacttctccgcccactggtacagcagcgacgcggaacgtgcgcaacgcgccgtggcccaggcgaggccgccattgtcgttaagccagcgcacctggttctccagcatgaccagcgtggccacggcgggcgtgttcagcgtctggtccttacgggagttctcgatggcggaggtcagggacaggaacggaggaatccagcgtcgcgcgcccggcaggctgacgcttttagcgatgccgtaggcgcggtcgatcgcagccggggaaagcacggcgatccacaggccgccgtcagagccgaacgccttctgcggggagaagtagtaggcgtcggtctggctgatatccacgttcagcgcgccggcgccgctcgtggcatcgatcagagtcagcgcgccctgctccttggaaccttcgacacgcttgaccggggccgccacgccagtggacgtttcgttgtgcgcccagcagtaagcgtccacatattcggtgagctccggcaggcgatacgtgcccggtttgcccgcgaagatctccggatcctcaaggaacggcgcggattgcgcggacttggcgaatttcgcgctgaaggagccgtacgtgccgaacgccgccttgcgggtgataagtgacgcgcaggcgatgtcccagaacgcgctggcgccgccgttgcccagcacgacctcatagccgtcgggaatctggaagaaattcgacaggccttcgcggatggagccgaccacctgcttgaccggggtctggcggtgcgaggtgcccagaagattgcgcgcgcccgcgtcgagcgcctggacttgctccggacggattttgctcggccccgagccgaaacgtccatcctccggaagcatgttggtaggaatgttcacagtgttcgtcatgtcatccaagggtagtcagaaggtcggattgcgcgttgatatggccgttttccggacgttcctccacccgtggcgaattatttgcgcaaggacggggtcttgatgataatccctatgtcggtgtacccttacccttgtgacggttctgtaaccgtgcgcggtcataagctgcgacggtttcgcaatccgcaaggagtgattaatatatgaggcatgcggcgcataaagctgccaaggtttcgcacgcgcaattcagcctatccaaggcgttgttcacggcgaaccggggctcccataccgctaaggccgtgcgaatggcacagctggcggaaggcggcgccgtagtcggactcgctccggaagtcgtggataagctgaatgaagtggctccaatgagccgccgtaccatgcgtgaggccgccaaagccgcttcccgcaaatccgcgttggtgacctccgcttcgttggcggcgcttgtcggcaccgcggcgaccgcgttggcgttcagccagcagaacgcatcccgactggtgcttgcggacgacggtaccgaaacgtcccagatcaaacgtgtgtccgatggagcggcatcccgttccgaaggacgtaccgcccttaaggaactggcttccaccagcaacaacggcggttggcagctgggagacaccagcgcctccatggacgccagcctgatgtccaagtccatcgccgacaatccgaacgtcgccgtcctgatggaccaagacagcagcgccttaccggctaacttcaatccgaaccatgccaccggagacgtcggcaacgcctacgagttcagccagtgcacgtggtgggtgtatgtgcgccgccatcagctcggtctgcctgcaggctcccacatgggcaacggctgccagtgggccgattcggcccgcgccttgggctattgggttgataacacgccgcgccatgtcggcgacatcatcgtgttcgccgcaggccaggaaggttccgactcgtattacggccacgtcgccatcgttgagaaaatcaacgacgacggctcgatcgtgacctctgaatccggcgcctccctcaatggcggcacgtattcccgcacgctcacgaacgtgggcgatttccagtatattcactactgagtttccctaccgacgaccgtgccccttttcttgtaagagggatgctgtaagctaaggattcgatgaagcatattaagcattgttccgtgattgctgcgctcgccgcggccgctcttactttcgccggggtggcacctgccgcgctggcagccaatgatggcgccacgcaagatgctgtcgttgctacccgttcgttcccgaagaccaacgccgtgaagaagaacatcctcgcggaggcatcgtccacccaggtcgaatccgattccgactggggcggtgtggaaagcctgaacgttccccaaaccaaatctcaagccgaaaaagacgccgaagccgccgcagcggcagcggaacagcagcgtcagcagcaggcccaggctcaagcacaggcccaagccgcttctcgttccgccgctcgaagcgacctcagcagcagcggttccttcaccgtgacgccgcctgatggggccagcgtgtccagcctgctgacgttcgcgaaccagttcgtcggcaaggttccgtatgtgtccggcggcaataccccgtccggttgggattgctccggtttcgtgcagtatgtctacggccagatgggcgtttccctgccgcattactccggtgctcaggcgactgtgggtcgcgcggttggcagcctcgccgacgcgcagccgggagacatcatcgccaatgcgcagcatgccgcgatctatgtcggcaacggcatggtcatcaactcccagctgaacggcacccgctacgatcccatcgcatgggtgttccccagcagctacagcattcgtcgaatcttctgaagctttgacattgagctaagggcgtatttccgtgaggaatacgcccttttgctttgttattttccgcgtcgttacttgaaaaccgcatgtcgcgcggtatggtggaagtcaggtgcaacgcatagtcgcgttgccgcaacctgattcaagggaggtcgctcatgatcaatgacaaggcaatcctcgtaggtgtcgatggatcccacgccagctacaaggcgacatggtgggcagcgaattacgcgaagcatgcgggactgaccctgcagatcgtctgcgcatattcgctgccaagctatgcggcagtgtcgttcgatgccacgtatacggccatgggcgatgacaatgccgcgcacaacgatgcgcaggagattctgtcgaaggccaaggccatcgccgacgagcagggcgtcgaggcatcgacgttgatcgtcaccggagatcccgcatccgtgttcgtcgaactgtcgcgcaactacaacctcatcgtcattggcaaccgcggcaagggtggtctggccgaacgactgctcggcaccaccagctccagcctgccggcatacgcgtactgcccgatcgtcgtggtgccgtacaccgacgacgaaggcaacctgatgcacttgaacaacaccatcaccaaggtggcagtcggctccgacgaatccaagtggggtctgaaggcgttggagatcgcggccgcgttcgccgattcgtggggcgccgaactggacgtcatctccgccgtgccgaacatgaagggctctgaggacgaaggcgtcatggcgtccttccaggaggatctggatgtgcgcatcaagccgcttgaagcggcatacccgagcctcaagatcaacaagcagatcgtgcccggccccgcagccggcgcgctgaccaaggccagctacgaccatgacgtcgtcgtggtcggctcccgcggacgtggcggtttcaccggcctgctgctcggctccaccagccaggggctgctgcagcatgcggtcggaccggtctacgtggtgccgcgcaagtatgtggaagccgcggagacccgtctcgacaccgtgccgagctcgcctgccgacgtcacgccgaaggcgatcgacgacatcaagggcgtcgaggaagtgccggtcgacaaggccaagccggaagtggtcgaagccatcgaaacgaagatcgatccggaccgtcagtgacggtacggcaaatcgactgaaatcgatataaaaaccgcatagaagagggtggctgcgattccaacgaatcgcagccaccctctaactatgtgcggtacgtgcctcagtgcttgacggtgacgttcatacgcaccggcgtcggctcgacgtacgtatgcttgaccgtgcagcccttctcgatatgacggctgacgcgatcggcgagcttttcggcgtcctcgtcgctcaaaccggcgtcggtggcgtcgatgaccacctgctcgtcgaaaccgatgtaggcgtcggtatcggcatcatacgtaccgtccaccacgatcttcgcgcccttgccatcgcccagcgtatgctcgacggcgaactggctggacagcgcggcgcaaccggccagcgcgaccttcatcagatcgcccggcgtgaactggccacggcccttgccgaacttgatgtgcgcgccatcctcgctgaacgcgtcccaggaaccgtccttgttgcgctctacccacagcctcttgcccatggaaactcctcatgtcctgtggcgcgccgttcgcgccaatccgtgataccaatctagcgcatcgaaacggacgtgggggagtgcgttccgcaagatgaagcgatacggttttgtgattcgttgcgattgcgctggaggccggcggacggccgggatgcgcgttggcggcacactcaaggccgttcggccaagcttacggccttacaacgcgcatcccggccgtccgcctccacgccaccggctaaacttgcctattatggctttgacttccgaacaactcgcagacattcgtactcatattcccgcacgtccggaaacggacattcccatgccttacgaggatctggtacgcaaaatccttacggaaggcacactgaaatccgaccgcacgggcacgggcactatttccctgttcggccagcagatgcgtttcaatctcaaagacagcttcccactgctcaccacgaagacggtgttcttcaaaggcctggcctacgagctgctgtggttcctcaaaggctccacgaacgtacgttggctgcaggagcacaacgtgcacatttgggacgaatgggccgacgagaacggcgatttggggccggtctacggcgcgcagtggcgtagctggccggcgccgacgccggacgatccgaaccgcacgatcgaccagatctccaatgtgctcgacctgatccgtaaccaccccgattcgcgccgcatggtggtttccgcatggaatccggcggaagtggagaatatggcattgccgccatgccacgccctattccagttctacgtggccgacggccgcctgagctgccagctgtaccagcgttcctgcgacatattcctcggcgtgccgttcaacatcgcctcctattcgctgctcaccctcatgatggcccagcagacgggactcgagcccggcgaattcgtttggaccggcggcgactgccacgtctacgacaaccacatcgaccaggtgttggaacagctgagccgtacgccgtacccgtatccgcagatccgcatcaggaaggccgattcgctgttcgactacgattacagcgatttcgaaatcgtgaattaccagcatcatccgaccatcaaggcaccggtggcggtctgaggttgttgccgccgtctggcgcgtctgcgccagacggtagactactgaccctagttccgacttcaaggagtgagtgaaatggagcacgatagtagccgcagtggctatcacgaacccgagcccggacttgccgggcgtgaagacgaggaggattggggcgacgatttccccaaaaccttctctgtgaatctgatttgggcgcaggcctgtgacaaggaaggtcacgacggtgccattggattcgaaggcggcatgccatggcatctgcctgaggatatgaggcatttcacggagctgaccgtctcccatccggtcatcatgggccgcaagacgtgggagtcgctaagcccgaagttccgtccgctgcccaaccgcgacaacatcgtcatctcgcatgacccgtcctatttcgcgccgggcgccaccgtggtggattcgctggatgacgcgttggatctggcccgtcaggaggccattccggatgacggcttggaccgcagtgaaatctgggtcatcggcggagccaaagtattcgaggaagcgatgccattcgccgacaaggcgtatgtgacgcagatcagcatgcacgtgaacgccgacacctacgcgcccgatatccacgcattggtggaatccggagcatggcgcgtggccgaggaaggcacgtggcagaaggcgcggaaaggaaacgaccaagtcgaaggcttccgtttcgtgacgtacgaaagaaaccacgaggagtaacttttcatgtataccgtgatgaccgtgtgcacgggcaacatctgccgttcacccatggctgaaatcattctgcgcgccgaattcgagcgccgcggcttggctgacaaggtcaacgtcgaatccagcggcgtcagcgacgaggaatacggcaatccgatcgaccgccgtgccgtcaaggtacttaaggaacgcggctacgagctgccatcgcaccatttcgcgcatcgcatcacgcgcgacgaaatcgaacgcaccgacctgttcctgccgatgaccgcctcgcacatgcgcgcgctgctccgtcagctgccgcaagccaagcgcagcgaagtgcacatgtaccgcagcttcgacccgaatctgccgaagccggccgcgggacgtgaggacagcatcgatctggtggatccgtggtacggtggtccgcgcgaattcgaagtggcgatcgaccaaatcgaagaggtggcgccatatatcgtcgattgggtcgaacagcagttgcagaactgattttttattgcgattgcggcatgcttgatggtttcaagcgtgccgcttttgttttttgcgatttattgcgatttttttttgggggggggctggctgtgttgtgaagttgcgatttttctgatgttgcggtgtttggtgggattgaatatacggcgtttttgcgatgttgcgattgcggggtgtccggtggaggccggcatatgcgttgcaaggcacactcaaggccgttcggccgagcttacggccttgcaacgcatatgccggcctccacctcgtttttattggcaggttgcgatgttgcttcgttctgtgggtaagttgcgttttttgatttttgtggggcgcctcgtttttgtgggcaagttatgtcttgacggttgggaagcgtggattggcgtgggaggggagagtgagggtaaaagaaaaaccccggcggattgggctggggtttggtggcgaccacggccggacttgaaccggtgacctccgccgtgacagggcggcgctctaaccaactgagctacgcggccgttgtttcagtcttgcgactgacaacagatagaaatactacgacaaaatcgcaattatgcaaaactgcggcgtgtcacggtgtgttgggcgtggcgcgccgcggtttcgcgggaaaggagacgaatctcagtcggtctgcttccaggtgtcgacgtcgatgtggtgctccgggttggcctgccatgcgtcccaagcggacttcacaatgtcctcgacattgtacttggcgtgccagcccatctcctcgttgatgcgcttcggggagccgatcaggtgcggcggatcaccggcgcggcggcccatgacggtctccttgaacggcagaccggtgaccttcttgacctcatcgacgatctggcgcacggaggtgccctcgccggtgccgacgttgaacgcgtcatactttcgctcgtcgcggtccagatacttcagcgcggcgatatgcgcgtcggccagatcggacacgtggatgtagtcgcgcacgcaggtgccgtccggagtcgggtagtcgtcgccgaagatcgccggggccttgcccttcttcagacggtcgaacagcatcgggatgaggttcaggatagccggatcctcaagttccaccgggccgcagccggccacgttgaagtaacgcaggccgcagaagcggatgccatacggttcctcgcaggcgcgggccatccactcgccgaacagcttggtctggccgtacgggttgatcggcagcatcggcacgacgtcttccggcaccacatcgaccggcggcacgccgtaggtggcggcggaggaggagaagacgagcttcttggcgccggaatcgcgcatgccgatcagcacgttgagcatgccgttgaggttctgctggtagtaccacagcggcttctcgacggattcgccgacctgcttgcgggccgcgaaatgaatcacggaatcgacgccttcggccttcatgatctccgcgaggcgctcgccggcgcccggagcggcgatgtccatgccgtacaggcgggagccttcgatgcgggtgggcttgccgtagctcagatcgtcgacgacgacaaccttttcgccggcctgatgaagtgcgtgaacgacgtgggcgccgatgtatccgcacccaccagtgacgagaactgtcatgttctggcctttccttcgaatgagcagtgaaatgcaacagttggtgaaaatgtcaaccattgttcacttttgctcaggtttgttaccttttgaacaatttgagtataacacgtgaacacgaacgcacactaacggctcgttcctgcgtttcctctataaattagggtatgcaacatgacgaaaacacgccgaccgatggtcgcaaaacagaagaaaacgcacagaatatacaacatgtgcagtcggccgctgctgacggcaggccggccctctacggtcgcaaggtgctgtccttcgtgcggcggtccgcccggctcgacgcgcgactgcagcgggcctgggacacctacgccgatacgtatctgctgaacatcaacgcgggcgaagggtccctcggcgtgcgtgagggtttcgtgttcgaccaagcctatatccgcgaaacgtggggcaataccaatcctctgatcgtggaaatcggctccggacaaggcgagaacgtcgttgccgccgcagccgcccggccggacgtcaacttccttgcgttggaagtctacgatccgggcgtggcgcacacgctgctgctcgccggcaagcagaacctgaagaacctgcggatcgcccagatcaacgcgccagaactgttcaaggcggccgtcgacggctcgatcgccgaagtgtggacgttcttccccgacccgtggccgaagatgcgccatcacaagcgccgcatcgtacagcccgagctcgctgcggacatccaccgcgcgttgacggacgaaggcgtgtggcgcatcgccaccgacatcgaggattacgcgctgcacgttcacgaggtgatggacgagctggacggcttccataacgacggcgcattgaccgtgagcctgcccgtcgagcacgtcggcaaaggcaacgcggatgaggcggccgcattgcgacacgccgatttcgctgaatccgagcgattcgatggccgtgttttgaccaatttcgagaagaagggacttgccgccgggcgcgtgattcacgatttcacctatcgtcgcgtgtaatgcgataaggcttggaatttcagtgttttacgaggattcctgtcttattgtggcggtgtgtgacaccggcgcgacacgccgaggtttgcatgtcggccagattcgcgtatagtagggcaagttgtcaagcggaaacgctgaaagcgcccccttcgtctaacggttaggacaccagactttcaatctgacaacgagagttcgactctctcagggggtacgtaccttggaaacaaggtggcaatggccgcgtagctcagttggttagagcgccgccctgtcacggcggaggtcaccggttcaagtccggccgtggtcgctggaacagcgcaagttgttcatggctctgtagctcagttggtagagcgaacgactgaaaatcgttaggtcagcggatcgatgccgctcggagccaccagatacaccccggagcaatctggggttttgtttttctcgcatatcttttccgatttacctgcgcgatttccgctcgtttcccagcacaagcgccatccgaaccatatcggcgaaagacatacgcccattacccccaacgaagagggatgttctgtcccctctgtcgctaaactatggtgcaggtagacaaggggttgacggctgtactgttccatgatgttgacctctaaacgggtgtatccctggggtgaggcgagtggagatactgttaatcggcaacaccgacttcgtgacgaagcagtggatcgagcacgcgttcccccacgacaaggtggtggtggccctccgcaaagggaccgaatccagcggcgaggatctcaaaatcatcgacatgcccgaccgtgacgccatgtcggaagtgttctccaactacgaattcgatcgaatcgtctacttctccgaagatctgacgcctcgcagcgaacgtgacggcgacctgggctacctgcgccgactgctgcacaccgtccgcaatcgcaaggtccagatgctgatggtgagcgggccggaatcggaattcacctatccgcaggaaacggacgtgcacgagaccagcaaaagcctgatgtcgcgtgccggcgaagagctcggcctgtactatgcgcgcacctacgatctggaagtgaagatcgtgcgctgcccctatctgtacgcgccgcaacgcaatggcgtcaccgcatatttcaacggcttgttcgaacaggcacaagcgggagaactgcgcttccatgaacgcgccgaacaacgcacctgcttcctatgcgccgacgatctggccgaacttatctaccgcatattcgacgactggaccgccgacagcgagctgttccacgttccgaacgtgttcgacttcacttacggcgatttgggaacgctgatcgcgggatattttccgggaacgaaggtcgtatacggcgaggaccgtccgcaggcataccccgccgacgaccacgaattgcgattgcggtacggcttttcgccacgatactcgcttcgcgaggattttccgcacgtcatcgaaggctggttgaagctccgcgagaacaaaaccgacaagcatccggtatgggatttcctacgcagccacaacaaatggtggaccgtgctggaaatcatcggcgcgttcctgctgacggaatggctccgcacttttacacaaggcaacagccagctggaaaccgtggacctgcgattgctgttcgtggtgatcgtcggcaccatctacgggctgcatgccggcgtgttcgcagccgtactggcctgcgccggcgtggccatgtcctacgcgtcgcagggcgcgtccttcgccccgttgttctacgacacatcgaactggcttgccttcgtcatttatttcgtggccggatcggtatgcggctatgtgcagtcgcgcaaccaggagagcgtgaggttcgtgcgcgacgagaacgggttgttgcgcaatcgtctggacttcctgcgcgggctgtatcaggatatgctcgacgaccgcagacagttgcgcgaccagatcatcggcagacgcgacagtttcggcaaactgtacgccgtgacccgagaattggacgaagtgcaaccgcagaagctgtaccatacggcgatccgcatcatgcaggaaagcctcgatagcgacagcctcgccatcttccgagtggacaacggcggacagttcgcccgtcttgtggcggcgagcccacggttcgacgtcggcagcttccgctccgtacgcgtctcggattacggtgaaatcatcaccgcgctggaacacaacggcatatgggtgaaccgaacgttaaaggacaaattcccgatgtacgccgtcggcgtgcgtgaccgtggcgaactggccgtgatcatcaccatgggagaggccaaaccggaccagatgaacctgtacttccagaatctgttcagcatcatgtgcggtctggtcgaatcggccatgatcagggccttcgaatacgaggacgtggcgcgccggtccatgctggtgccgggaacgaacctgctgaagccagaagcgttcctgccgaaggtgctggctgccaacgacctcaaacacgaccatatgggcgaccatctgctgctcaaagtcgaatgcgagggaaaccttgaggacgtggactccctgctgatgcaaagcatccgccagaccgatgaggccggcatgctgacggatgacggcgtgtatctgctgatgaaccaggcgggggagaaggaactgccgatcatcctcaaacgtctgacccgttccggcttgcactgctcctacgttccgcagacccaagaggatgccctgctttccgaagcccgatcgcatatcgcgcaagccgacgatgggggtgaaagctgatggggtcgacgactatcgccgcgttgatcatcatcgccgtgcatctgctggtctgcatgacgctgtgtctgctgcaccacgtcggagtgctgaaagtcgatggactgctgctcccgttcatggcgttgattcccctatgggggccgttgagcgtggcgctcatgcattcgcgtgccgtgcttcgtgggggacgacggattcccgccggtctgcaggaactgaaggtcgaggatcaggaacaacgcaacattcttgtggacgaccgtacggattacgccaacaccgtgccgttggaagaggcgctgatcgtggacaatccacggcagcgtcgtaatctgatgctgtccattcttaacgagaatcccggccaatacgccaatctgctctcccaagcccgtctgaacgaggacgtggaagtcgtgcattacgcggccacggccatggcgcagatcagcgcgaaggaagacatcgcgttgcagcaacgcatggaggaatacgagcggaaccgcgattcggacgaggcgctcgaccggtaccgtgaggcgctcgaacactacttggaatcctccatggaacaggggtatgccagaacgttgcagatgcgccgatacaccgacctgctcgccgaacggctcaaacggcataacgactaccgcaccgtatgctcgttggcgaagacgcagatggatctcggttcgttcgatgccgcgtctcgcaccatcgaagcggcgctgtccgcatggccgcgtcaaggtgacgtctggctgatgaaactgcgattggaagccgcacgtcacgatggcgaggcggtgcaacgcaccgtccggcacatcaaggacgaccacatctaccttggcggccgaggccacgacatcctgcgattctggctcggcgacaaggaggctgggcgcgcatgatacgttccgcatggcgcatatggaagcgcttccgttggaaaaacctggtccgcgtgtgggccgtattcatggccatcgccttggtgctgttggcgcaaaccttgggcatccactacggcgcgacgaaattcactttgaaatacatggctcgtaacgaggccattccggcccagaacgccatcatggggcagcgcgccacgaacctgatgctcgtggatagttcccaggatggtgtggacgaggccgaaaccatgatgaaacaggtgctgctcgacatgaaagtgccgaccgccaccgtggatctggccaaaaccgatcccgacgacatcccctcattgaatcggtaccgcaccgtgctgatcgtcatgccggaacttgattcgctgggggatgagctggtgtccatcatgagatgggttgaaggcggcggcaacatgatgcttgccatgacgcctgaaaaaacaggctatctggacgcgatcgggcctcaaatcggcatcgaatcctccgcatacgactacgtgatgaccaaaggcatcaagcctgccagggactttatgctgggtggcgggcacacctacatgttcagtggcccgttcaaatcgtcgttgagtctgaacctcaatgagaaggccgccgtcgaagcggtcagtgccaacggccatacgccactgatctggagtgccgatgtgcgttccggacgaaccgtgacctgcaatatcggcatctatggcaaggtggtgcgcggcttctatgcctccgcgttcagcctgctgggttccgccacggcatacccggtcatcaacagcgccgcgttctatctggacgattttccatccccggtccccagcggagacgccacctacatcaaacgcgactacggcatgagcatcaccaacttctattcgaaggtctggtggccggacctgaccaaacttgcggaacgctacggtattcggttcaccggcgtgatgatcgagaattacggggacgatacgaaagacgctcccgtacggcagaaggacgaatcgcatttcatctatttcggcggactgctgctcaaacagaacggcgaaatcggctaccatggctacaaccatcagccgctcgtactgccgaacaccgattatggcgacgaatacgcgtaccatcagtggccgaatcgcaaagctgtcgtcgcctcgctgcgcgagctgatcgcattccaaaagtccgtgctgccggcggccacagcgtcggtatatgtgccgccgtccaacatcctgtccaaggaaggacggcagacaatcggacgagacgtgcccgaaatccgcaccatcgccagcacctacctgccaagcgacagcaaacttccttacgtgcaggaattcggtgtggccgatgacggcatcgtcgaggcgccgcgcatcgtctccggcggcatggtgggaaacgattacatgcggctcgccgcagaatccgaactgaacatgcatttcgtcagcacccacttcatgcatccggacgacatgctcgaccctgaccgtggcgcgaaagaaggctgggcggtctacagaaaaggccttgagaactatctcgactggcttgaagtgtccgcaccgtccatccgcatgcagacaggcacggaatgcgcgtccgcggtgcaacgcttttctggactgactgtcaagatgagggaatccgccaatgagtgggaattcgacttgggcaatttcaaggaccaggcttggctgctgctccgcgcgaaccatggcacgcccggcagaatccaaggcggaagcatgatccggatgacggggaatctgtacctcatcaaggccacggactccacagtgcacgtcgaacgcaaggctggaggcgcggcatgagaatctgcctggtattggaaggttgctacccgtacgtgcatggaggcgtgtccacatggatgcacagctacatcaccgccatgaaggaacacgagttcgtgctgtgggtgatcggcgcgaaagccaaggaccgtggcaaattcgtgtacgaccttccatccaacgtggtggaagtgcatgaggtgttcctcgacgacgcgttgcgtctgagcggtgaacatgcgaaagtgatcttcaccgacgaggaagtcaaggcactgcgtgagctggtgaatctgagcgatcccgactgggacgtactgttcaacctgttccacaacaaaggcgtgcatccgctgtcgttcctgcaaagcaacgaattcatcgacctgtttacgaagatctgcatggaggaatacccgtacgttgcctacgcggatgcgttccacaccgtgcgatccatgctgctgccggtgctgtacctgatgacgggagaagtgccgaaagcgcagatctaccatgccatctccaccggttacggcggcctgctggcatgcttgggcggcagtatcaaccacgcacccgtattactaaccgaacatggcatctacacgcgcgaacgcgaggaggagattctttccgccgaatgggttgcgcccgcgttccggcaacggtggatccgtttcttcgccatgctgtcgcaggagatctaccgtagggcatggcgtgtgaccagcctgttcggccgcgctcgccagacccagatcgacatgggcgctccggcaagcaaatgcctggtcattcccaacggcatccaatacgaacggttctgcgacattccactcaagcctgaggacggttgggtggatatcggcgccgtggtacgtctggctcccatcaaggacgtgaaaaccctcatccacgcgttcagcgaactgtcgaaccgcgtggacaatgtcaggctgcacatcctcggtggtgtggacgaccaggactatgccgacgaatgctatgagctggtgaaacagcttgaagtgaagaaccttgaattcaccggacgcgtgaatgtggtcgaatacatgcgcaaactggatttcacggtgctgaccagcatctccgaaggccagcctctgtcggtgttggaatcgttcgcggcggcccgcccttgcgtgaccaccgacgtgggctgctgccgtgaactgctggaaggcgaggaaggcgacgacctcggcgtggccggcttctatgtgcctccgatgtaccgcgagggccttgcccgcgccatggaacgcatgtgcgcgagccgcaagctgcgcgaagccatgggccaagtgggacgcgaacgcgtgaaaacctactatcggcatgagcgcatgcttgacgaataccgtgcgctgtatctcgataccgccgaccattacgggttggagcactgatatggcgggaatcggattcgaactcaagaaactgttccaccgcaagggcctggtcgccatggtgcgcgcctacggttatgccggtgtgatctgcaccggaccgatgctgctgggcatcctgctgcagttcggcgtgctggcggtcagcggttggtggcacgtgccccgcgcggaccagaatctgctggtctgcatgatcacgtacacgctgctcgcctcattggtgttgaccagcttcctgtccatgccggtgacgcgtttccttgcggacatgctgttcgaacatcatgaggagaccattcttccatcgttctggggatccacgaccctcatgctggcggtgggtgcggtgctgtacgcggtgttcctgctgttttccggcgcgaccctcatgcaggggttactctgcctatggctgttcctggaaatgatcgtcaattggaatgcgatgagctatctgacggccatcaaggattaccaaggcatcatgtggtcgttcgtcgcggcggtggtcgtggcgttcctgtccgcatgcgcgatgatggcgctgggcctgccgcaggtggaaagcctgctggccgcagtggcgttcggctacggcgtgatgatggtctgggacgtggtgctgctgcaccggtatttcccgcaaagctcggaaagcccgtggacgttcctcgcatggctggaccggttcctgccgctcgccctgacgggactgctgaccaccctcggcttgttctcccacttggtgatcacctggtgtggtccgcttggcgtgcatgtgaagggactgttctacggtgccccctactatgatgtgcccgcgttactggcgttcctgacgattctgatcaccaccgtgaatttcgtggtgtcggtggaagtcaatttctatccgaaataccgtgcctactacgcgctgctcaacgacggcggcaccgtgaaggacatcgtggtggccgaacgcgagatgctcgccgtgctcaaccgtgagctgtactacaccgcgttgaagcagctgttcgtcaccgcggcggtcatctcgttggaaaagatggtgttgggcgtgctgccgctcggtttcaacgatggcatgcatggttatttccgtgtgctgtgcgtcggatacgccctgtacgcggtcggcaacaccatgctgatgattctgctgtatttcactgattacttcggcgcggtgtgctgcgccgcgatattcgccgggtcggccacggtcttgactgttatttcgcagttcgttccggtcacgctgatgggattcggcttcctgctgggcgcgtcggcgttcctgctggccgcggtcgtgcgattggcggtgttcaccgacaatctgccgtatcgtgtgctcggcgcgcagccgattgtggcgaccgaaaagcgcggatggtttacgaaactgggcgaagcgttggacgaattcggcgaacggctgcatggaactttcggacggaaggaatcatgagggaaagcgtggaaagcatggaaaggaacggacgaatgacgatgggtaatcggccgtgcggccgcaatgccatattcaaatgcgtggcgatcatcgccacggtcgtgacgacgttctcctgcgtcgcctgcggaaacgctgcggacagtggttccacggcagacaaatcggcggcgcaatcgcaaggaaagcatgagaaagtcaagaaaagcgccacgcaggggcttgacggcgcgcatctgcgtgacaacgactcgctgtacaaggtgtatgacgacagcggtgtggaaaccatgtatctgacggtctcgcgcggcaacaagtcggaaggcaccgaccacagttggagcgaaatcaaccagtattccgtggatgattacgcggccatgcgcaccaaccggtaccaagtcaacggtctgctgcaggtcggcgacgaacaggggcctgtatccggcgaactcggctacggtgaaaaagcgccgaacgccaccgtgcaggtgcgcggccagtcgtccagtctcaataagcagaagaactacaaaatcgagctgaaaagcggcaaaggcaaatggcgcgggcagcgcaccatcgcattgaacaagcatatgggcgaagggctgcgattccgcaacaagatggcatacgacctgatccgcggcatcgaccagatgatgggactgcgcacgcaattcgtgcacctgtacgtcaaggacgaaacctccggttccaactccttcgacgactatggcctgtacacgcaggtggagcagctcaacaaaagcgcgctccaagcgcacggcctcgacaagaacggccagctgtacaaggtcaactacttcgaattccaacgcgacgcggacgtgatcagactcgccgacgatcccaaatacaatctgtcgaaattcgaggagaagctggaggtcaaaggcaacagcgaccataccaaactcatcgccatgctcaaccagctcaacgattattcggtgccgatgagcagcatcctcggcaaatatttcgatacggaaaatctcgcatactggatggcgttccagctgctgaccggcaacaccgacacgcagagccgcaacatgtacctgtacagccctacgaattccgacaccttctatgtgctggactgggacaatgacggcatgctcatgcgcaaggagaaccagctgcgtaacacgtccgaaggttccagctgggaacagggcgtcagcaactactggggcaacgtgctgttccgccgctgcctgcaaaccaagtcgttccgcgacgaactcgacacggcggtgaaacgggaatacaactacatgaacgccaatcgaatcaacggcatggtgagccactacgaatccatcaccaaccagtacctgtggaaaacgccggattccacatacgagccgttgacccgcgcgcagtatgacgtggtggccgggcaactgcacgatgagatcgagcagaactacaaaacctaccgggaaagctacgacaagcccatgccgttcttcatcggcgcgccgcaagccgacaatggcaagctcaaaatcaactgggacacctcgttcgacttccgaggcgaggatctgagctacgacatcaccgtggccaaggactatctatgcaaggacgtcgtctttagcaagaccaatctggcattgccccaaatcgtgatggacctgccgtccgatggacagtatttcgttcgggtgcgtgcgcgcaacacctccggcaagatgcaggacgccttcaactattacgtcacggaacatggcaagacgtacggcacgaaatgcttctacatcaagtccggccaggtcgtggaggacgacaatgggcagtgatgagacctcgacgtcgctgctgcggcgaatcgggcggcgcgtcgggcggcgtatcggcgaggagcttgccatgccgccacgccgctgcgaggaacgttaccgtcacgagctcaaatatctgatttcgtacggtcagaaggccgacctgaacgtgcgcatggcaccattgctcgaccatgacagccatgcccgtgacggcagctatacaatccgcagcctgtatttcgacgattactggaacaccgcctaccaagaaaaagtggacggcgtgctgacacgtaaaaaataccgcatccgcatctacgactacagcgaccgggtgatcaagctggaacgcaagcgcaaaagcgacagttggatttacaaggaggacgcgccgctcacgcacgagcagttcgaccggatactggccggcgacgtcggattcatggaacacagcgaacatcagctgtgccgggaattctacgtggaatacgtgagcaatgtgctgcggcctcgggtgatcgtcgactacgaacgcgaaccatggatcctcgacgccggcacggtgcgcgtcacgttcgacatggacgtgcgcgccgcggtcgacggattcgacatcttcgaccgcaccctgcccaccctgcccgtgcttgagccgggcaagctggtgatggaggtcaaattcaccgaattcctgccgcagatcgtgcgtgacattctgccaggcaaggcgcaggagataacggccgcctcgaaatacgtgctgtgctatgacaaagcctcgtatctgcggggtttcgactactggcaggaaggctggaacgtgccgagcgtgtgacttgagcgcaccggtcggacgtatcgcggaagaccgaaaacagacggacgaaaacgcgcagccgaaaacatcggcaatcgtagaaaacgtaataaccgaacaatcgcaaaagagaaaacgaaaccatgagcgtaaacgacatgatcaagaaatcggtgctgaactccttcagccaatacaacgtgcccaaaatggcgctggccctgctggtggcgctgctggtgggcatcgtcatctactgcgtataccggcggttctacacgggcgtcgtgtattcgcgcagcttcgcggtgacgctggtgggcatgtgcgtgctcacctgcatggtcacattggccatcagcacgaacatcgtgatctcgcttggtatggtgggcgcgttgtccatcgtgcgttaccgtaccgccgtgaaggatccgatggacctgctgtacctgttctgggccatcacgtccggcatcgcggccggcgcgggcatgtatctgctggtggtggtcgccggcgcggtgatgatcggcatgctcgccctgttctattcgcatcaggacaagggccgcgtgtacatcgcggtgatccattacgcttccgacgcggtcggggacgacatcacgcgcgcgttcggccgcacgaagttcttcgtcaaatccaaaaccatgcgtggcgaccatgtggagatggccgtggaagtgttctgcgacgacaaggacatgacgttcgccgagcggattcgtgccatcgagggtgttgaggacgtcaccctgatacagtacaacggtgaatatcacggataggacgtggtgacaggaaggaatctgtttggctgacacaccggaaatgggcaggacgccgtccaccgacgagcttgtgccggagctgacgttcgacgagatcgaccgtgcgttcgacaacaacgagttctgcttctacctgcagcccaaatgcaatgcggctacgggtgccatcgtcggtgccgaggcgctggtgcgttggaaccaccccaaatatggtgtggtatctccgggcaggttcgttcccatgctggaacaggccggacaaatctcccgactggacgtgttcgtatggcgttccgtggtccggatgctggcacgttgggaacgtgagggccgcaatctggtgccgatttccgtgaacgtctccatggtggacatcgaccagatggatgtggcggacacgctcaccggactgctgaacgaatacgatgtcgacgctcggctgctccaagcggaaatcaccgaaagcgccgtggccaggaacctgtccaaagtggaaagcaccatccgcaagctgcatgcggacaacatcgcggtgctgatggatgatttcggatcggcgtattcgtcgctgaacatgctcaaggacatcaacgtcgatgtgatcaaacttgacatgaaattcatcgacctcgatgaggacaatgccagcaaagggctgaaaatcgtcgaatcggtggtcaacatggccagaaagctgcgactgctggtcatcgccgaaggcgcacagaccaaacagcaggtcgaccagctgctgtccgtgggatgccggtacatccaagggtattacttccacgaaccgcttccggtgggacggatggagaagctgttggccgaacgtcccgacgaccggcatttctgggatatgtcaaacgatttcatgcatggcagctatgtgcccgtcaacggccgtaccatgcttgagacgtccgcgctcgccgccagcaccttcgagattctggccaatggcgtggcggaactctcccgactgaatgtgaagacgggcgagtaccgcgcggtcaaacgcgatggcatactgccgacgccggaaaccgatgatttcgaaacctacgtgcagacgctgatcgccgaacgcgtggtgcatccggacgatgccgacaggttccgtgctgatatggatctggcttcgctccgttcgctgctgttctcgcagaaatccgcgttcggagtgtaccgcagtgaggtgctggccagaaccggcataatctccttcgcggtgattccctcacgtgaatgctccgaaagcgatccatgggccgtggtgatggttggccggaacctgccgatagagtcctttgtccggttgaacggcgaggagtaccgacgggattcattgacggggctgctcaaccgcaacgctttcgacgatgatgtggaattcatccaagccacccatgacaagccgttgacggtgatgtacatagatctgattggcctgcatgagatcaataatcatttgggtcatgccagaggcgacgtggtgctgtgcgagcttgcggatgcggcgcgcgcctatttcggcgacgataatatctaccgcatcggcggcgacgagttcgtgatcatcagtttcgcccattcgatggcgcagagcgcccgacagatggaatatatgcgtcaggagctgcttgatcacggttgcgagctgtccgtgggcatggccgaatccgatgacggcgaggatattccggatctggtcaaccaggcggaaaacgagatgcgcaaagacaagaagcgctactacgccagcggcagcggcaaaaggcagttgcgcacgttgaacaagcagcttgaggacatcctggtacgcaacaaagacatggaatcgttgctgcagcatttgaatacacggtattcgatcgcttatgtggtcaatctgcgtgccgatacgcaacggccggtcgtggttcccggctatgtgcaaaaaatgcttgacaaacatggcggttccttccacgagatgctgctcgactattgcgacaaattggtggcgccggcctaccgggacggcttccgcatgctgttcgactatgattacgtccgcgaccggatatgcagggaaggcgctatacggtacgcctatgtcagaaacgacggcgaacggttcctgattacgattttccccgacacccattccgtggacgaggtcatgtgggtgttcgccaaagaagacacgtcgtccgaagaataggatttcgggcatcggacggcatgctgtccggttttgccggtgttgtgggatattgacgaaaaaattgtgtgtcgtgggtgcttcctcgcatggaaaagggcttatgatgaaaccgttggccgcggcaatggatgccgtggtcttcgcttgaacacacagtcgcttaaaggagagcactatggtctatcgcatgattttcaaccagaccgcgtatttcggccgcggagccatcaaggagattccgggcgtcgccaggtcccatggcttcaccaaggcgttcatcgtcaccgatccggtgctgctggagaccggcaccgtcaagaaggtcaccgacgttcttgacgaggcgggcatgccgtatgaggtgttcgacaacgtcaagccgaatccgccggtcgaatgcatccaggatggcgtcgccaagttcgcagcctccggagccgacttcctgatcggcctgggaggtggttccccgcaggacacctgcaagggcatcggcatcgtgactgccaatccggaattcgccgacgtgctgtcccttgaaggcgtggccgacaccaagaacccgtccgtgccgattttcggtgtgccgaccaccgctggcaccgcatccgaaacgaccatcaactatgtgatcaccgacacggccaacaagcgtaagttcgtggccgtcgacccgcacgacatcccaatcgtcgccttcgtggatccggacctgaccgactccatgccgcgcggcctcaaggtggccaccggactcgacgccctgacccacgccatcgaaggctatatcacaccgggcgcgtggagcctgtccgactgcctgtccatgcagaccatccgcatgatcgccaagaacctcgccaagagcgccgatggagacattccggccggcgaacagatggcctacgcctcctacatcaccggcatggcctactccaacgtcggcctcggtctggtgcacggcatggcccacccgctgggcggccgcctcggcgtggcgcacggtgtggccaacggcatcctgctggccccggtcatggaatacaacaaggactacaccggcgagaagtaccgtgacatcgccgacgccttcggtatcgccgacgcctacaccggcgacatcgaaaccgtgcgtgaagaggccgtccaggcggtgcacaagctcaccgtggatctgaagaacccgaccaagatctccgaagttggcgccaccgaagccgacctggagccgctggcccatgacgccttccacgacgtgtgcacgccgggcaacccgcgccaggccacccaggaagacatcctcgccatctacaagagcctgatgtaggtccgactgcggtaggcgcaatcgcaaaaccgcaatcgtaaaaacaaaacggacggcatcgatcgcatggtcggtgccgtccgttcgctatccgcggaaaatacgccgcgaataatcgctatacctaatcgctattcctcgtgcttctcgctccactcctcatcagtgggagtgtcgtcatacagctcatggccttcctgttcggccaattccatctgctcgttgatccacgcggcctcggccggattgatatcagcggtgttcaacaccttctgccacaccggatacagcagatgcatcacaggatataacgcggtgatgaggatttccggcttgtgcttgcggtaatgctgcggatgcgcgttgaacgtgttcttgaaacggcgcatatagttgaggaacgatgccggagacgtgtccatacgacgtgcgctgatgcccgcgatcatccgcggacaatacacggtcttgagatccttgcccaacagatgcagcgagatgtcgatgtcctcatgcatcacatccgccttgtcttggcagacctcgtcggcgatttcgcgccaggcggtggcgcgcagggccatgttggaaccgaacagcagaggttgcccatcatcggccctataaatacgtttgcgggtggaattgtccccgcgaagcccgaaatgacggctcggcaaatcgtaatacatcaccggaccggtggcgcccatcgcatccggatcctcggtgaaaatgccggacaccacctccacccagtccgggcggatcatgcagtcggcatcgaaacggccaagaatatcgccggtggcatgattcaaaccataatcacgcgttggaatcagaccctgctcatcatcctgatgcagcagcttcaccggcgcttccggatggtccttcatgaactgctccaccacggcaacggtcgaatcagtggaacggttatcgacgacaatcacctcatgaggcatcacggtctgccgggtggcgttgagcaggcaatcgttgatacgctcctgttcattccaggcggggatgacaattgaaacgttcagcatggtttcaagaataggttccagcccgtacacggtgcctgtctacaataaggagccatgagcgaacgcgaacagcatatggatacggacaagaggacgggaacgtccggacagtgcggcaataccgacgaaatgcgttgggatctcggcacgctgttccctgcgaaaggcgatccacgcagacctccggaatggctgggtcgcgcgctgctgtacatcgccatcgccatcgtgctgctctccttctgctggcgcagttggggcaaaatcgaatacctcatcatcgacgtcgtcatctcgctgttcctggcgctcgccgtggagccggtggtgattccgctggtcaagcatggctggaagcgttcgttcgcttcgattttcgcgttgctgatgttgggtgtcctgctttgcgtgatgttcggtctgttcggcaatctgttcgtgcagcaggtcatcgctttgtgcaacggtctgccggccctctaccagcagatctgcgatttcgtggcgcaatacacggatttcaagcttcctgagatcaacagtctcggcggtgagattctgaagaacatccagacctcgtgggtcacggatttcgcgggcaccgccatcagcacggtgtccggattcttcagcttcctgctgaacctcatgacggtgatcatgaccacgttctacatttcggcggccggcccgaagctgcgccgcgcggcctgccagtggatggctccctccgcgcagcgccggttcctgttcgtctggaccgtcagccagacgcagatctcatcgttcctgttctcacgtgccatcctcgccgtgctcaacgcgttcttcacctcgatctgcctgatggcgttgcacgtgccgtattggatgccgttggcgttgttctgcggcgtcgtatcgcagttcatcccgatgctcggcacgtacatcggcggcgcgttgccggtgctgttcgcctggggcagctgtggtttgtggcaggcgatcgccgtggtggcgttcatctgcgtctaccagcagatcgaaaacctgatcttcgcgccgaagatctcccgccgcaccatggacgtcaacgatgcggtcgccttccttgccgtcctggccttcggctcgctgttcggcgcgatcggcgcgttcctggcgctgcctatcgtcgcctcgatccagacgatcgcccgcacctacaccaagcggtacgatctggtcgattcgccgctgatggacgatccggttccggacaagaagtcgaagctggtggaaggcgccgaagtcatcagcgagcacctgcacgccgtgccgcgcgccgtgcaggggtcgagcgcgcatgtgccgattcccgacgacgtgcgcttcctgcaggagcaggcgtacaatatcactcggtccgacgagaccggggatgccgacgaatcgcagaccgtcgccattccgaagcgcgtgttggacggggtcgatcgcaagccgctgcggggaaccgcggaagcggacggagcgcagacggaagccggaccgcaggtagcggacgggtcgcaatcgcagggaacggatgacaatccgagaagtaggtggcgttaatggtattgctgagcgtacttgatgtcgtgctggtggttttgggcggcgccggcatgctctaccaagcggtctgcatcgtcatctcgctgttcgccaagccgatcaagttccccgaagcgccgatgaacaaacggtacgcggtgctgatttccgcgcgaaacgaagcgaacgtcatcggcaacctcatcgactgtctgcattcgcaaacctatccgagcgagctcatcgacatctggctggtggccgacaactgcaccgacaacaccgccgaagtggcccgaaacatgggatgccacgtcatcgaacgattcaacaaggagcaggtcggcaaaggctacgcgctgacctatctgctcgaccagatgaacgagtcgggcgcatccgacccgtatgacgcctttttcgtgttcgatgccgacaacaaactcgacaagcactacatcgaggaaatgaacaagggcttccaagccggtttcaaaatcctcaccagctaccgcaattccgtgaacctgtccgacaattgggtgtcgtccggttccgcgttgtggttcatccgcgaatcgcgcttcgtttccgcctcccgcatgtggctcggcaacagctgccacgtgggcggcaccggcttcatgttctcccaggagatcatgcgtcgcaacaacggctggaaattccacctactcaccgaggatctggaattcaccatggacagcgtgctgcacggcgaccgcatcggctactgcggcaccgccatcctgtacgacgagcagccggtcaccttcgcgcaaagctggcgtcaacgcctgcgttggagcaagggcttcctgcaggtgttccgctattacggaccggcgttgatcaagcgcgcggtcagggaacgtgatttctccgccgtcgatttcacgctgctgctgtgcccgttcaccgtgctcggcatcgcacgcgtgctgttgggcatgctgttcgccgcctgcggtttcgtgacatggcaaagccagctgaattcgctgaccggctggacatccggcattgtgatatcggtgatcggcatgatgggactcgccgcattgaccatcgtggcggaacgcgatcacgtgggcgccaccaacaaggagctgctcgcctacgtgctggccttcccgatctacatgctgagctatgtgccgatttcgttccaggcggtgttcgccaagtccgaatggaagccgatcgagcataagggctgaggcttgcccgcggcggtgtgaacggtcatgagatgtttcgtggcgatccatacggtgcggatggtgaaaagatgacgaagagagggtgtggtttggctatggatgacgctggcgattaccgctatacgcgacgacgccgagcaatcacggtggcggtttccgtcgtggccaccgtcgcactgtgcgtcggctatgcagtggccgacatgtgcgatgtcgtaccgggcgtcctcacattgcgccatgtcgaacattcgacggccgccgctgccggccgttcgatcgaggcggccgacgtgatcgccgacatcgacgcttccaagaccatcgatccggccgctgcgcgcgcgctgaccgacgcgttccgagcctcagccgccggcttcggcggcgaattctccatcgccatcgccgacgcgtcgggcaacgtggtcgcggaaaacaacatcgacgtgccccgcacgccagcatccaccatgaaaacgttgacggcgtatgcggccgccgtcgaactcgacatgggcaagaccctggacacgcagacctatctggaacagtcccaggacggcaccgcgcggctggcgctcaaaggcaacggcgacatgctgttgggagccggagcgtccgacgcgaaccacatcaacggacgtgccggattgggcacgcttgccgggcggaccgcacaggcgttgcggcagcgtggcatcacctccgtgacattggcttatgacgacacactgttcggcaacgaccgctggccgcaaggcatcgccgaactcgacacggaccacctgtactacgccccgacagcttccatggccgtggacggcggcaggaattggaacgggacaggtccggccaatcctgatgtgttctcggcgtatccggcattgagcatgcagccggcgcgtgacgcggcgctggtgttccagcagcggctggccgaacagggcatcacggttcagggatttgtatcgcaaggcacggttgcgggggcatcccatccgcttgcctccgtgcgttcggcgtcgttgaacgagattatggcgttcaccatgcggcattccgacaattcgctcgccgaggaattcggcaggctgctggcgttgcaggtcggcgcggacaattcgccggctggcgcggtgcaggctgtaaaaagcgtgctggagcgcaaaggcatcactacgaccgggctcgacatgcgcaattgttcgggacttacggaggattcgaaactgacggcgcgcaccctgctcgaagtgcaactgcgcaatctggctgcgggatcgggggcggccgcagccgaaggaatgtccgtcatgggcttcgtcggcaccgctgagagccgtctgaacgatgctgacgaagcggggctgatccgtgtgaaaaccggcagtctgggcgacgtgacctccatgaccggcaatgtgtcgcggttgaacggcggagcgttgaccttcgcggtgatcgtcaacaatcccaccgatttcgcggcggcgaaggcggccatcgacacattcgtggccggtctgccgaagctgtgaacggccacgtgtgaatcttcccagcggatattcagcatatagccagaaacacgtcattcgcatgtgccaagatggtgggcatgcgaatcgctgacgtacaagaagacattgatcacgagctgatcagcaaagaagagatctccgacatcatcaaccgtgccgcggcacaagccagtgaagactatcgtggcaagaacccgctgctggtctgcgtgctcaagggagccgtgaacacgcttgcggcgttctcccaggccatgagcattccggtccaaatggatttcatgagcctgtcgagctacggttccggcacggagtcgagcggcaagatcacggttcgtcaggatctgtccacggatgtgcgaggacgccatgtgctgatcgttgaggacatcatcgattcgggcatcaccctggcttggctggtcgacgagctcaagcgccgtagagcggcttccgtggaaatttttgcgcttctggagaagccggcacgtcgcaaggtcaatgttgatgtgaaatacaagggacgtgagattcccgatgaattcgtggtcggtttcggcttggattacgacgagtactaccgcaacctcgattcgatcgcggtgctgaagccgtcagtctatgaaggaggtcaggcatgagtttccctggtccgaaccagccgccaagcaatggcggcggcaacaagcccaacgggggtagtaacccgttcaccaatccgtttagccgcaacgatgacggcaagaacggtggcagcggggcgaacggcaacaagtccaacggcccccgtccgttctggcagtcgccgtggctgtgggttgtggtcgtggcattgcttgccgtgaccatgttccagcttttcgccggtgcgggctcgcagaccatcgacaccaaggatggcatgcagatcctcaacggcaacaccgtcgagtatgcgacgatcgtggacaacacccagcaggtcaagctcaagctgtcgagcgattactccgccaccgacccggacaccggacgtacgaagaactacggcaagaacgtgcagttctactacacgtatgcgcagtccgcggccgtggtcaaggccgtgcagaaggccgatccggccaagggctggaccgcgtccatgcagcagaccagcatttggacctacctgctcacctcgctgttgccgttcctgatcatcttcggcctgttctggttcctgatgagccgtatgggcggtgccgccggcggcatgttcggcatgggcggcaagaagaacagcggcaaactgctcgacggccagaccccgaccaccaagttctccgacgtggccggcgaagacgctgccgtgcaggaggtcgaggaaatcaaggacttcctcaaggacccgtcccgttacaaggctttgggcgcccgcattccgcgcggcgtgctgctgtacggccctccaggcaccggtaagacgctgctggcgcgcgccatcgcaggcgaggccggcgtgccgttctactccatggccggctccgacttcgtggagatgttcgtgggccttggcgcctcccgtgtgcgtgacctgttcgatgaggccaagaagaacgctccggccatcatcttcatcgatgagattgacgctgtcggccgcaagcgtggcggttccggcatgagcggtggccacgacgaacgcgagcagacgctgaaccagctgctcgtcgagatggacggcttcggcaacgatacgaacctcatcatcatcgctgcgaccaaccgtccggatgtgctcgatccggcattgctgcgcccgggtcgtttcgaccgtcaggtggccgtcgaagcacctgatttggaaggccgcgaggcgattctgaaggtacacgccaagggcaagccgttcgtgccggacgtcgacctgcatatgatcgccgtgcgcacgccgggcttcaccggcgccgaccttgccaacgtgttgaacgaagccgcgttgctgtgcgcccgtgccggcgcccagctcatcgacaaccgcgccatcgacgaggccatcgaccgtgttcaggccggtccgaagcgtcgttccaagggcatggctctcgacgagctacgcaacaccgcatatcacgagggtggccatgcgctggtcgcggccgccatgaacgacaccgatccggtgaccaaggtgacgattctgccgcgcggccgtgcactgggctacaccgcggtcatgccaaccgaggaccgttactccatgtcccgcaaccagctgctcgatcagatggcgtacgccatgggcggccgtaccgccgaagaggtcgtgttccacgacccgaccaccggcgcgtccaacgatatcgagaaggccacgaacatcgcgcgtcagatggtgctcgactacggcttctccgagaagctgggcgccatcaagtggtccgacgacgagcaaagcgatctcggcgcgctcacccacaagtactccgcgcacaccgccgaaatcatcgacgaggaagtgctcaagcttgtggagaccgcgcataccgaagcatggaacgtcattaacgagaaccgcgacatcctcgacgagctggtacgtcagctgctcgtcaaggaaacgctcaacgagaaggagcttgccgccatcttcgccaacatcaagaaggcgccgaagcgcgaggtctggttgagcgacgagaagcgtcccgattccgacattccgccggtcccgattcccgacaagctgaagaaaagcgcaggattgaccaactgatgagcgataccgatttcgataccctcctcgacgacaaggcccgtgccgctcatgcggccgggcctgtcggctatgacgaggaaggcgtgcgccaggccgtgcgcctgttcttgaagtccatcggcgaggatccggaccgtgaaggtctgctggacacgccggaccgtatcgggcgcgcgtgcaaggagctgttcgccggcctcggacacgggccggaggaagtgctgaaaacccgtttcaaggtggacaccgacgaaatggtgctggtgcgcgacattgagctgttctccgtctgcgagcatcatctgctgccgttccatggcgtggcccacgtcggctacatcccgcagaacggccaagtggcgggcttaagcaaactggcacggttggtggaactgtacgcacgccgtccgcaggtgcaggagcggcttacccagcaggtggccgacgcgttgatggaaggcatcgacgcgcgtggcgtgatcgtggtcaccgaatgcgaccacatgtgcatggccatgcgtggcgtcaagaaggcgcagtcccgtaccgtcacctcggcggtgcgaggatgcatgcgcgacgcggccacgcggaccgaggcgatgagcctgattctgtcgaaccattcgtaagtgcgctttaccgggcggaatcggacagaaccgaacggaagaacggaatgaatgaaggaagaaaaccgatggcgattgatatgaaggcgattcatgatagccagcgcacgttggtgatgggcgtgctcaacatcacggaggattccttctccgacggcggcctctggcttgctccggaggcggccaaagcccatggcgaggcgatgatgaaagccggtgccgacatcatcgacatcggagcggaatccacccgtccgggagccaaacgcgtcagcgaagccgacgagaaggcccgtgtgctgggcgctgtggacgcgctgattcccgaaggggcggtgctgtccatcgacaccacgcgcgcttcggtggcgttggccgcgctcgaacatggcgcgcagatcatcaacgacgtgtccggcggccagttggaccgcgaactgccgcatgtggtggccgaccattccgactgcctgtacatcgtgcagcattggcgtggctggcttgccggcgccgcaggcaatgtgccggacgccgacacctcccgctacgagcatggcgtggtgaatgacgtgtatgacgagctgatgcgtcaggtggatgcggtgcttgaagccggggtgcaggccgaacaggtcatcatcgacccgggcctgggcttctccaagccgggcgtggagcataacctgccgattctggcggcgcttgaccggttcaacgcgactggctatccggtgctgatcggcgcgtcccgcaaacgtttcgtcggctcgctgcttgccggcgccggtgtgaccgagccggacatggcctcaaaagacaacgccaccgcggccatcagcgccctgtgcgcggaacatggcgtgtgggccgtgcgcgtgcatgacgtggcgaaaagccgcgacgcggtcgccgtcggcaacgcatggcgcgagtatgcgaacgcgtgaccgtgcgaatcgcagatagtcacaacatcgcaatcgcggaaataataggaatacggaacgtaggaacggcaaaggaaggctggtatggatcagattcgactgacgggaatccgcgcgacgggcaaacatggcgtgctcgacttcgagcatgagcgggcccagaccttcgtggtggacgccacgctgttcctcgacctcgctgccgccggccgttccgacgatctgaacgacaccgtcgactatggtgcgatcgccaaaggcatcgtggccatcatcgaaggcgaacacgtcgatttgattgaaaagctggccaatcgtatcgtcggcatgattctcggctttccggccgtgtgccgcacgcaggtcaccgtgcataagccgaatgcgccgatcaccgtgccgttcgacgatgtcagcgtgaccgtggaacgttcccgtgaaacagttgacagtccatcgcgtgagcggtcgtcggaacatgggcaggtgcatcatgccatcatcgccatgggaggcaatcagggcgatgtgaccgccaccttgcgtgacgccgttcggtgcattgatgggcttccctccacgcaggtgacgggggtgtcgccgctctatcggaccgacgcatggggcatgccggaaggtactgcggaattccgcaatgcggtcgtgtccgtggataccaggctttcggccgccgaactgctggccggtttgcagcgcatcgaagcctcacatggtcgcgtgcgcaccgaccattggacgtcgcgcacgctcgatttggacatcatcgactttgacgggcaggaaagcgccgaccccgacctgacgttgccgcatccgcgcgcatggcagcgggctttcgtattggggccgtggcttgcgcttgaaccggacgcagaactcgggggagcgcacgccggttccgtggcgcaactgctgcacgaaacgtccgaccgcgaccatatcgatgagatcgcggacgattggatggttgccggagctcaggatcccatagttcgcgattccgacattgggacgtctgcagatgacgttgatgcgattgacgatgccgattctgttgaatccattgattccattgaacttccggaaggtacggcggcctccaaagcagccgctgcggccgcggcgaaaccgggaccggcatcccgtcgagcggtcatttccctggatagcgtttcaactgatgcggaacaccagttccgtcaggcaatcgtggccatcgacgcgcttcccggcaaccaggtggaaggtatttcgccgctgtaccatgtcagccaggtcgacgactatccggacaaaatggccgccgtcatgcagatttccacgcgcatggacgcgcgtgagcttatcggtgcgttggaatcggtgtcatcctccatttcggatgacctcgacctcgaccttgtggacatggaaggcgtggtccgcaacgaacctgattgcatggtgccgtggccgtccgcacgtgagcatgcggccgtgctcgccccatggttcgacatggatccggacgcgaaactcggcagggatccggtcgcgttcctgctggcgatggctccggacgccgcgcaagtgggcatgctgaccgacaattggattatcggagacacgctatgagggcacgcagaaccccttggtggtcattcgtccttgcggccgcacttggcgtgctggccggcatgggattggcgaaatacggcgagatttcaggcctgccgttggttggcgcaccctggatcgtgccggtggtgctggccgtgttgggtggtgtggtgctgtacatggctctgcagattcataaatacacgaccaaagatcccgtcaaacgcgcgcagctcaagccattggacccgcagaaggcgttcggcacgctggtggcctgcaaagcgctcggacttgcgggcgcggcgttggccggctggtacggtgggcagatcatcatgagtctgccgcatggtgaggcggaattctatagccaagccatcatcgaatgcgtggtggcctgcgtggtatgcgtcgccgacatgatcgtcggcatcgtgggggagtggctgtgccgcatcccgcctatcgacgggccggaaagtccggccgtgaaaaaggccgcacagcgcaatcgctatgcggccgccgccacgaaggcgtctacaaaatcggctacgaatcctgccacgaaatcgaaagtctgaacgtcagaccttctttaactccgtctcagtccttcttcggcacgcggaacatcgcttcctgcgccatgcaggccaccagctcgccatcctgtgtgtagaccttcgcttggcccaagccgcgtccgtgcgccgcggtcggcgtgtcttgcacgtacagatgccactggttgatgtcgatgtcgcggtaccaccacatcgaatggtcgatggacgcatacgaaatgcccggcgtggcgatgcttaagccagcacggcgcagaatcggctccagcatgatctggtcgcagcccatcgccagcatcgcacgatgcatgacctgcggcacgtccaccttgccgtcggccttcatccacaccatctgcttgccggaatcctcgctggcgctcttcttgtcggcgccaagcatgatggtgcgcgtcacatggcgaatatcgaacggcgacttctccgcataatacttggcgaacggcgactgttccgcatacggctccatcagttgcttcgcactggtcaggctgtcgggatcgggaatgttctcaggcatcgggtcggcgaattcgatgccttcctggtcatgttcctggaagctggcgattgccgtcaaaatcgagccctgcgcctgcgtgacattcacgcgacgggcggagaaggaacgtccgtcacgcagattttccacgtcgaacagcagatcctgacggatatcgccggccgaaatgaaatagccgtggatggaattcggcagacgggatggagcgacggttctcgacgcggccatcagcgactgcgcgatgacctgtccgccgtagactcggccagtggggaagtacaggctttcgccgttgatatacgtatggttgcgatagtttgagggcgtgcccagctggagcacctttgccagtcgctgcagcggcgtcatgtctgtctgcgtcatgatggcctcgattccttccgcgtgtggatagctctttatgctggcatcgagtctatccatacgtagtaaatttcgtcggattgttttgtaacgagtacgtgagaagaatgaacggttggttagcaacaaacggttgacgtatggcaaagcgccaccgctcgtaatgaagggtggcgctttgctgaaatctgcgcttaacgcgactcgattggatctgtctgcctttagcgggtcagcttgcggtgcaggcggtgcgggcgggccgcatcctcgccgagacgggcgatgcggttctcctgataggcctggaagttgccttcgaaccagtaccagttggccggattctcgtcggtgccctcccatgcgaggatgtgcgtggccacacggtcgaggaaccaacggtcgtgggagatcaccacggcgcagcccgggaaggcgagcagcgcgttttcgagggattccagggtttcgacgtcaaggtcgttggtcggttcgtcgagcagcagcaggttgccgccctgcttcagggtcagtgccaggttcagacggttgcgttcgccgccggacagcacgcccaccagcttctgctggtcggaacccttgaagccgaaggacgccacgtaggcgcgggtcggcacttccactccggccacctcgatgaagtcgagtccgtcggacacggcctcccacaggttcttgttcgggtcaaggccggcacggttctggtcgacgtagctgatcttcacggtgtcgccgatcttgagcgaaccggaggtcaacggctccaagccgacgatggtcttgaacagggtggacttgcctacgccgttcgggccgatcacgccgacgatgccgttacgcggcagggtgaagctcaagtcgtcgatgagcacgcggtcgccgaacgccttgtggatatgctcggcttccagcacggtggaacccagacgcgggccggccggaatctggatttcggagaagtcgagcttcttgttgttgcgtgcctcctgctccatctggtcgtaacgttccagacgggccttgttcttggcctgacgggccttcggcgaggaacgcacccagtcgagctcgctcttcaggcgcttggcgagcttggcgtccttggcgccctggatctccatacgcttggccttggtctccaggtaggtggagtagttgcccttgtatggatacaggtggccgcgatccacttcgcagatccattcggccacattgtccatgaagtaacgatcgtgggtgacggcgatgacggcgcctttgtactggtgcaggaactgctccagccacaggatcgattcggcgtccaaatggttggtgggctcgtcgagcagcagcaggtccggagcctcaagcagcagcttgcacagtgccacacgacggcgctcgccaccggagcacacgctcaccggcgtatccggatccgggcactgcagagcgtccatggcctgctcgagctgggagtcgagatcccaaccgttggccgcgtcgatatcgttctgcagtttgcccatttcttccatcagcgcgtcgaaatcggcgtccggattggccatttcctcgccaatctggttgaaacgcgtcactttttcggcgatcgggccgaatgccatcttgatgttctcgccgacggtcttggtgtcatccagcggcggttcctgctgtagaatgccgacggtgaaaccaggggtcaggtaggcttcgccgttggaaacggtgtcgaggccggccataatcttcagcagcgtggacttacccatgccgttcgggccgacgacgccgatcttcgcgcccggcaggaagctcagggtcacatcgtcaagaatcactcggtcgccgtaagccttgcgggccttgatcatctggtaaataaactcagccaatgttgtgttccatccttaagaaacgttggaattccagcgttttgcgtatgtcggtcgacggaaaatcgcacttgttcgccgtgctgtggcgcgttgccggcgcgactggttgcggacgaatcgcaagtctgctgcgaactcatcgaagccaagtgttttcggaccgtgtccatacgcaaagtaccatcgccgattatcccatatcccgtctacacagcggtcgtgggtcggttgtgtgggaatggaagcgtgcctccgtacgtggttggtggtgatggtggcctgctgcggcggtctccgagcctgggtgtctccgtgtgcctctgtgcgcgcgatggcaccgagttgagatgtcgccggagagaggggagtcccggtgttgtccccgtaggtgcggtggcggtgattttgcgcggtgaaatcgggttttcgcgtacggggtatgtttcgaccgtttgagggcgaaatcgtacctccgtacgtgactttgttgatgattcttcctgttttcccgtgcttttcgagtacggggtggtgggttggctgttttcggcgggcggctattgattggtgggcggcaggccggcgatcaaatgatcacgccatcgcagtggtcgatctcgtgttggatgatctgcgcggtgaaaccggtgaacgctgcgtggcgctcgcggaatttccgatccatataatccacttcgatgcgctggtatcggacggtgcggcgctcgccctggagcgagaggcaaccttccgccgtatcgaacgcgccgtcttcggcggtgatgtgtggattgaacatcacgaaaatgcggccgccgaaatcctcatccacaaaagcgatgatgcgcttgggaacgccgatcatattggccgccatgcccacgcaaccattgcgatgcgcgtccaacgtgtctttcaggtcctgtgccacggccagatcctcttcggtgttctcggctgcggcggacggctggctcaaaaatgggatggacgtcataatctcacgttgcatgtgattcctctcgttggatgttgccggtctgccaatattgtagcgtcgcatggctgcgagacggacggctgggcgaacctgtccattccctgaccgttcgcgtcggcttcgggatgtgaggtgcaacgtgtgcggcttggactggtgcaatatgcttggggtcatggaagacatgttgcaataccgcgaatctatggcgcaggctcttgaactggcccgcaagggtgcgggatgggtggacccgaatccgctggtaggcgcggtggtggtacgtgatggcgaggttctcgccaccggataccatgaccggtatcgtggcccgcatgcggagcgtatggcgttcgactatgccgacgcgcacggcatcgatctgactggcgccacggtcatcgacacgcttgaaccctgctgccatgtcggatcgcagccggcgtgcactgccttgattctggcgcacggcatcgcacgcgtggtggtcggatcggttgacccgaacccgattgtagcgggcaaaggccttcgcatccttgaggaagcgggcgtcgaagtggttcgcgacgtgatgcgggaggaatgcgacgccatcaatcgccatttcttccactacatcaccacgggaaagccgtacattgtggacggcagaaggcgtgcgggtgaatcggactctgagtatgcggtccgtcggcgcgaactatatgccacatatgcggcggtgcttgccggaactgaatcggacgttcctgacgagtctttcgcgcatttcaacggaccggtccaagccgtcggcgcagacgaagtggtgattggcggccacaggccgttactcctggaggccggcgcgctcgcctgcacggatccagacgaatggctgagtgagctgggcaagcgcaaaatcgacagcctcatcgtggaaagcgacgaagcattcgagcggttgtccatggctttgccaaaaagactgaagcgccattcgtgcgttgttggccgtgtatctcgcttatagatggcggattcgtctgcttgtccagtgctatctcgcttataggtggcggatgaattttgcgaagaggtcttaaagggtgtaaatcataccctctaagaccttaatgacgtagaggcgccgccatctataagcgaaatagcatcgggcggctttccgattccgccatctataagcgagatacgtgagactgatatgtccagcacccagcaagcatagtggcgagcacatggtcgggcatggcgcgcatggcctcaggggactcaagctcactcggatcgcaatccagcagcactaggtctgccgcatctccagcttgcaacgtcgtacgccccagggcggtggacgaagcgagagcggtttcgaaatccagacattgctcagactggaaaggctctcgatcggaactctccgtgccgaacaccgctgcggaaatggccagccacggatccaacggcgcgaccggcgcgtccgagcccataagcagtttggttccagacttgtgcaaactgttgaacgcgtagggaattccggcgggattgccccagaatcgtgtgatgacgtcacggtcgtccatggcgtgctgtggctggatgctcgcggcaagtcccaattgcgcaagacgtggaatgtcgcgttccttgagcatttgggcatgctcgatggagccgtgcgcgtgggtacgttccgcgcagtcgagcacgatggtgttcgcttcgtcgccgatggcatgacaggcgatgtcgaagccatgttcggtggcgagccgcatatacgattcgatttgctcgggggtgtagctcagcgtgccgtaggtttccggcgtaatgcccgaatacggtgtggagcagtaggcggatcgggtgttgagcgagccgtcggaaatcatcttcatcgcaccgacatggcccaagccatggcttccgggaagttcgtcgccggtatgccagccgtcgtcgatggcttgctgaagtcgttcggggtaaacgccggcttcgatgcgcaatccgtcaagcccctgcttgaagcggtcaatccacgtgtcgatgttctcggccatctcatagtcgcgcacgccgaccacgcctttgccggcggcgtcctgttccgcgttgcgcagcaatcgcatcagctcgtcagccgcaccggggcctttgtccagcttgcagtaagcgtcgaaccattcaagctcgccgacgagtcccgactcgcctacatgcacgccgagcttacgagccgcggctgaattcacccagccgcaatgcatgtctgcgcttgacagcgccacgggctggtcgcccgacaccgcgtcgatcgcagccaatgtcggttgggcatcatcggcccacagggagtgtctgaaccgcatgccgaccacgtactggtccgggtcgagcgtgccggattcgcggcgttcctccaagtgctcgcgtagcagactcattgcctcatcggcgctgcgggcatcaatcagatcaagccgccccagcgtgtacgaccactgcgtgaagtgcgtgtgacaatcccacaagccgggaatgatccacgtttttgaagccttggctaccgacttttccgaagaccgtacatccgcgatccgcccttgctcaatcgtgatgtcgacagactcatcggaccccacgaaacacacattctcaatcacatacggttcgcccatacatcctcgattcaacaaaatgacctcattgccagccatagtatctttgcaatgcttgcgattgccgcgctcgtctcaatcggctatgcgcactttgaattcctccgctgggatacggttatccgcatcagaaaaggaagggcgcagttatccacttatccactgtttgccggaagccggtaggcagcgcggcgacatttcctctactttggcgctatggacaatggagcacaatattcggaaagcctcgcacggctgaggacaagaaccatcgaacaatgtctcgaagcgcagaggcgcaccggaaggcggctggtgttcgcgcttgataccgcactgagtttacaaggcatcgaactgcctcgctaccggcgcggagggcttttggctgatacgctgcacgcggtgattgaaagtaacggcgtgcgaacgatactgcagggaatttgttttgtgctttggtctggacctcagacgcatatgccgattcatcatggtcgattgcgatgcacggattccgtgaccacatgggccatgcatgccaatcggcttgaagatgaagaattggtggttttgggtgattcgatgatgcggcgtgatggacatatgaaaaaggccacactggaggagtttcggatatatgtcgatagcttgtccgatttgtccaactattcaggctccgacagattacgtgcggtgagaggagtgtcgaaaatgcgtagggctctcaggctgatgcgggagaatacagattcttcccaggaaacgagaagtcgaattgttctgttgtgttatggtttgccttgtccggaagtgaactatgccattcggctcaaaggctattctcatgtatttttcgcggacatggcttatccggatttgaaaatcatcattgaatacgacggcaggcatcatgcctcgcgatggttggctgacagtaaacgtcgggaagcgttggaggatgaaggatggctgtatatccaggtgacggcggaaaatctcagggatgaggattctcaaagggaattggcggaacgtgtggcgcagaggatgtcattgcgtttgggggagcctgtgcggctatgtgggcgaatgacgattgctcagatagccgatggtcggaggaagggcaaccgtctgtaaggcttgggcaagcccatatctcgcttatgaatggcggaatcgggctgcggcatgatgctatttcgcttatagatggcggatgaaatccacaaaaaggccttaagaggtatgaatattaccccctagggccttagcgattcaagaagactgccatctataagcgaaatagcatcggtcgggtgaagaaatccgccatccataagcgagatggcggatttctgcggctcactgcacggcggcgagggcttggtcgaggtcggcgatgatgtcggccgtgttttcgatgccgcagctcaggcgcaccaggtcgatgccgacgccggcttcctcaagctgctcctcggtgagctggcgatgcgtggtgccggccggatacagcgtgcagctgcgcgcatcggccacatgcgtggcgatggacaccatcttcagatggtcgaggaacgcggagaccttctcgcggccgcccggcacgccgaaggagatcacaccgcaggtgccgttcggcatgtacttctccgccagcgcatggtacttgtccgtttcgaggcccgggaagctcacccagctgacgcgcggatcggcgtcgagccacttggccacggccagtgcgttcgcgcagtggcgctccatgcgcacgccgagggattccagatgcatgcccatgatccacgaattgattggcgccggagtggagccgaagtcgcgcatgagctgcgcggtggccttggtgatgtatgcggccttgccgaattccttcgcgtaggtgacgccatggtaggagtcgtccggagtggtgaggcccgggaatttctccgcatgggccatccagtcgaaattgccggaatcgacgatcgcgccgcccacgcaggatccgtggccgtccatgtacttggtggtggcgtgcgtgacgatgtccacgccgtactggaacggacggcagttgatcggcgtcgggaaggtgttgtcgacgatcagtggcacgccgtgacgatgcgctgcgttcgcgaacttctcgaagtcgagcacgataagcgccggattggagatggactcgccgaacacggccttggtgttcggctggaacgcggcctcaagttcctcttcggtgcagtccgggctgacgaaggtacattcgacgcccatcttgcgcatggtcacgttgatgaggttgaacgtgccgccgtagatggcggaggaggcgacgatgtggtcgccgttgttgcagatgttgaacagcgcgaagaagttcgccgcctggccggacgaggtgagcatcgcggccgcgccgccttccagctcgcagatcttcgcggcgacggtgtcgttggtcggattctgcaggcgggtgtagaagtagccggattcggacaggtcgaacagtcggctcatctgttcgctcgactggtatttgaaggtcgtggcctggatgattgggggagtgcgggattctccattgcccggctgatagcctccctgcacgcagatggtgtcgacgttttcgctcatatgttccttctttcgattccgcgcttccgtgtgccgcgcaggtgttgcgccgcgatgcgaacaaacaaacacactgtatcactgcattgataaatggcttgattccaatggaaacgccgtatagtttaacgaattgacaaacttaggtaattcaatttattatgtagaccaagacgggcggaaagcccgctgcgaaataaagctttacgtaagtaaaccaagcaaaggagcattccatgggtctgtgggatatcgataagattccgtacgtcggtcgcgaaaaggggccgcaggagggtcttgctttccattactacgatgccgacaaggtcgttgccggcaagaagatgaaggactggctgcgtttcggcgtcgcatggtggcacaccttcgaccagcagctcgtcgatccgttcggcaccggcaccgcccagcgtccgtggtacggcaagtattccgatccggaggacgaggccctggccaaggtcgactacgccttcgagttcttccagaagctcggcgtcgagtacttctgcttccatgatcgcgacatcgctccggaaggcgacaccctgcgcgagaccgacaagaacctggacaaggtcgtcgacaagatcgaagagaacatgaagtccaccggcatcaagctgctgtggaacacctcctccctgttcaccaacccgcgcttcgtctccggcgcctccacctccccgttcgccgacatctacgcgtacgccggcggccagctgaagcactccctggagatcgccaagcgccttggtgccgagaactacgtgttctggggcggccgtgaaggctacgagaacctgtggaacacccagatgaagcgcgagcaggagcacatggccaagttcttccacatgtgccatgactacgcgaaggaaatcggcctggacgcccagttcctgatcgagccgaaggccaaggaaccgacgatgttccagtacgacttcgatgccgccaccgccatcaacttcctgcgcacctatgatctgatggacgtcttcaagctgaacctggaaggcaaccacgccaacctggccggccacacctaccagcacgagatccgcaccgcccgcgaggccggcgtgctcggctccttggacgccaaccagggcgacaagctcatcggctgggatatggatgagttcccgaccgacctgtacgagacctccaccgttatgtgggaagtcctcgccgaaggccagatcggccctcacggtggtctgaacttcgacgccaagccgcgtcgtacctccttcaccgccgaggatctgttccgttcccacatcgcaggcatggattccttcgcagcaggcctcctggtcgccgccaagatgcacgaggacaaggtcatcgagaacctgcaggccgagcgctacagctccttcgattccggcatcggcgcaaccgtcgagaacggcaccgcctccctggcttccctcgaggagtacgctctggatatcccgcagtccaagctcatcgaagccaccaagtccgatcacctcgagtccgtcaaggccacgatcaacaactacatgatcgacgccctggccgaggcgtgagccgaaaactcactagggttttaggtagcctcgggcgaagtccgagacggtagtcgagggcgagcaatgactgggcgcgcgtagcgttccggaattgcaggaccgaggcatgggcgcagtaaggagtttccgttaggactcctgattcatcgctggatcaaacagtggggctcgactgtgacagagccggatgtggtgtgccgaagcgtcggtgttccggcacaccactcacttttctttccttcctccttcctcaaatttccttcgcacgcaagtcgtttgccggctagatcgccggtgagcggcttgcgtgcgttgttagaccaagcgaaaatttcgattattcgcaatgatgtgatgtatccaaacgttcccgaatgaggcgtacttatgaccacaacgattaccatcgccaatcccattcttcacggaatgcatcctgatccgagttggatttgggatgatgatcttcggcaaatcgtgcttgtgacctccaccttcgaactggttccaggcttgcctatttacgtttccagggatatggcccactggaaacacgtgtcggatgccatagatgaggagttggcaagacgtttgctcattcctttcgtggatgactcgggtggcgtctatgcgccgacgctgcgtaggattcgtggcaaatacgtgattgcctgcaccatcgctcgcatcaatggacgcaaagccatcgcggaaggatgctcccaggccgaattggatgcggcccaggcggcggaaggcaacttcgttcttgagtcggactcgatcgacggaccttggcgtgggccgttctggatcgagggcgccgaaggcatcgatccagacatattcgaggacggggacggcaatgtgtactggacccagacccgtcctgcggtcaatccgcaatgggaaggccagaccgaggtctggacccaacgcattaatccggagacttggacttttgtcgatgacggtcttcctgcgggatcgggcaagacggtaatatggcgcggatacggtatggaatcggtgtgggctgaggcgccgcatctctatcgcgtgggtgattatgtgtatctgatgaccgctgaggggggcaccagtttcgaacatagcgaaatggccatgcgcatctatgcaccgcatggactgcttcgggcgttcgaagcttacgaacgggaagcatccgaatcgggtgagtgcattccgcaggttcgtgacggggaacgctgctatcttggcaccgcaatccgtgccttccacgcggataagaagaatccgattctcacccaccgacatctgggtttgtcggaaccgctgcaatgcgtgggacatgcggacctgttgcttcatccggaactgggatggtggctggtgtgtctcggcgtgagggagacgcggggaaagcatgacggcgaattattgagctacttgggaagggagagctttgtcgctccggtatcctgggaacataatccggccgattggaagctggacggcaacggtgcattagatacgcatgagggtgaccccggatggccagtgacgtgcgctggtcttggccgcttggccgacgagatcacggttactactgaagacgatggcatcaccatcgagcctagggtgaaatcctcgctcgccggtgacgtggaacctgcgctggtggatgtggctgatggctcgacgaacgatgtggtggtgcgcgacgagcgtgatgtcagctaccgcagaatagcgaaactgccgacgctcatgccgattcccatgtccggttctttagtgattcggcagaattccacgcattacgcggtgttttcgatgcatggcacggatgtgcgctacgagatggtgaatggagacgattcgcaagctgggtctgttgccgtacaggctgacggagtgcgtccggcggtacttttcgacgacaaccgcttgtcggtcatcgtaactggcatgcatggtccggttgattctgcgacgttcgtgcgtcaggggcaggtcctgctgagtgtcgatgcccgtttcctcagcaccgaatgggctggtgggttcgtcggttgcatggccggcttcatggcatagattctacggaatttcaggatggttcactgctggtgttccgacgggccgtcttagaacgaggtgaaaacgggtcgaaaggctaggagcgctgtgttctcccttacggttgtgcctgtgaggtttgccccgctgattaaccctcgagttgctgtgtgctgttgcgtaccactagcgatgtcggcatgatgatgtgcggttggatcacgtcgtcggtggacagcgcctcgaccagcatgcgtacggcggcccttgccatgtcttggagcggctgccgtacggtggtcagcgccgggccaaggaatgcggcagtctgcacatcgtcgaatccgaccacggataaatcctccggaatacgtaatcccagctgtcttgccgcctcgtagacgcccatggcctgcagatcgctgccggcgaagattgcggtcggacgatttggtcgtttcaacagggagatggactgtgcgtaaccgccggaagtggtgaaatcgccttcggtgataagttcgggatcggtttcgattccatgttccgcaagcgctgatgtatatccgtccagacgtgctttggaacacatcatttcctccggtccggtgatgatgcctatgcgggtatgtccgagtgcgagcagatgcctggtggcgattacgcctccggtccagttgtccgcttgcaccgacagcgtgtctggatctggattaccgaatggatcgaacaagacgaagggaatacctctggaatgcagtttgttccgttcgatacgtgtcagactggagaagacaagaatggcgccatctgtctgccgacgcagcatgttgtcaatccaggatgagtccgggtgctggcgattgccgccttcggtggtgatgacgttcaaatcatgcaacttggcttcgcgaatggcgccacggagtacttcaagggcccaaacattatcgaaatcttggaacacgatttcgataattcgttggcttttcgcgcctgtcgctttacgggaatacccataccgtttcaacaccgcgttgatggtttgccgcgtctcttcggaaacgtcggctctgccgttgagcgccttggatacggtggaaagggaataaccggtctctttagctatgtcagagagtcgtaccgtagctttctttgtcgtattgcgcatgagtcactccttcttcatgctcatcatatccgaaaacgcgaacgaaagtttcggtttgcgtttttcgaaactttcgatatgttggcaatacttaaaaacgttgtaaaatcaacgaaaaataattagttttctgattttacaaaaaacttgactttgtgtgatttgtttcggtagtctataggtacaacgaaaacgaaatggaaattttcgaagggagtcaaaggctgattctctgtctgccaggggagctgcagcagcattcgttgcggtcatgcttcccgattcgacccattcgagagaaattcctgtcgttgccatcattttgtcgatgatgatttggtcaataaggagaagacaatgaagttcagaaccattgcagctgccactcttgcggtggcgaccatgttgggcatgggtgcctgcggctccagcactggtgctaaagacgataagaccattacgttctggcataacgcaacagctggtgacggcaagcagtattgggaggatatggccaaagcgttcgagaagaagactggtgtcaaggttcagattcaggccatccaaaacgaggatttcgaaggcaagctgaccaccgctatgcaggatcccgcctccggcccggatgtgtacatgacccttggtggagccaagaccaaggacatgattgacgccggacagaccatggacctcactgataagatcagtgacaccgtcaagaagcagatgtcttctgcgctggagtccatgtcctatgacggcaaggtctatggtgttccagtcactgtgcagcctggtggcatctggtattccaaggatctgttcaagcaggctggcatcgatgccgcgccgaccaccttcagcgagctgaagaccgatgtgcagaagcttcgcagcgctggcatcgatccgatcgcactcggcggcaaggatgcttggccggtcggtcactggtactactggttgtccatgcgcgaatgctctccgaaggcctacgccaagggcgtcaatgacaaggacttctccgactcctgctggaccaaggccggagatgatctgaaggatttgttggatgcgaatgcttttaacgaaggattcctcaccacgacggcccagcagggcgccagctcgtccgcaggtctgctggccaatcataaggctgcgatggagctcatgggcacatgggagcctggagttctcaaggacctgactccggacaagaagccaatggctgaccttggcttcttcgccttcccgaccgtggacggaggaaaaggcgaggaaggtgctttgatgggcgctgtgaccggtttcgctgtcaatcccgaggctccggacgctgctgttgatttcgtcaatttcatggctgagaaatcaaatcaggagaaatacgccactgcgttcagcaccattccggcttccgccgaagcttacgatgcggttaccgatgaaaatcttaaagccatcatcgaagctatgaaaaagtccgatggcatgcagctgtggatggataccgctctcggcggaaatattggcaacgctcttaattccggagtggtgaatctgctttccggacaggggacttcggctgacatcgtcaaggcgatgaaggacgcagcggccaagggctgacagtgaacatggctggttgaaggccaaaggagggtggatagacagattttcatctgccctccttcctattcgagaaacgtatctggtagtggagaaaaccatgtcaagtacaagcaaagacgcggtgacgctgcgcgctaagcggtccaagaaaccgtccgatggcaaaatgcgtcgtaatgttgagattttcgtactgtccgcacctgcgattcttctgttcgtctgctttgtgattctgcctatcgtcttgggtgcttattacggcttctatcagtggaagggttacggacttccctccaagacaggtaaattcgttggtctccagaactacatcacagcgcttaaggatcccgcgttccaggcggcaattctgcataccttcgaggtcgtgatcggctcgttggtcatccaggctccgctcgccatcctgttcgcattgctgctgaaccagaagttcaaggggcgtggtctcatccgcaccctcatcttcgtgccgtatgtcgtttccgaggtcatcgtcggcacaggatggagcctgttgctgcagaagaagggcgccatcaatgagattctggccaacttcggcatcaatggtcccgattggctggccgacccgaagatcgctatttggacgctgctgttgctgatcagctggaaatacgtcggtttcgccgtaattctgatgctcgccggcatgcaatccattcccgaggaactgtatgaagcagccaaggtggatggggcgagtttctggcagatgcagaaaagcatcacgttgccgttgcttgctccgacgttgcggatctgggtgttcctttccatgattggctctctgcagcttttcgatctggtctatatcgtgtggggcaagtatgtgtcgaccaccgctggtgtgtccaccatggccacctacatggtgcgtgaaggtcgtggagccggcaactatggctatggttccgccgttgctctgatcatcttcgtgatctctttgatcatcgcactcgtctatcagaagttcgtgctgaaccgtgacttggacggtgctgttactgaacagaaagaagccgagaagcgtgccaggaagcgcgcaaaagaagtgcagcatcgtgaggttgctgccctggcaagtgaggtgaagtgatgactgccgcaacaatcgcaggacattccaacaaaagcgagtacagcaagaagaatggttaccgtaagtcatccaagacgccatggggcaacccaatcgtctacttcttctccctggtgcttgtggccatctgcatcactccggtgttgtacattatcttcggcggtttccgtaccaattcgcagatcaccaaccatccgtccgggatgccgaacccatgggtccccgacaactacaagacggtcttcgaaagtgatattttctggacggaactgaagaattctaccatcgtgggtatcgccaccatggtaggtgtcgtggtgcttagcatcatggtgagctttgtcatcgcccgatacaaattccgctatgcgccgcttatgtacgcgttgttctctgctggtctcatgttcccgatgaccgttggcattacacctttgtatctgctgattcgcaatctgggtctggccaactccctgtggggtctgatccttccgcaaattgccttcggacttcctcagaccatcatcatcttggtgccgttcctacagtcgattcctaatgagcttgaggaggcctgtcttctcgatggatgctcccgccttggcttcttctggcgcatggtcattccgctgtccatgcctggcgtggccaccactggaatcctcaccttcgtgggaagctggaatgcctacatgctgccgctgttcgtgctcagtgatgccaacaagtacacattgccacttggcgtacagatgttcagctccgaacactccgttgacaccgcacaggtgttggccttcacctctctggctatgattccggccctgatctgtttcaccatcttccagaagaagatcgtcggcggcctgacaggtgcggtcaagggctgacgaaatgtgacaatccacgcccggaagatgttcctttccgtcttccgggcttcatctcttatgcaagaggtacattatgaagatttccaacccggtgctcaccggttttcatgccgatccttcaatgattcgcgtcggtgacacttattacattgccaattccactttcgaatggttcccaggcgttcgcctgcatgagtccaaggacctggtgcattggaacattcttccaagcccgttgagccggtccagccagcttgatatgagaggaaacccctcttcgggaggcatctgggctcctgacctaagctatgcggataacaaattctggttgatctacactgatgtcaaggtggtcaatggtgcattcaaggattgcactaattatttggtcaccgccgaggacatccacgggccatggagcgagccggttcgcatcaacggggtcggttttgacgccagcctgttccatgacgacgacggccgcaaatacttggtgcagcagacatgggatttccgtgaataccaccaccagttcgacggcatcacgttgacggaattcgacgtcgacaccatgaagctcaagccagaaacggcccgcaccatctgggatggcacttcggtgaagatcaccgaaggtccccacctatacaagaaggatggttggtactacctgtttgccgcagaaggcggcacggtgtatgaacatcaggaatctgtggcgcgttcccgtacccttgacgaatactccttcgaagttatgccgaatggcccgttcatcggtaacttcgacactcctgacacctatttgcagaagcagggccatggagcgttggtggacaccccgtccggcgagtggtattacgcctccctatgcggtcgtccgtggcgtcatgataccgaaccggcccatggcacccgcggatggtgcacactcggacgcgagacctccatccagaaagtcgaatgggatgaggacggttggccgcgcgtggtcggaggtcacggcggacagcgttacgttgatgctccgaaagatgccatcgagactttggccccaacaacgcgtgacgaacatgatgagttcgattccggcgagctcggtccgaattggaacactctacgcgtcccgttcaccgacgccatgggcacggtgggcggtggcaaactggcattgcgtggtcagggctcgctgtgcaacctgtttgacttgtctcttgtggctcgtcgctggcaggcatttgatttcgacgccgaaaccaaggtgcgtttcgatccgaagaattacatgcagatggcaggcctgaccaactattacgatgacctgtgctggtcatgggcgtttgtcacttgggatgagaaacgacatgcaagggtcatcgaagtggctcagaacgatttcaaccaatatacgtcgttcctcaaggatgacgccatcgtagtgcccgaagacgccgaagcggtatggctgcgcaccaaggtccgcacggaatactattcctacgaatattccttcgacggagaacatttcaccgagattccggtcaagctcgatgcgaagatcctgtccgacgattacgtgaaccaacgttacggcggcttcttcacaggcgcgttcgtgggacttgcctgcgtcgatctgtccggctacggcgcgcaggccgaattcgactacttcgactatcgggagctttccgataaccagtagacagtgccggctggcgacagagcgtccgtcgtcagccggcatactcgacggcattgaaatctatgggcaatgaggagcggacgagcatggtcttgcgattgccgaaactgcttgacgacggttgcgtgctgcaggccggtgcgaccatacatatctggggcaccggcgaccctggacgcggcgtgctggtacgcctcgatggcaaggaccggactacacgggtgggggacgacggctcatggagcgtgtcgtacggtccgatcacagcaggcggaccgtacgatttgacggtgcgttatgaggacggaaccgaatgcatctcgcgccaatgctatgcgggagaagtgttcctgtgttcgggacagtcgaacatggaactgcccatggcttgggtgcgtgcggactatccgttggagtgggatcgtgagcctgacccattgctgcggcaatacaaagcgattcccgattgcgacttcaacggtccccgcagcgatcatgaccatgcattctggcaggggtgcgatgcggaaacccttggggatttctccgcgctcgcctatttcttcggacgcaggatccgtcggtggctgaatgtgcccgtcggcctgttgaacgtttcattgggcggatcgccgattgaatcctggatggatgccgacgcattgcgggcgttccccgaagcgctcgctgaccttgagccgtatcttggcgatggcgtggcgtcgaagaaaagccgcgattccgttgccgaacgggaccggtggtatcaggcgcttggatacgaggctgtggccgatgcccaccatgaatggctgccattgatcgcgtgggactgtccggaatccaagaacatcgagccgcgcgacgtggcatggcatgacatacgcctgcctggatggtacaaggatcgcggacttgccggtttccgcggcgagattaccatgagaaaaaccgtgttcctgcctccgtcggatgcggggaagcccgccctactgcgtctgggcaccatgaatgatgccgaccatacgtgggtcaatggtgtgttggtcggtgggcgaagcaatgtgtatgagccgcgggactatccggtcgcagccggcgtgttgcgcgccggcgcgaacgaaatccgcatgcgtctggtcgttgaacggcccggcggccgtgtgacgcccggcaaacggatgacactgaccatcggagacgatatcttcgacctgtccggcatttggcagtatgccgtgaccgccgaagctgaccgcgattgcccattcgaggatttcgtcagatggaagccgaccggcctgtacaacgccatgctcgccccgtgttttccatatgcggtgcgggccgtgctgtggtatcagggcgaatcgaataccggcgatcgcgccatgcaatatggtgacgagctgaaggccatgattcaattgtggcgcgtcaaatggcatcagccggatatgccgtttctgatcgtccagcttccaaaattcgacatcgacgccatcgaggatggtggttggccgcttattcgagaacaggaatggagagtggcggacgaacttgaacacgtggctgcggtggtgacgcttgatgccggtgaaagcaatgatttgcatcctcatgataagaaaaccatcgcggatcgtgcattcaatgtcgcgatggattttgtgtatggccagcaggctcagcctcagccggttgttgaaaccgcagaggcggacgatggattgttgaggatgcactgcgtgtggcggaattccatgggcgaacagatgcaatcgcagaatcgccatctgatgacgttggatggtgacgttccgcgagaaattgatttcctgtggcacgactgcgccacttcggtgcgggctgaggcatggctggatggttgcgatattgtggcgcgcataccgtcgcgcatgccggacgaggtgcggtatgcgtggagcaacagcccggaatccggtctcatctgcgacggggacggtgttctgcttccgccgtttcatctgccgttgcccatggttgattaggagcagtcatgcgcagacaagtcatgattcgtcaaggatgtgtccggattctccgacgcggatcctgtgatcaccgtgtttcggggcattccatatgccaagccgcctgttgatgagttacgctggcgtgagccacaacctgctgaagcgtgggatggcgtgctcgaagccggtgatttcgcgccgatgccgatgcagccgctgcccggctcggatgagttctacggcagggaatggcagattgacgctgacactccgatggctgaggattgtctgtatctgaatatctggacgccggccttgcgtggatgcggcagtggttccgagattcgtacggattcccgttgcgatggtcatgggctgcctgtgatggtatggctttacggtggagcgtttcagactggatctacctgtgagaaggagttcaatggagagcagctggcccgtcagggcgtggtggtggtctccattgcttatcggttgaatgtgtttggttttttcgcgcatgccatgttggaaaaggaagcggttgatggacggccttgtgcgaatttcggatttcttgaccagcggatgggcattcagtgggtaaaggacaatattgccttgtttggtggtgatcctgcgaacattaccgtgttcggccagtccgcaggggccgcaagcgcgttggcgcaaagtgtctcgccgatgaacgatggtctgttccaacgcgtcatcatgcagtctggaggtggaactggtctgttcaatcgccatctgtggtctcttgaggatgcgcagcgaaatggagcgcgttttttgaagtatctggaagttgaatcgattgccgaggcgcgttctgttcctgcgactgatctgctggaggcggcggtgacttttcctgcttgcgattggtctgggcagggtgatgatgtcgtatgggctccgatgactaattggattccctgcgtcgatgggacattccttgtcgagcaataccgtgatgcgcttattgcgggacatcgcgttccgtgtgatttgttggtggggaacacgaccggcgagttcatggttccgggccctgatggcactccgtatccggagggtgagtgcggcaatctggatatgatcgatgcatgggtgtcaggcggcggctcggaaccatacaggtatcgattcgatgtggatatgccgggggatgatgccggtgcgtttcattcgtccgatttatggttttcgttcggaacgctccctgcgagctggcggccgtttcgaggctggcattacgatttgtcccatgcgatgaatcgatattgggtgaatttcgcggcgacaggtgatccgaacggttccggattgcctgagtggacggcatgcggacctgatggtcaacgatatatgctgttcggtggatgccacgatacgccgggtaacgtttcatgcgtcatggtcaagtaagtgaatatagtatggtgtgagcgttcactatagtgcggtggaatgtgatgaaggagacggatatgacgcaggagacggaagcgctgatcgcgtccgacgaggatctgaccaaactgttcgccggcaagccgacgcaatatcgcaaatcgaagtcgctgccgaaattcacaggcgaggccatgcgcgcctgcgcgaagatcaaccgcatcttcttcgatgatccggacgaggcgtaccgtttgtttcacgagctggtcccggacgcgggggagggcgtgcagttcacgccgccgttcaatgtcgattatggtatcggattgaccattggccgcggcacgttcctcaacaaggatttcatggtgtgcggcggcggatatgtgacgctcggtgaggattgtctgatcggtccgcgctgcaccatcgccacacccaaccatgccaaggacgctgccacccgcctggcgggctgggagcatgccagtgccgtgaccatcggtgataacgtgtggttcggcgccaatgtgacggtcacgccgggggtgaccatcgggtcgaattccatcatcggcgccgggtccgtggtgacacgtgacattccggagaatgtcatagccgtgggcaatccagcgcatgtgattcgtgagattcccgaacatgaccctgccttcgccgatgtggaaggtttgctgtagttttgcaaacgtttcatagggggtgttgacggcaaatcgatttctccagccatgcgatgcaggtgagcgcgtaaagccttatacggaagctgtcgttcatattgtcgtttctatgagtatggttcatgaatcagcatagggccgggaagccccattgttgggaagcttcccggccctatgcctgaattcctgcggtgatggatcagccgcgggccttggcgtaggcttcgtatacggcttcggtcggttcgccggtctccacgccgtcgatggtgagttgccatgccggaggctcggtttcgccggacagcacccaggcggcctggcgggccgcgccgatggccacgtattcgtcggtggcgggtcgggtcacgtccatgcccagaatgcttggtgccagcgtgcggatagcttcggacttcgcgccgccgccgatgagcagaatgcgcgtgatgcttgcgcccagggatcggatgagctccaggcagtcgcgctgggagcacagcagtccttcgacgaaggcgcgggccaggttctcgcgtgtggtgttggccagagtcatgccggagaaggtggcggtggcattcgggcggttcggcgtgcgttcgccgtcgaagtacggcaccagggtgatgccgttggcgccgggcttggaggcgaaggccagcttggccagttcgtcgtaatccacgccgagggcggcgcggccggcgtcgaggatgcgcgaaccgttgatggtgcaggccagcggcaggtagtgcccggtgcagtcggcgaagccggatacggcgccggtcaggtcgtaggttgggttctcggagatggctgcggccacgccggaggtgcccagggaaatggacacgtcgccgacggccatgcccagtcccagcgatgccatggcgttgtcgccgccgccgggggcgagcaggcagccgccttcgacgttcttgccggcgatggccggatcggccttgacgggggcggcgtcgcgcggccccagcacggtgggcagcacgatggcctcggcgtgcgattgcgcggctttggcgccttccgcggcctcgagcaccatggcgatcaggtcgcggcggtattcgttcgacgcggcatcgtagtagatggtgccggaggcgtcggagcggtcggtgaacagggcttcaagatgggcgtcctcgccttcggcgaccgggccgtaaccggcgatgcgccagctcagccagtcatgaggtaggcagatggcggcgattttcttgacgttttcgggctcgttctcggccacccatgccaccttggtcagcgtgtaggatgcgacgggggaggagcctacggccttgacccaacgctgcttgcctcgggcgattgggtcttccggctcgccgtcttgtgcgggcgctgcgccgagcttttcgatcagagccgcagcctggggcgccgaactggtgtcgttccacagcatcgcatcgcggatcacattgccttggttgtcgaggatcaccatgccgtgctgctggccgccgacggccagcgcggatacgtcgtccaggccgccggcctgctcggcggcctcttggaatgcgctccaccagtatgaggggtcgacggatgtgccgttcgggtgtttggcctgcccgaatcgtacaagctcgccggtttcggcgtccgtcacgcgtaccttgcaggactgcgtcgatgtgtcgacgcctgcaaccagagtccttgccatagtttgtgttgcctccttgcatgtgccgttcgccggtggcgcacggttaatagttagatgaataaactatactatagtagtgtagcatcaggaaaggctccggaacatcggttcgggaaattcatgctgatgcggcaacacggcaaacagggcagggacgggaacggctatggtatctcttcgcaggatcaatcaggacgatctgcgcaatcacaatctttcggtggtgattgacacgctactgcgtgcctccgggccgatgagccgagcggatcttgccaaggagaccgggctgaccaaggcgacgatgtcgttgctggtgtcgctgctgatcgatgcgggcgtcgtcaaggagggtgagccgcagaactcggccagctatgggcgcccgtccacgccgttgatgctgggaggcggcaaggtgtgcggcatcggcatgcaggtcaacaccgacggctatggatgcatggctttggacatcaaccacgacatactcaggcacgaatgggtggatgccgacatgagcggcgtcgagccggacgtcgtattcggcaagcttgacgccatggccaaggcgatggctgaggatctggaatcgaaacgatgcatcatcgcgggcgtctcgtgtgcgctgccgggcttggtcacctccgacaagaggctgctcatggcccgcaatctcggttgggagaatgtcgatctgaccacgttcgacgttatgcgagggtatgacgttaccccgtgcaatgaggcgaagctggccgccatcgcgcagattccgggatatgcctgtgcgcgtgcggacgtgttcgatggcgtggattgcgccgactccttcctgtatctgtcgtgcgatatcggcatcggcggcgcgatcgtccgtgacggtgagatcgtgtcgggaagccacggtttcgccggtgagatcggtcacgtgtcggtgtctttggacggtccgctgtgcggatgcggacgacgcggatgtttggaaacgtatgctggccgtcgcgcgctggtcgaggcttccggagtggccgaaaagaatgcggcttcgagcggtgaggcactggagcgtctgttggacgcatggcattcccatgatgtgcggaccgtggaagccgtcggacgggccatcgacgcgctggcctcggccatcggctccgcactgaatctggtcgatgtcgataccgtgctgctgggcggttggtggaccgatttcgggccgttcttctacgaaacgctcgaaaaccgtttggaatcgcaggtcttgggggcgtcggacatgcaggtgagcgtgtccatcccgttggtggccgaccatccggcgttgtacggtgccgcggaagtcggcttgcgcaaattcatcgacaatccgctgacgttcatcaccgacaaagcatgattcctgagcgccgccgcaacgtcactcgtgcgcattgacatattgcggattctccactttgcccgttccgccataccgtttgaagccccacagcagaatgagggatttcgcatacgccacccaggcgatgccgaagaggatggcgagaacgcgtatgaacggtacgaaatatgacaggccggccgcgagtacgtcgatgacgacgaggacgagcgagcaggggaaggctcgccaggggaacatcgccgatagcgagaagagcctgccggtggtgttggcgaagcgtgcctgcaacggtgcgacgtattcggcgaacagcgccacgaccacggcggcgatgaccagaaggatcagcggtatgtaggaggcgttggtatcccacgccttccagaacgacaggccgaagaggatggcggtggcgaggatggcgacgagcacccaggccgcaagtccctgtttgaactcgcgtttgaaccgtttgagatactcgcgtaccagattgacgtcgtcatgctcgtcataggcgaacatcgtgctgtacagggcggcgcgggccgggccgatggtgatgctcggaatcagggtgaccaggtagacgagattcagcgcggtgaagcgcgccaacgtgttcatgaactgccagaacggggcgttggtgttgaatttcatgatcctccttgaacagctatttataagtatataaatagagatgatatttgtccagtgctccgtgttgcgccaatttctggagccacaccatctacgattggggcgacgtggtgccgcccgtcagctacggcgacggcatcagcgacgccaaatgcgtggtctccggcctgcagatggactaccgtcgtttccaaaaccaggcgcagctggcctgctatacgaacgagcgcgacgcgatccgtgcttacgacgcggccacgccgatcaccaccaacctcatgggcacgttcaaagacctcgactatttcgaatgggccaaggaaatggacgtggtcagctgggacaactatccggacatggacactccgccgagcttcaccgccatgtgccacgacctgatgcgcggcatcggcggcaacaagccgttcatgctgatggaacagaccccgaaccagcagaactggttcccgttctgcaaagtcaagcgtcccggcgaagtgcgcaagctgagctggcaggccgtggcgcatggcgcggacaccgtgcagttcttctagatgaagcagtcgatcggcggctgcgaacgattccatggcgcggtcatcgcgcacgatggcaccgaacagtcacgtgtcttcaaggagaccgcggcgctcggcggggaactggaccgcatcggcaagcggatcatgggatcggaaatccgtgcgaaagtcgccatcatgttcgactggcaaagctactggtctctcgaaggctgcgtcggaccaaccgccggattctcctatccgaacgaagtgcaccgcttctatcgcgcgttctggcgacgcaacgtgcctgtcgacatcatcgaaagcaccacgcctctcgacaagctcaaacaatacgatctggtggtcgcgcccgccctcatcaccgtgctgccgggcgtcgccgaaacgctggaatcctacgtatccgaaggcggcagcttcataaccggctacatggccggcatccacgacgaacacgacctcgtggtgccgggcggctatcccggcaaattgcgcgacctgatgggcgtatgggtggaggaaatcgacgcgctcgcgccggacgagaccatcgaagtgcatggcgacgcggttgatgccaagggcgagatcgtggccagcatcatccaccgcgaaggcgccagacggctcgccgcctatggtggcggcgaattctacgcgggccattccgcgctcaccgtcaacacgtacggcaaaggcaaggcgtacttcgtgggcacgctgttggacgagaccggtatgagcgccttcatggccccgatcatcaaggagctggggctgaaaccgctcgacaccccggaggatgtgagtctgtccgtacgctatggcgatgacggcgtccgctacgcattcctcatcaacaacagcgaatccgacaagaggctgtgcctggacgagctcgacggcggtgtggaactgctcaccggccatgtggtcgacgggccggtcgggctcaaaccgtacggcgtgaacgtgatcgaactcggataatcggcatcggcgtcgtcacgtggcaggatgcgtcagacgcgaccgaatacgcccgcgcaagtcgccggacgctatactggtcacaggttttgaactctattgaagacaggttagatagcgatatgactgcgaagaggcgcattcttgcgttcgagatcggcacattcttcacgcgttacgtggtgttcgaggatggccggatgggcatccccggcaccgtcgccacgccggtcgacagcgtggaatctttctaccaggcgctcgcgcacatcgtcaacggccaacgcgcgccgcttgacggcatcgccatgagcgtgccgggattcatcgacgtcagcaaacaggttgccgtcaccgccggcgcgttgggcatgctgtacaagcatgagatcggcaaggaactgcaggaatatcttgacaagccggtgccgacctggatggagaacgacgcgaactgcgcggccatggcggaaaaactctccggcaacgccgtcaaactcgacgatttcgcgctgatcaccatcgacaccggcatcggcggcgcgctgtttttgggtggcgggattcgccgtggcaaggattggcgtgcgggcgagctcggcatgatgattccgaactatgaaaccggcgggttcaacaccatgcagaactatttgtccaccatcgtgctggccgaggactacgccaaggaattcgacgtgccgaccggttccatcgtgcccgccaccctgttccgcaggcttgacgagccgcgcgtgcgcaagatcgttgacaaatggattgattacctggcgatcgccattttcaacaccgccgcagccaccgatccggaatgcatactgctcggcggcggtatctgccgtgaacagcagctcttgccgatggtgaacgcggcgctcgacaggattccgcagtggggcgatttccgcacatccgtcaaacgttgccgccacacgaacaacgcgggccttatcggcgcatactacgccttcgaaacggaagtcggcggccttactgacgtgccgataaggtgaacggcagcaggcagcggtctggggcggggtcgtattcgcttggatcggtgaagccggcccattcgcttggcgggaagatgatgtcggaaatcgacatccattcctcaagcagattcatcgaatcgtcgcccagccaacggtattgcagaccgtccatcgcgctcatcgccagcgtatacaggtcgtagaaacgttcctcgtccacgccggtcggcaggatccagttcatcgaacagatcatctcccaattgcgcatatggcggccgatgaagaaattatgcgccggatgcgtcggactgagcgcttcgccgttgagcaccgaatacaactgcaccaattccggacgctgcagattgtacagtgcgatgttcagacagtaacgggggtagaaatacacgcgatgaccgtcgttgtcggtcacggcggcggtcaccgcattgtactcgtcggcgtcgggggtgtcgtagcattccgacagcaccatgttgagcaggtcatccttcgacgaaatgtaatggtagagcgccgcctcggtgatgccgatctcgtcggctatgtcctgcaggctcatgccccagaatcctttggtggcgatgattttgacggccgcctggaggatctgcaggtgcctctcctcctgactcatgcgctttttcttctcgaaggtcttgcccgccaatgcgttgcgcgcctgagtgccatagggggttgaagtgttggcgcgtgacgcggcgggccagctgtcctgttcctgcagaaaacggtcccatgccgcaacgctcatgtcaatctcctatggtcttggttaatggtggttgttgcaccgttgtgcaactgtacttgatggtggccacttgatggtggccgccacgtgatggattcactgagcaagcgtgcggcgcatccatgcgacggccagcttcggccaagcttgcacgcattcctcgatgccgttgacgccttgccacgccgtctccgcggtgcccagcgccagaccgtgcccgccgctggggaacaggtgcgcctcgatgctcacgccggctttcttgcaggcatcgatgagcataagtgtgttctcgtagggcacgcagtcgtccggaacggtgtgccatacgaacaccggtggggtcttggcgtcgatatgcttctcgatggatacgggttcgagcgcttcggcatcagccttgcggtcgccgagcagcgcgtcgaagctgccgcggtgcgcaagcggtccggatgtgattaccgggtaggcgagcatcagtgcgttcggacgtaccgcgtccggatcatagccgtgtgccgcgagcacgtcgtcactggcggaagtcgcaagattggcggcgaggtggccaccggcggaaaagccgatgacggcgattcgatcgccgtcgacatgccattcggcggcgtgcgcacgcatgcgtcgcaccgcttctgcggcttccagcaacgcgacggggaatacggacggtttgacggaataccgtagcacgaaggcgttgaaaccggctgcaaggaactgcatggcgattggctcggcctcacgatcagacgtcatttcatagccgccgccgggtatcaccagcacggatggacgtctgcggtccgggtcgatctccttgctgttgtcaaggcaatagccgacgaatgtggccgtgctgtcatcgatgccgggaatcttgtgttcgaaatatgaaatattgcatggcatccatcctattcgtatgaagttcgtgtggttatgccgtgttaccgtacacggtttgcgtgtttccccgctcttggggggtattggaaacgggcggccgcgaaaatgcttccacggccgcccgtttccaatactcggatagtcaatccgtcagaaggtgacggtgacttcgactggtttggtggtatcggtcgggatcgggacggtgtcgccgtcgagggtggggcgcacgccgagcaggtattgggacgcgtccacgaaggtccacgcggcggtgccggtgagccaggagttcttgccctcgcccggggttggggactcgtcctctaagaaaccgtccaacacaccgtcgccaatccaatctccacctcgccggtggacaggttgcgctggaagttggacgagtcgtccacggcattccacaggcaccattccacggagccggtcacgtcgatgacggccggctcgtcggtggtgttcgtcacgtcgagccgattgatttccgcattggtgtgcagcggcacgaaggcggtgagcttggattcgatgcctcgcttggaagcttcgaacacggtgtagccgatgccttgacggcacttgcaggaatcaagcggggtcttgcacggaaggaaggtcggcgaccaggtttcgaccggcttggcatcggcggaatcggagtccatcaggctcaggtaatagcagcgggagccgttgtctgccggcacgttgttataccggtagcgggtgatgcggcgtagtttggcgtccttgtagaagctgtagccgccgccggtgttggaaatcagcgagaagaagtcctcgttgccaaggtagttgatccacggcaggggagtcgccggggtttcaatcacgtattcctttgcggcatcatcgaaatgaccgtagcgcatgggtgccctttcgtcggtgaaatggctgtgacgaggtgtactgtatgggtatatcgtccattgatttaattaataggttagcacgttgtttataaacttataaataacgatttgctggcgtgttgccgtcggtcttccaatggtcatctgtcgacgctgccgcaatcgggcagaggttggggtatacttcctcccgttgccctcgtagctcagttggttagagcagcacccttataaggtgtttgtcctgggttcaagtcccagcgagggcacatgcggacctgccggaagcggcgggtcctttgcatatccgcggattgcagtccgtacgccctgcgtgtgacggcgcataccgtgtcccggccatcgcctacactccataaggttatccggttcacgccttgccatcggggcaatgcgacccgggtcccccgaatctctaggagacaaactatgaagcagggtatccatcctgattaccacgcagtgcaggtcacctgctcttgcggcaacaccttcgtcacccgttccacctacaacggcgatcacatgaccgtcgacgtgtgctccaactgccacccgttctacaccggcaagcagaagatcctcgacaccggtggccgcgtggctcgcttcgagaagcgttacggcaagaaggccaagtgagtcttattgcttaggcaatgaaaacgccagtccattcgtgggctggcgtttttcgttaccgacgtgccgtcgctcacctccgacgaccgcacttccgcgccaccttatatgatggacaggttgagtaaggttcagcgacgagtgattccgctgaagcgcagatacgaagaaaaggcgtacattggcagacgaacaattccccgcggccgtcaccgcgcttgaggaataccacaatatcgaacagcagatggccgagccggaggtcgcatccaatcccgacaagatgcgcaagctgggtcggcgccacgccgaactgggtgccatcgtctccgcctacaccgcatacaagcaggtgaaggacgatctggaggcggcccgcgagatggcgtccgaagatcccgatttcgccgaagaggccaagcggttggaaggcgagctgcccgcagccgaagagaagctgcgcaccgcgctgattccgcgtgaccccgatgacgcgcgtgacacgatcatggagatcaaggccggcaccggtggtgaggaagcggcgctgttcgccggcgacctgctgcgtatgtacatgcgatacgcggaaaagcgcggctggtcggtcaccgtgcaaagcgagaacaccaccgagctgggtggcgtcaaggacgtgcagctggccatccgcgccaaaggcactccggcgccggaggacggcgtgtgggcttccctcaagtacgaaggcggcgtgcaccgcgtgcagcgcatccccgtcaccgaatcgcagggacgtatccagacttccgccgccggcgtgatcgtcttcccggaagccgacgaggacgacgatgaaatcgaaatcgatccgaaagacctcaaaatcgacatcttcatgagctccggccccggcggacagtccgtgaacaccacgtattccgcggtccgcatgacgcacatccccaccggcatcaccgtgaacatgcaggacgagaagagccagatccagaaccgcgcggcggcactgcgcgttctgaagagccgcctgctggccatgaaacacgagcaggaggccgccgaggccgccgatatgcgccattcccaggtgcgctcgctggaccgttcggaacgtatccgcacgtacaacttcccggaaaaccgcatcgtcgaccatcgcacgaactacaaggcgtacaacctcgacgccgtgcttgacggcgatctgcaggccgtgatcgacagcgacatccaggcggacgaagccgatcgtctcgccaaccagaagtaaggcgattgggtggcgacggtattcgaaacggtgcgttccgccgcggacgaactacgtgcggcgggagtcgacactccgcagcacgacgccaaactgctgctcgccgaagcgttccatacggacctgcagcacgtggacaaagccatgctcatgggcgatggcgtcgaacgtctggccgaaaaagaagacgcggaaccggcgatggaacgtttccagaccatgctggcccgtcgtgtcaaacgcgagccgttgcagcacatcaccggccatgcgccgtttcgctaccttgatttgaaagtcggtccaggcgtgttcattccacgtccggaaaccgaactggtcgtgcaggaaggcgtcgactgggccaccagaaacggcatgtaccgcgccaaagtggtcgatctgtgcgccggcagcggtgcgatcggcctcgccttcgcttcggaagtgccgggcagcgaggtgtgggccgtcgagaaaagcgctacgaccgccgagtggacgtggcgcaacctcgacgagaccgcgaaacggtatcccgcaatcgccggcaattatcatctggacatcgccgacgccacgcaaatgccgacgctaagccaacttgacggcaccatcgacatcgtgctcaccaatccgccgtacgtgccgcttgccgacattcccgaacagtcggaagtgcgcgattatgatcccgatctggcgctatacggcggttcggcggatggcacgctcattccggaacgcatcatcgcacgcgcggcgaaactgcttcgtgcgggtggacttatggtgatggagcacgacatcacgcagggggagcggcttgccgccttcgcacgaacctgcggcttcgtcgacgttaccgtgcataacgactacaccggacggccacgttatctgacggcggaaaaacagccggcacagtaacttatattcttttgcgccatgctgacggggatataaccagaagttgagtctcactataagaacattttatgcaggccgccgtccgtcaggctataaagaacaatcggaatgcacagagagagaacgggcgtccgtcatgagtggtcgccgtggttccgcgcacgggggttgagatgaacatgattttttccaaggtgcgcgttgaaaggaatgtgcagcgttttcaagaaaagaggaagaacggaatgaacgcgaagttctccgccaagtgcgtcgccctgatcgcggcaggcgcaatgtcgatgtccctcgctgcctgctccggcggcagcatggacgattccagcagctccaacggtagcgcggccaacagcgataccatcacgctgggctccgtcaccaccaactccggcaccgccgccgcatatggcgaggccgaggtcgccggcttcaagctggctgtggatgagatcaacgccaagggcggcatcaacggcaagaaggtcaagctcgagtccatggacgacaagggcgacgccaccgaagcctccaacgccttcaacaagctcgccggcgacaacagcgtgctcggcgtggtcggcccgaccatctcctccaccaccgcggcagtggctccgctggccgaccagtccaagctgccggccatcgcaccggccgccacctccgactccatcgagaccggtggctacatgttccgcacctgcttcaaggactcctaccagggtgagatcgctgccaagttcgcagccgagaccctgaaggtcaagaaggtcgccgtgctgtacggcaccggcgatccgtactcctccggcgtgggcaaggccttcgccgctgccgccaagaaggccggccttgacgtcgtggccgaagagaactcctccagcgccgacgacaccgagtactcctcccagctgcagaagatccaggccgctggcgccgagttcctgtacgctccgtactactactccgtcgctggcccgtacatcatcccgcaggcccgctccgtcggctacaagggctatgtgatgggtcctgacggctacgacggcctgaagatgaccgacgacaagtcgctgtacaacaaggtgctctacaccacccactactctccggacgacacctccaacgccaaggtgcaggacttcatcaagtcctacaagaaggccaacaagaacgccgatccgaacaccttcaccgcactgggctacgactccgtgtacatgatgaagcaggccatcgagaaagccggcaagaacgccacccgcgaaggcgtgcgcaacgccatcgccggcatgagcttcgaaggcgtgaccggcaacttcacgctcgacaagaagggctccccgaagaagtccgtcgtcgtgcttgagctcaaggacggcaagccgcagtacaagaccaccattcagcctgccaagtgagcgtcgcttgcctgaaggcctgaatctgtgaagaggagggggccgggaaaccggttctctccctttcgcgtatcaagacgaaaataaccatattcagccgctgggcttcttcagcggccaagccggacggttatgtcaaaagtccggcatcatcaacttttgaaaggaggaatgatgggcgatcagatcatcatgttcatcagtcagatcttcaacggtctgaagatcggcagcgtgtactcgctcgtggcactcggctacaccatggtgtacggcatcattcgtttgatcaacttcgcacacggcgatttcatcatggtcggctcctacgtgctgatgcttaccattccggcgatcgtcgcattcggcctgcccgcatgggtggccgtcatccccgcgatcctcatgtgcgtggcggtgggcgtcatcgtggagagggccgcatacaagccggttcgtgaaaagggcaacagcatgacggccctcatcaccgcaatcgcaatgagccttctgctggagaacggctcccaggccatcttcggcgccgactaccagaccgtgcccaccatcatccagattccgacgctggcgatcggcaaactgaagatcgacggcgcgaccatcatcaccatcgtgctcggcgtgatcatcatggtcgcgctgcagctgttcgtcacctacaccaagcagggcaaggccatgcgcgcggtctccgaagacaaggaggcctcgatcctgatgggcatcaacgtgaactccaccatcacgctcacgttcgccatcggttcgggcctcgccgccgtcgcatcgctgatgtactgcgtttcctatccgcaggtgtccccgatgatgggtgcgatgctgggcctgaaggccttcgtcgcggccgtgctcggcggcatcggctccatcccgggtgccatggtcggcggtctggtgatcggcgtggtcgaaagcctgaccaaggcgtacatcggcaccatcaccagcggcgtgatcacgtccgcgttctccgacgccattgtgttcggcatcctcatcatcgtgctcctggtcaagccgtccggcctgatgggcgaaccggaaaccgagaaggtgtgacctcatgaagaaatcaatgctttccaccaaacagtcctatctgatgtgcgcggtcggcatcgtcgtgctgttcggcattctgatgggtgtatgcgaatccggcatggccagcacctacatcaagggcatcatgatgacaagctgcatcgccatcatcatgaccacgtcgctgaacctcaccatcggcgtgctcggccagctgacgctgggctgctgcggcttcgaagcgatcggcgcgtacagcgcggccctgctgagcaagctgctcgtcgccaacggcgttgcgatggatccgacgctgcgattcctgctgacgacgctcgccggcggcgtggtcgcctgcatcttcggcatcctggtcggcattccggcactgcgtctgcatggcgattacctcgccatcatcacgctgggcttcggcgaaatcatccgcgtgatcatccagaacctgaaggtcgccggcggcatgggccttgacaagggcgcggccggccaggcgctgatcggcatcgaccgactcgccaacctgtacgtcgtgttctggatcaccgtcgtcaccgtcgtgctgctgttcatgttcgcccgctcccgttacggccgtgccgtcaaggccatccgcgacgacgagatcgcggcaagcgcgtccggcatcaacatcacctacatgaaggtgctcgtgttcgctatctccgcgttcttcgcgggcatcgccggcggcatcttcgcccagtacatcggctcgctgaaccccgcgatggccggatggctgcaatcgatcaactacgtgatcatggtcgtgttcggcggcatgggctcgctgacaggttccatcgtctccgccatcgcgctgacgatcctgccggagctgttgcgcgccttctccacctaccgcatgctcgtgtactcggtggcgctggtgctcatcatgatcttccgcccgcagggcatcttcggcaactgggaattctccctgaccaagaccatcaacaagctgttctacccgatgaaggtcaaggcgcacggcaagtcgaagcaggctgaatccaccgccaaggcagccaaggacaccgccaagacggacgaaaccgtcgagacggccgccgacaccaaggaggcgcaggcatgagcgagcccatcctgaaagccgaacatctcggcatcaccttcggaggcctcaaagccgtatccgacttcaacatgaccatcaactccggcgagctcgtcggtctgatcggcccgaacggcgccggcaaaaccaccgtgttcaacctgctgaccggcgtgtaccagcccacggaaggcgagttcttcctggacggcgaacgcatgaacggcaagaagacgtaccaggtggtgcgcgccggcatcgccagaaccttccagaacatccgcctgttcggccagatgaccgtggaggagaacgtgctggtcgcattcaacgaatcgttcagctaccacatgggcggcgcgattttccgcacgccgaaattctggaagcaggaacgcgagatgcacgccaaagccatcgacctgctcaagatcttcggactagagggcctggccgaaaccgaagcggcgaacctgccgtacggcgcccagcgcaagctggaaatcgcccgcgccctcgccaccggcatgaaactgctgttgctcgacgagccggcggcaggcatgaacccgacggagaccgaggacctgctcaactgcatcaacaccatccgcgaccgcttcggcatcgccatcctgctgatcgagcatgacatgagcctggtgatgaacgtctgccagcgcatccaggtgctcgactacggacgcaccatcgccgccggcacgccggacgagatcgccaacaacccgcaggtcatctccgcatacctgggttccgacgacgataccgacagcgacgatgccaagcacgaaagcgaggaagcctgatgctggaagtcaagaacctttccgtttcgtacggtgccatcgaagccgtcaaggacatcagcttcactgtcaacgacggcgagatcgtgtctctgatcggcgcgaacggcgcaggcaagaccaccacgctgcacaccatcaccggtctggtaccggcgaaatccggttccgtgatgtacaacggagtggatctgctgaaaacccacaacaacaagatcgtgaccctcggtatggcgcacattccggaagggcgccacgtcttcacacgcatgagcgtcgaagagaacctggagatgggcgcgttcagcctgaaggaccagtcggacctcaagaaggacctcgacatggtctacggcctgttcccccgtctgaaggaacgccgtaaccagaaggccggcacgttgtccggcggcgagcagcagatgctggcgatgggccgcgcgctgatgagccatccgaagacgatcctcatggacgagccgtccatgggcctgtccccgaagctcgtcaaggagatcttctccatcatccgcaagctgcacgagcagggcatcacgattctgctggtcgagcagaacgccaagatggcgctgtcgatcgccgaccgcgcatacgtgctggaaaccggccgtatcacgatggaaggcgacgccaaggaactgctcaacaacgagcaggtgcgcaaggcgtatctgggcgcctgattcatgccgtatccgccttgtcggcttggacgcatccaaaccgacagggctttttctatatccgatggaatattcgccggtcgtgttccctccattcgggcgcgccatcgagccatgccttacaataggtaagttgactggctgaaagggaggtgtcatgagcgaaatttgcacagtaaacgacgaatcccttgcccgggccgttgaaatcatccatgatggcggattggtggtcatccccactgacacggtgtacggcgtcgcctgcgatccgcgtaacatcgaggcgatccgcaaggtgttcgcagccaaacaacgaccgaaatacaagtcgttgcaggtgttgctgccgtcaatcgaaagcatggagaagctgcatctgaccttgccggtgccgctcaaccgtctggccgccatgttcatgccgggcgctttttcgccgatagcggaagcggaagacgactgttcgcttgccacgttgcgtcatgatccgacaaccggcaaagccacacagggcgtgcgcatccccaattccgcggtcgcgctgcgtattctgcgagccaccgggccgttggccgccaccagcgccaaccgttccggcgaggaaagcgcacaaacggtgcaggaagccgcggacgcgctgggagatgcggtggatctgtatttggacggggggcgactccgggacatgtgtcgtccacggtggttgcagccgacccgcacgagcgcgacggcatcgcgattcttcgggagggagtgattcgcgagctggtcatccgtaaggctttaacactgaatggcggtgctttgggcgcatgagaatctacctgttcattgccgcggtcgcaggtggcgtcacctatctgctcacgccgctgatccggcacatcgccatcgaaatcggcgcagtcggcgaagtgcgtgcacgcgacgtgcataccgtgccgacgccacgcatgggtggactgggcatgcttatcggcttcaccgtggccatgctgttcgcctcgcgcatccctttcatcgaaggcctgttcgcccaatcgcatcaggcatgggtgattctagccggcgccattatgatcagcctgctgggcatggccgacgatttgtgggaccttgactggatgctcaaactcgccggtcagctgctcatctctgtgtttgtggcctggggcggcctgcagatcatctcgttgcctctcggctcgctcgtcaccgcgtcgccgagcctgtcgatggccatcaccgcgttccttatcgtcgcgtccatcaacgcggtcaacttcgtggacggtcttgacggcctcgcttcgggcatcgtcgcgatcggcggcatcgccttcgccatctattcgtacatcatcgcaagaagctcgccgtcgtacgcatccatggcgacgctgatcgacatcgccatggtcggcatgtgcgtcggcttcatcctgcataactggcatcctgcgaaactgttcatgggagattccggctccatgctgctcggctatctgatcacctgcgcgtcgatcgtcatgacgggccgtctcgatccggcgtccatccataccagcatctatctgccggtgttcatgccgattctgctgccgatgctggtgctgttcctgccgatcctcgacatgtgtcttgcgattgtgcggcggttgagcaaaggccagtcgccgatgcatcccgatcgcatgcacctgcaccaccgcatgctgcgcatcggacacaccgtgcagggcgcggtgctgattctctgggggtgggcgtcgctgatcgcattcggctcgatcatgattctgttcttcaaagcgcagtatgtgctgattggcttcctcattgcgtcggcgctgctgacggtcgccacgatgtacccgtatctgaaacaccgcattcccgaaatccgtgaggaaaacgcaatctccggaaccgatgcgcaacacgcgtcggtcggacgcgcgcgcggcgacaaaacgcgcggtggacgctgatcgtccgtccggcgcaatcgcaagaaaaactgatgaaacgctttgccaaacgatataagcagcttttattacgattgataatttcggcttttcgcgccgtgtcgcagtaagtcagcccacgttcatatagtgggtctatggctacaattcctgatatgaatgcagattccacgttcgccccacttcctccgattttcgcccagcttggcctcgcctatgacgatgtgctgctgctgccgaacgagacggacgtcattccgtccgaagtggacaccaccacccatctcacacgcaacatcacgatgaaggtcccggcgatctccgccgcgatggacaccgtcaccgaatccgacatggccatcgccatggctcgcaacggcggcatcggcgtgctgcaccgcaacctttccatcgacgaccaggccgcccaggtcgacatcgtcaagcgttccgaatccggcatgatcaacgatccgctcaccgtgagcccggacgtgaccctcgccgacctcgacaagctgtgcggccgtttccacatctccggcctgccggtcgtggacaaggacagcaagctcgtcggtatcatcaccaaccgtgacatgcgtttcatcgcttccgaggattacgaccgtttgaaggtctccgaggtcatgacccgcgagaacctcatcaccggtccgtccgacatctccaaggaagacgcgcacgacctgctggccaagcacaaggtcgagaagctgcctctggtcgattccgaaggtcacctgaccggtctgatcaccgtcaaggacttcgtcaagaccgaacagtatccggacgccaccaaggatgagcagggccgtctgcgcgtcgccgccggcatcggcttcctgggcgacgcctacaaccgtgcttccgctctgatggaagccggcgtggacgtgctcgtggtcgacaccgccaacggtgaggccaagctggctctcgacatgattcgccgcctgaagtccgattccgcgttcaatggcgtggacatcatcggcggcaacgtcgccacccgccagggtgcgcaggccatgatcgacgccggcgtcgacgccgtcaaggtcggcgtcggcccgggctccatctgcaccacccgcgtggtcgccggtgtcggcgtcccgcagctcaccgccgtgtacgaggccgcccaggcctgccgcgccgctggcgtgccgtgcatcgccgacggtggcatccactactccggcgacatcgccaaggccctcgtggccggcgcatcctccgtgatgctcggcggcaccctcgcgggctgcgaggaagctccgggcgagaaggtgctcctgcacggcaagcagtacaaactgtaccgtggcatgggctccctgggcgccatggctccgcgtggcaagaagtcctactccaaggaccgttacttccaggccgacgtcacctccaacgacaaggtcgttccggaaggtgtcgaaggcgaagtgccgtaccgcggaccgctcaacgccgtgctgtaccagatgatcggcggcctgcaccagtccatgttctacattggcgcgcacaacatctccgaaatgccggaacgtggccgcttcatccgcatcaccgacgctggcctgcgcgaatcccatccgcacgacatcgtcatgaccgccgaggcgccgaactactccggccgtcagtgattggcgaataccgcgcgaaacgcatacgacgcgactaaacgctagataatacgaaacccgtccggtggcaggaatgccgctggacgggtttcgtgcgttttcggcagctattggtctagtgacgtttagttaattgagccatgtcgatggcaccgtatgaacgtcaacttacgcgttccgtggtgccacgcagcaccagcgacgtcggcatgacggtgaacggctcgtcaagcgtctcgccattgagcagcgcaagcgtcttacgtgcagcgatacggccgatttccgccggatcctgatgcatggtggtcagatccaatgcggtggcggtgtcgtcatcatcgaatccgaccagcgacacgtcctgtggcacgcgccatcccatgcgccgcagctccttcagcaggggagcggccacggcgtcgacggagacgcagatggcggtcggctgctttggagcgctgagcagctgcgcgacgatgccggaatagatgtcctgctcgctgcgagcatcgatatgggatagtgacggcatgacgatgatgtcttcatccgcgtaaccgcaagcttgtgaggcttcgctgaatcccttcttgcgcagcctgtcggagcagacgaacggcgtggtgttgatgggctgttcgatgtaggcgagcgtcttatgccctaacgatttgaggaaccgtacaatcgtcgccatggaagcctcgtcgtcgatggcgacgccggcgtcgagaccgtgcgtgctcggcgcgttcatgccgaccaccggaatggtcagattgccaagcacctgcttcttcgcctcgtcgaagtcaaatgacgcctcgatgaccgcgtcgacgttgcggttgcccggaagattttggaaaaacgcatccaaatcgtcctgcgtccacacgatgtaaggaacgatgtcgtatccggccttcgacatcacctcgtaaatgccttcgaaggcgtgggcgttgaaccagctgctgatttcgttcggcagcagcacggcgactcgcatggttttgccggacgccagggacgacgcgcttttcgaaaaggagaaatgcaggcgcttcgcctcctgctcgatgcgttccctggtttcgggactgaccctgtcgagcccgcgaagcgcgcgggacacggtggagacggacactccggctgcctgggctacgtctgcgatggtggttcgtggcatggtcggatggctccttagggtggactatgcgggcggtcggttgcccgcgactgcttcactctatcacgacacgctgcttttgtaaaaacgcttgcatggcttcaggtgttgttattgcttgctttttgaagtgctgccaccttgttctgcctcctgtggtttgcgcttttttgcacaagcgttattattgattatgtcaagcaatgcgataacagcaacgaagctacacaacacaacataaccatcgtaggaaaatcaacgaaaatcgttctacgtacggagttgtgatacgtgcgcacggtgcacaagcgtttgtatgaaaggggacaacatgaccgaagtcaacgatccgtcgctgtggtggaagcaggccgtggtctaccaggtgtatccacgttccttcaaggattcccgcggcgagggcctcggccagattgccggcgtcaccgagaaaatcggatatctgaaggaactgggcgtcgacgccatctggctgagcccgttctacccgtcccagctggccgacggcggctatgacgtggacgactaccgcaacgtcgatccgaaactcggcaccatggacgatttcgacgcgctcgccaaagccgcgcatgccgacggcatcaaaatcgtcgtggacatcgtgccgaaccacagctccaacctgcacgaatggttcaaggccgcgttggccgcgaaacccggctcgccggaacgcgaccgctacatcttccgcgatggcaagggaccgaacggcgacgagccgccgaccaactggcagaaccacttcggcggccctgcatggacgcgcgtgcccgacggccaatggtatctgcacatgttcaccaaggaacagccggactggaactggaaaaacgaggacgtgcgcgccgatttcatcaaaaccctgcgtttctggcttgaccacggtgccgacggcttccgcgtggacgtggcgcacggcctggccaaggatctcgaccgcgatgatctggacgattatgtggtctggtgcaccaacgatcagcccgaagacggctcccatccggtgatcgaccgcgacgaagtgcacgacatctaccacgagtggcgcaaggtgttcaacgagtacgatccgccggcgttcgccgtggctgaggcgtgggtccgaccaagccgccagcatctgtacgcctccccggacgatctcggccagatcttcaacttcgagttcgccaagaaggattggatccgcgacgacatgcacctcgccatcgaggaaggtctggaaagcgccgaacggtccggttccaccgccacttgggtgatgagcaaccatgacgtggtccgccatgccacccgctacgcgctgccccaggtgccgaccggcgaataccatcgactgccgctcgactggctgctgcgcgacggcaccacataccgggaggaccgcgcgctcggcaccaagcgcgcccgcgccgcgatcatgatggagatggcgctgcccggctccgcctacgtgtatcaaggcgaggaactcggcctgttcgaagtggccgacattccgtgggatgagctggaggatccgtccgcatggcgcacctcccgttccgccagcaccaaaggccgtgacggctgccgtgtgccgctgccgtgggttgcggccgacgctccgcagctggacgatccgaacgatgagttcggccatggcggctccttcggattctcgccggcagacgcgaaggccgagccgcatctgccgcaacccaagtggtacaaggatttcgcggtcgatgtcgaatcggccgacccggattccatgctgaacctgtaccgccgcgtgctggcattgcgacatgagttgcagaccaccgacctgagtctcgaatggcttccggaagaccagcccggcaaggcgcatgacggcgccaacggtttcccgggtggcaccatcgcgtaccgccgtgccaacggctgggcctcgatcaccaacttcggcgaagaaccgatcacgttgccgcaaggcgaagtgctgctgacatcaggaccgcttaccgacgacggcaagctgccgcaagataccagcgcttggctcaaactggccgattgaccgcacgcaggatgccccgatctgagggtgtccgtgccggataccgcactcgtgcgctgaaccatcgaaccggcagcgcgctccagccgtccgcgtccctccatttgggcgcggacggctttcctgtttccaacgaccgttttccaacgatgacggtccgacgtacctaccctgcggtatcttcatatgttcggcctgcgcagagggcgcgaccgcggaccaatcgaaagaggcaacgatggtagatgcacacgatggcgaaacatacacgtccgaaggctcacgtctgatctggatcgactgcgagatgaccggcctagatatcttcggcggcgacgagctcgtcgaggtttccgtggtgccgaccgacttcgacctgaacgtgctcgacgaaggtgtcgactatgtgatcaagcccagtcagaaggctgtcgaccacatgaatgacttcgtgcgcgccatgcacacccgttccggcctgatcaacgaatgggaacacggtctgagcctcgacgaagcgcaagccaaggtcatcgaatacgtcaggaaattcactccggccggcgtcaagccgctgctcgccggcaacaccatcggctccgacaagaagttccttgaccactacatgccggaactcatggagaacctgcactaccgcaccatcgacgtgagcaccttcaaggaactcgcccgccgctggtatccggccgtctacctcaaccgtccgccgaagaacggcggccaccgcgcgctcgccgacatcatcgaatcgctcgacgaactgcgttactaccgcaaggcgttcatggccccggtgcccggtccgagcgaagcggaggcgaaggccatcgcctctgaaatccaggaaaccagcctgctcaacaaggactgacagcacgactccagcgagaggaaccgcatgaccgcagctgattggaccaccatcggccaaccgcaggatatccgccttgtggtcgccgacatggacggcacgttacttgacgaacgaagccgaatccccgacggattctggcccatgctcgcccggctcaaacgccgtggcgtcgaattcgtgcccgcgtccggacgccaatacgccacgctgcgcaacatgttcgccgacaaagccgcggagattctcgacgggggagaactgtcctatatcgcggaaaacggcaatgtggtggcgctcgacggcaaagtcgtggaagtgcatggcgtcgatttggacgtcacgagtcacgtcatcgacctggtcgacgacgccgctgcctccggcgagcataacgtgggactggtggtgtgtggccttaaatcggcatacgtgcagcgttccgacaagccgttcctcgatgaagtcggcaaatactacgcggcgctgagcatcgtggacgatctgcacgaagtgctcgacttcgcgcaggaaccgtccgcctacacccctgacggcgacgccgaaatcgttctgaaactcgcgatcctcgaccttgacggctccgaacgattcaccaacgaaaagctcacacatctgcgcgcggactaccaggtggtcgtctccggcaaactgtgggtggacatcatgaacatcgaaaccgacaaaaagcagggcgtcgaggcgttgcagcgcgtgctcggcgtcacacccgcgcagacggcggtgttcggcgactacctcaacgatctgctcatgcttgaggcgggcgactggtcgttcgccatgggcaacgcacaccccgatttgaaggccgccgcgcgctacatcgcaccgtcgaacgtcgagcacggtgtgctcaaggttgtggacaggctggttgcctgacgatttcgttgcatggggcgcggtgacgtaaagaaggtggcgtaatgaggcaatccgaggcgcttgcgattctgggttccggcgcaagcgtgttcctgacgggcgcgcccggtgccggcaaaacctacgtgctcaacgaattcatacggcaggcgcgtgccgacggcgcatccgtggccgtcaccgcatccacgggcatcgctgccacgcatatcaacggcaccaccatccattcctggagcggcatcggcttggccacggcattgaccgacaatctggtcaaaaccgttcgcacacgccgcaaacgcaagctgcaggaagccgacatcctcatcatcgacgaggtctccatgctgcacgcgtggctgttcgacatggttgaccggatctgccgcatcatccgccgcgacgaacgtccgttcggcgggctgcaggtggtgttgtccggcgattttttccagctgccgccggtttcggtatcgggacgcaacaacgacctgatcgcgccgtccgccgaatatctggccagtcgcgaacggtacatgcgcgccggactcaatcccgaaggtttcgtcaccgaatcgttggtatggcgcgaattgaaccccgttgtctgctatctgaccgaacagcatcgtcaggatgacggccagctgttgaacgtgctgaccgacattcgcgaaggcgcggtggacgatggcgaccgcaatgtgctgctgacccggttgggggccattccggaacccgggcagcaggcggtgaacctgttccccgtcaacaggcaggccgacgcgcttaatgacctgcgcctgttcgaaatcaaggaggagccgcacgaatacctcgccgaatccgagggcgcggcgaatctggtggaacggctcaaaaagaacatgctcgctcccgaacgcttgtacctcaaaacgggcgcggccgtgatggcggtgcgcaacgacaccgaccaccagtacgtcaacgggtcgctcggcaccgtgcgtggattcaccacgcaatcgcagggcggctggccgatcgtcgaattcgaaaacggcaacatcgtcaccatgaagccgaattcctggcagatgcaggacggcgataccgtgctcgccacggtcaaacaggtgccgttgcgctgcgcgtgggcgatcaccatccacaaatcgcaaggcatgacgctcgatcgtgccgtcatggatttgcggcgcacattcgcgccgggcatgggatacgtggcgctgtcgcgagtggaagggctcgacggcctgtatctgcaaggcgtcaacgagcgcatgttcctggtctcaccggacgcggtccgtcttgatggacaattgcgattggagtcggcgcaggccgtcgatacgcttgcctccgacggtgtcggagcattccgcgcccgcatgccgcaaccggccggtgaggatgacgaattcgcgcaggacgtgctgttctgacccgctgctaaatatcagcccatcgcctgcagggaacgcgcaagatccgggtcgagctcaacttcgtcctcgacgctttccgaatcggggtcccaacagctggcgatcacgcaggccagtccgacgagcaaccaaagcgggttgcgctgcaggaactcaagacctggaatcgcccgcgtgacgatgatccatatcaccatgccggccagcgcaatcgcattgaacggcttcttccatggcagggaaatcaacgtgacgcacaatacggccaggcacaggccgatccattggttgccttcggtcagcacttccggcgctgccgccgcgaagacgaaatagcagatgatgccgatccggccgagtttgttccaaatcgaaatgtgcgcggtgacgtgacgcatgctgcgtcctttccttatgaagcgatatggtgctgattccagtatcatagaaacggctttagacttatttataactctataaataacgtttttcgcgtattggtgtgcgattcgaggacgtgtggcgcatccaagtcggcttacctgagtaatttggaacgtatgaccaaagcacttcgtatgtctaccatgttcctgcgcaccctgcgcgaggaccccgccgatgccgacgtcgtgtcggacaagctgctgcagcgcgcctgctacctgcgcaaggccgctccgggcatctggacctggctgccgctgggcctcaatgtcctgaacaagatcgagaacatcatccgcgaggagatggcgtccatcgacgcccaggaagtccacttctccggactgctgccgcgcgagccgtatgaggccacccaccgctgggaggaatacggcgacaacatcttccgtctgaaggaccgccacgaggccgactacctgctggccccgacccatgaggaaatgttcaccctgctggtcaaggacctgtactcctcctacaaggacctgccggtgaccctctaccagatccagaccaagtaccgcgacgagttccgtccgcgcgccggcctgatccgcggccgcgagttcatcatgaaggacgcctactccttcaccctcgacaaggaaggcctcgtcaaggcatacatggacgagcgcggcgcatacgagcgcatcttcaaccgtctcgacctgaagtacgtgccggtgcacgccatggccggcccgatgggcggcttcgaatccgaggagttcctggctccgatggagatcggcgaggacaccttcgcccagtcgccgtccggcaaggcctggaacgtcgaggcgctgaccactccggaaccggaagccatcgactttaccgcaacgccggcagccgaaaagcgcccgaccccggacgcggccaccatcgacaagatggtcgaattcgccaacgccaaccatcctcgttccgacggccgcgattggcaggcctccgacattctgaagaacgtcgtcatcgccgtcatgcatccgcaggacgaagaccacgacgagccgtggcgcgagctcgtggtcgtaggcgttccgggcgaccgtaccgtcgacatgaagcgtcttgaggcgcagttcaccccggccgagatcgaggaagccaccgacgaggatctgaagaagcatccggaactcgtcaagggctacatcggaccgatggcgcttggcccgcaggcgcgcgacggaaagaaggccgagaacgcgtccgagaccggtgacgcgctgcgctacctgatcgacgcgcacgtggcacgcggttccgcatggttcaccggcgccgacgagcaggacgtggattactacgatttggtgtacggccgcgatttcgaggctgacggcaccgtcgaagccgtgcaggtacgtcatggcgacatgagcccggacggttccggcccgctgagcttcgagcgcggcgtggaaatcggccaggtgttccagctgggcctcaagtattccaacgcgctcggcctgaaggtgctcgaccagaacggcaagaccgttccggtgtggatgggctcctacggcatcggcgtctcccgtgtgatggcctgcatcgccgaaacccatcacgacgagaagggtctggcgtggccggcagtcatcgcgccggcacaggtgcacgtcgtggccaccggcaaggatgcggccgcgttcgaagccgcagaacagctgatcggtgagcttgaggccaagggcatcgaagtcatcttcgacgaccgcaagaaggtgtctccgggcgtcaagttcaaggacgccgaactcatcggcgtgccgatcatcgccgtcgccggccgcgacaccgtcaacaacggcaccatcgaagtgcgcgaccgcaacggtgagaacgccgaagcggtgccggtcgcggacgccgcgcaggcgatcgcggaccgcgtcgctgcactgctcaagtgacatacggcaatccgtagcgcgtcggtttgatccgacgaacgacatacggcaacggaagaccatcaagcaggtggtcttccgttttttgtttttcatggggaataccgtgcgcatctcacgcacatgaggattgtggatgtcggtggataagtcgaaattatccaccgacaatccacgactcgcccgacgatctcaagttatccacattctccggttgggcttgcagacggatggaacgttcggcgatagtggtcttaccgcggaaacgtgaagatgcgggaagggcatgcagtttaccctctctcaccataaatccacctcactgcctgtcgcttccgtgccgtcaacggcgctttccgcggtccatcattcgtcaaacagaaagggccgaacatggcgcagcagcagggtctcctcaccatcacgggatatgtgggcggccagcccacgcaattcaatcgggaaggcatgccgcatgccagctcattccggctggccagcaccagacattatttcgatggccgaacgcaacagtggaaggacctgcccaccacatggatcacggtgaaggcatatcgaggcctttccgaaagcatctgccaatcgttcaaaaaaggcgaaccggtcatcatgaccggcgtgctggcggcggaaagctgggtggaccagaacggcaagcaacagtcgaaactcgtcatggaagcgaatgcggcggggcatgatttgagctacggtgtctccaccttccgcaaactcgccaagaaaaacgattccggccagcaagacgcgcagcctggacaggctttaggacgtgatccatatgtgcaagccgcccaacagcggggcgaaacttcagtcaatgcgatggacgggcagagttccggcgttgacgagcaaggcggctcgcaggccggtacggatagcaacgccgccgaacccctacgtgaggaattcggcggcgatggcttctgacgattgcctgacgcttatgcgatcgctggcatggcctgttaccagatgcgcacgcgttgctccggtgcgagccacatgccgtcgccgggctgcacgccaaacgccttgtggaacaggtccacattacgggcgatgccgttcgtacggcattcggcgggggagtgcgggtcgatctgcagatactgctccgccaactcgtcgcgattcttagtgcgccaaatcgaagcgtagctcaggaagaaacgctgcaggccggtgaagccgtcgatttcaggagcatcggcaagcgcggcttcgatggcttccgtggaaccatccttgccgcggccggccgcttcatcgagagcgaacgcataggccttgagagcgatgttcacaccgctcaaatcgccgatgttctcgccgatggtcaacgcgccgttcacatgaggggccttcgacgggtcatccgaatacttttcggcgagctgcgtcggcacgaactcgttgtactggtcgatgagcttctgggtgagcgccttgaaattggccttgtcctcttcggtccaccagtcgttgagtttgccgtcgccgtcgtattgcgagccctggtcgtcgaaaccgtggccgatctcatggccgatcaccgcgccgatgccgccgtagttcgcggcatcctcggcatccgggttgaagaacggcggctgcaaaatggcggccgggaacacgatcacgttcatggacggctcatagtaggcgttcaccgtctgcggattcatcagccattcgtccttgtcgacggccttgcccaccttggccagctggtagccggtctcatacaggttcgcggcacgcatgttctgggcgaagccggcgtcctcgcgcacatccagcgcggaatagtcacgccaatggttcgtgtagccgatcttcggcacgaacttggacagcttctccaatgccttggccttggtctcgtcgccaagccaagtggaattggagatggacacacggtaggcgtcgatgagattgccgaccagctgctccatacgctgcttggaggtttcggggaagtgacgcttcacgtattcgcggccgacatcctcgccgcagatgccgttgaccagcgagacgccacgcttccaacgcacacgctgctccttctgcccggacagcgtcttgccgtagaagtcgaaattcgtttcgtcgaattcgtggggaagctccaatgtggagccgatcaccacatgcacgcgggcccacagcttgagatcatccagcgacgcttccttccagaacgcgttgagtccggtgaggaagcttggctcatgcacgatcgtgtggctgaaacagccgcggaaatccaacggctgcacggcagccgcggtggtcgcgtcgtaagcgttctgccaggcgtcgatccaagcgtccaggtcaacatcggcgagcatggcgcacaggtcggcgtaatccgtcgggttataggtcttcaccgaatcgcgcgtggacacgttgtcccaatggttcgccgcgatgcgcgtctccacgtcaaggaaacgcttggcctgcgcatgggcatcctcgtcatcggccgcaagatgcgcgttcttcagctgcttggcgaccatctcgacatacgcctcacggattggcgcgtaatggtcttccctgtagtaggcctcgtccggcagatccaaaccgtcctgttcgatgtgcacgacattggtctccggcgctcccggatctccgtaaacggcgatgccgatcaggtctggaccgccggtcgggttcatggcgccaagcgcgcgggtgagcgcggccttgtcttcggcctcgtcgatggaagccaactggtcttcgatggcggcgagtccggccgcgtcgatggcatcgacgtcaaggaaactatggtacaaagcgcgcgacttgacggctgggcaatcatcctcttcaaggatgtcgcggatctggttttccgcatcctcggcgagcttgtcgaaggaaccataccgggaacggtcgtcgggaagacggtacatgtcgacccacgggccgttgacgaagcggaacaagtcctgagacgggccggtcacggcggagaacgatgccggatcgatacccgaaaccaaagaattcgaagtgttgttcatggcttcacactatccatctttggtgacaacatcgtgtattcgaatcgaatattcgggtggaacgcaaggtggaatacagaaaggagaacatcgttcgccggtgtatggcccgcgaagtagggttgaaggcatgatcgaactgaaaacccctaaagagattgaagcgatgaagcccgcaggccgcttcgtcggcggcatcctgcgcgacctgaaggaattcaccaaggtcggcaccaatctgttggaaatcgacgaattcgtccacaagcgcatcgtggaccgcaagggcgcctcgtcctgctacgtcgactatgcgcctgatttcggcaccggtccgttcgcgcactacatctgcacgtccgtgaacgacgccgtgctgcacggcgttccgtacgactacaacctgaaggacggcgatctggtcagcctcgatctggcgatcaacgtcgacggatgggtcgcggattccgccatcagcttctgcgtcggcacgcagcatcccgacgacctgtgcctgatcaagtgcaccgaagaggctttggcggccggcatcgaagccgctcagccgggcaatcgtctgggcgacgtctcctgcgccgtcggcgacgtggcacgcgaatacggctacccgatcaacctggagttcggcggacacggcgtcggccatatcatgcacggcgatccgcacgtgccgaacgacggcaaggcgcatcacggctacaagctgcgtccgggcctggtcatcgccatcgaaccgtggttcctcaagaccaccgacgagatctaccaggatccgaaggacggctggacgctgaagagcgaggacggctcccgtggcgcacacagcgagcacaccatcgccatcaccgaaaacggtccggtgatcctcaccgtccgcgactagtccaaaaccttatgaaaacgggcttgtgcgattacgcacagcccgttttttcatgcccgttttgagacggaacccacatatcgaaacgcgcatgccatatagtgggcggtactttttgaactggtaaggagcgaacgagtatggccacagccaatctgagtgtggaatccaaggacttcaccctgccggtggtcgaagccacggcgggcgcggacggcatcgtggtgtccacgctgcgcaatgatggctgggtcacactcgaccccggtttcctcaccaccgcgcaatgcgaatcgaaaatcacgtacatcgacggcaagaactcgattctgcgctatcgcggctatccgatcgagcagctgtgcgagcagtccgacttccttgaagtcgcttggctgctgcgtcacggcgaactgccgaacaaggaccagtacgaccgtttcatctccgacatcaaccaccgcacgatggtgggggaggacttccgtacgttcatgggctccttcccgcgcaccgcgcatccgatgagtgtgatggcgtccgcggtcaacgcgctcgccacgttctacccggacaccacggacatcaacgattccgaccagctggacgaagcggcgaccatcatcatggccaaggcgcgcaccatcgtcagctacatcttccgccgccgtcgcgatgagccgatgctgtacccggactactcgcgtggctatgtcgacgatttcctgcgcatgtgcttcgccgtgccgtatgagccgttcgaatccgatcctctgtatgtgcacgcgcttggccgtctgctcatcatccatgccgaccacgagcagaactgctccacgtccgtggtgcgcatcgccggttcggcgcacgccaacctgtattccgcggtcgcggccggcatcaacgcgctgtccggcccgctgcacggcggcgccaacgaggcggtgctccgccagctcaaggccatccgcgactccggcaaaaccgtcaaggaattcgtggaggacgcgaaggccaacgggcgtcgcatctccggcctcggccaccgcgtgtacaagtcgtacgatccgcgcgcggcgatcgccaagacctatctgcagaagatcatggaacgcaccgacacgctgaagctgccggcggacgagcgcgcgctgttcgacgtggccaccgaactggagcagatcgcattgagcgacgattacttcgtgtctcgtcatctgtatccgaacgtcgacttctacacgggactgatctaccgtgcgatcggcttcgatccgtccatgttcaccacgctgttcgcgttgggccgcatccccggctggatcgcgcagtaccgtgagatgctcgccgacccgaacacgaagatcggccgtccgcgccaggtgtacaccggctacacggaacgcgattacgtgccgatggaccagcgccactgaacgatattgacacgcggctccggtttcggacgtgcgcatgcgcctgccatggcttgccgctacagtgtttcaaggaacgaaagaacctaacgaatcgctggaaccggtctacggctccggcatggtcaaaggagcgtacacatgactgaacagcgcaccgcatggggttggggtctggcaagcatcgatgcggccggcaacacccttgacgtgtggtatccggaactcacgttgggcgaggctccggctgaaacctcgcgtccgaatcacaacttcggcgccatcgcgcatgacgaggccgacgcgcgtggcgtgcgccgcatgcccgtgttcaccgtgtccaagctggacgagccgatcgaggacgccgccgacgcctatctgcgtctgcacctgctgagcatgcgtctggccaagccgaacacgttgaatctcgacggcattttcgccaagctcaacaacgtggtgtggaccaactacggtccgttcgccgtcgatgatttcgctttgcgcaagcttgacgtgatggccgccacccgacagtccggagccgtgttggcgccgcacgtcgatgtgaacgtgctgtcgattgacaagttcccccgcatggtcgactacgtcgtgccgaccggcgtgcgcatcggcgacgccgaccgcgtgcgactgggcgcgcacctgtccgaaggcaccaccgtcatgcacgccggcttcgtgaacttcaatgcgggcaccctcggcgtctccatggtcgaaggccgcgtctcgcaaggcgtcgtggtcggcaacggctccgacatcggcggcggcgcgtccatcatgggcaccctgtccggcggcggcaagctcaagaactccatcggcgagcactccctgctcggcgcgaacgccggcatcggcatctccctgggagacaactgcgtggtcgaagcgggcctgtacgtcaccgccggcaccaaggtcaccatctacgacaaggccaaggtcgccgccggcgaaccgctcgaaaccgtcaagggcgccgaactgtccggcaaggacaacatcctgttcatccgcaactccgtgtccggccgcatcgaggcgcgctaccgcaagaccggcatcgagctcaacgagaaactccacaagaactgaaaacggaatggcggagagcgtcatccgcgctctccgcaagaggaaactcgtgaaaatcacactgatcaccgtcggcaaggtcaaagagaagtatctgcgcgacgccatcgcggaatattcgaaacgactgggccggtattgcaagctcggcatcgtcgaagtggccgacgagaagacaccggagcatgccagcgacggactcgaacggcagatcaaggccaaagagggcgaacgcatcgccaaacatattcgtgacgatgcgttcgtcatcgccctcgccatcgaaggcaagcagctcaccagcgaacagctcgccgcgaaaatcaacgacctcggactccacggcaccagccatatccagctcatcatcggcggctcattgggactcgaccccgcgatcctcaaacgagccgactacctgctgagcttttccaaaatgacgttcccgcaccagctgatgcgggtgattctgctggagcagatctatcgcgcatacaaaatcaacgccggagaaccttaccacaagtgattttcgaggcgtttcgcaagaaacgctaagtaggggcgagccggtatagtggcgcgtatgagtgactacagggacgaacgcgagcagcgagaacgccgtcgccgcaccatggtgcgcacggtgtgcatcgtcatcgccgcggcgatgctgctgagtctggtcattcctgcgatctacgcggggctttgacgccttcgggcccgtatgatccgaaacgggccccggtttcccgtatgcgtgcggacaggttcgcggtccgtccatgtgggaaatggatgtgggcacgtggaaaaaccttatggattgtgcgggagccgtggacggctccatgtcagaatagtcaggaacgtaatagaaatgtatggtgtaaacgatggcagaatttgattactccgaggcgatcagcgaagcgcgcgccaaatacgagtccatttccaaggccctcgacgtcgatcgactgaccgccgaggccaaggaccttgaagtgaaagcggccgaacccggattgtgggacgatccggaaaacgcacagaaagtgaccagcaagctgtccgcggtgcagtcgcagctcaagcgtctggcatccgccgaccagcgcatcgaggacgtggagaccctggtcgagcttggccaggaggaagaggacgccgacacgttggccgaggcgaaggccgaagtcgaaagcatccaaaaggatctcgacgatatggagatccagacgctgcttgacggcgaatacgacgaacgttccgccgtggtgacgatccgttccggcgccggcggcgtggatgcggccgatttcgcgcagatgctgctgcgcatgtacctgcgttgggcggaacgcaacggatacaaggccaaggtcatggacacctcctacgcggaagaagccggcatcaagtcggccacgttccaggtggacgccccgtatgcatacgggcgactgagcgtggagggtggcacccaccgtctggtgcgtatctccccgttcgacaaccagggccgccgtcagaccagcttcgccgccgtggaagtggttccgctggtcgaagcgaccgatcacatcgacgtgccggattccgaaatccgcgtcgacacctactgctcgtccggtcctggcggacagggcgtgaacaccacgtattccgcggtgcgcatcacccacatcccgaccggcatcgtggtgaccatgcaggacgaacgctctcagattcagaaccgcgccgccgccatggccgtgctgcagtcccgactgctggtgctgcgccacgaggaggaagccaagaagaagaaggagctcgccggagacatcaaggccagctggggcgaccagatgcgctcgtatgtgctgcatccgtaccagatggtcaaggacctgcgcacggggtatgagacctcgcagacccaggctgtcttcgacggcgacatcgacgagttcatcgaagccggcatccgctggcgtcacgaacagcgtcgcgcggcagccgaggaacaagaagcctaagcgataggcggagggaaaacacgatggcgctgatctcgcttgaacatgtgagcaaagtctatccaaagggcacgcgtcccgcattggatgacatcagtcttgacatcgatcgaggtgatttcgtctttcttgtgggcgcgtccggttccggcaagaccaccttgctgagcctgctgcttcgcgaggaggaagccacggatggcgagatccgcgtcgccggcaacgatctgcgacgcctgtccgcacggcaggtgccgcattatcgccggcagatcggctttatcttccaggattacaagctgctcaacaacaagacggtatgggagaacgtcgccttcgcacttgaagtgatcggcacaagccgttccaccatcaaatcgctggtgcccaaagtactgcagacggtggggctcacgggcaaggaaaacaactacccccatgagctgtccggcggcgaagcgcaacgcgtcgccatcgcaagggcgtatgtgaaccatcctcagatcctgctcgccgacgagcctacgggcaacctcgacccgaccacatcgctgggcatcatggaagtgttggacgccatcaaccgtaccggcaccaccatcgtcatggccacacacaacgaagagatcgtcaactccatgcgcaaacgcgtggtcgaattgcacaccggcaagattgtgcgcgacgagcagcagggatcctacgattccgcgctgtatttcccggatgccgaagtcgagtcgaaatcgcaccaggcattgggcacttccgacccgaacgcgaaataccgtcgacagaacgccatcgattcaacgaacgctcctgacgacaccgtcgacgtggaaggcgcgacgcgcgccgaaaccgtggtgaacgccgtggatgtggtcgccgctgccgtccatgacggacaggggaacgacggcatcgcccgtcttgccaaatccgtgcattccggacgcaccggccgttacggcgaggccttcgcgtcagtggagaccaccttgacctggggcaagggactgagcctcgaacagatggccgaccaggaacaggccgagcaaaccgaacggaacgaacaggccaagacctccgctgaaaatgatgcctccgagactggtgccgacgaagcatcggcgctgtccgctccgcctgcaccgcccgttccaccgacccaaaccgagcctccgacaccgcccgaaccgcccgtcccgccggcaccgtccgatgaaaaccctgaggacaccaaggagcacgactgatgcgttttcgtttcatcctttccgaaacatggaacagcctcaagcgcaatgtttcaatgatcatctccgtcatgctggtcacattcatctccttcctgttcatcggcgtatccggcctgatgcaggcacagatcaccgccgcgaagggcgaatggtacgacaaggtcgaagtggtcgtatggctgtgcccggacggtgccagccaggcggcgtcctgctcgtcgggcaaggcgccttccaaccaggagatcgtcgatctggagaacgtgatcaacgaggaagccggcaacatcgtctccaaaatcacatatgtgagccgtgaggacttctacaagaacaccttcctcaagcagtatccgaacggcgaataccaaggacgcgtgctcaccgccgccgacatgcaggggtcgctgcgtctgaaactgaaggacccgaccaaataccaagtggtatccgaagtgttgagcggccgcaccggtgtcgaggaagtgcaggatcaacgcaagatcttcgacccggtcttctcggtgctgaaccgtgcgacggcggtcaccgtggcgctcgccggcgtgatgatcctggtggccatcatgctgaccggcacgacgattcgcatgagtgccgcctcgcgtaagaacgagaccgagatcatgcgactggtgggagcctcgaactggaccatccgcctgccgttcgtgttggaaggcgtgtttgcgtcgctgattggttcgctgctcgcctgcggaacgttgagcgccatggtgaagctgttcatcacggattggctgtcgaagagcgtgcagtggatgcctctgatcaaccagaagacggtatggctgcttgcaccggcccttgtggtgggagccgtcgtgctgtcgatcgtcgcgtccagcatctcgctgaggaagtacctgaaggcataaaccggcggagtgctgaacgagatgttcagcatatttgaagtttgctggatacaatgtcgaaataggtggatttcgggaagggaatacatgtctaggaaaatgacgagacaggtgcggcccatcgttggactgatgcttgcttcggctatgttctgcgccggcggcgtcgcggtcgtcgtcgcgccggctccgcaggcgcatgccgtgagcatgtcggaataccaggcgaaggtgtcgaaccacgccaagctgaagtcgcagcttgtcggcgtgagcagcgatctcgccgacacgattctgcagttggccgatttgaacgacaaccagattcctgcggcggtcgaggccgcggaatctgcccagcaggcggcagaacaggcgcagagcctggcggaagcgaccacgcagcggttgcaagcggcccagcaggacaaggcgaaccttgaggagcagatcaaacagaccggctccgactatgatgacgccaaggccgccgtcgcgcagctcgcccgcgaaagcttccacggctccagtacgtcggatgtgctggattttgtcaccgattcgacgaccgccgacgatttcgtcaacaagatgcagtcgcaggccgcggtcacgcgaagcgaatccaacgcggcaaccgacgcggcgaacgagctgaacacgtcgatgaaccgtaaggaccgtctgggcgccatcgaacagaagatcactcagctcaaggagcaggccgaccagcaggcggcaagcgcccagcaggcggcaagcgaggccagcgccaagcagaccgccctgcagaagctgcgtgacgagggcacggtgaaacgtgagaagctcgaatcgcagaagagccagctgacaacgcagagcgccaaggaagcggcggacatcgtcgccatgaaatcgcagatcgattcatggaacaaccagtacaacaattccaacaacgccgctgtcaaccccaataacaaccagcagcagtcgcgtccgaacaacaacacgaactacaatcccgctcccgcgcctgcacctgcgccggctccgacgcccaataacaacaattccggcggcgccggcggcatgaactatgcggtgcccggcaattgcccggccggttccggatactgctacggacacaacaccggcaacacggtcggcggtgccgcgtatccgtcccgccagtgcacgctgtgggcatacctgaggcgttcccagctgagccttccggtcggctcctacatgggcaacggcgccgattgggccaataccgctcgtggactcggatacctggtgaacaacaccccgcatgtcggcgcggcgatggtgttcgcgcgcggccaaagcgtaggcggacattggaccgccgactggcagtacggccacgtggccgtcgtggaacgcgtgaacgccgacggttcggttctgatctccgaaggcggcactggcttcgcgacgttcccggcttgggaaacgatctccaacgccggagcctaccagtacgtccactactgacggttccgttccagacatgaaaccacggcaagcgcgccgtccgcatcgtcgggcgacgcgctttcgtgatatggtcgacggagtcgcgttgcatacactgatcgaaagaaccgggaaggaggtccgacatggccaaggaacagggaaccaaaccgatcgcgcagaacaagaaggcgcgtcacgactacgccatcgaagacaagtatgaggccggtctcgtgttgaccggcaccgaagtgaagtcgcttcgtgaaggacgggcgtcgctggccgaatcgttcatcaccatcgaccgtcgtggggagatgtggcttgagggagccaacattcccgaatatctcaacggcacgtggaacaaccacgcacccaagcgcaagcgcaagctgctgctgcatgcggcgcagatcgacaagctggcccgccaaacccaggccaagggattcaccatcattccgctgagcctgtatttcaaagacggccgcgtcaaggtcgagatcgcgctcgcccgaggcaagaaggaattcgacaagcgccagtcgcttcgcgaggagcaggacaagcgtgaggcgctgcgagccatgcgatacgccaacaagcaggtgcgataaatcggaaaaattccggtttcacatagtgaaagaacgccgattcaggaaaatttttgtaacacaccctctttacgctaggatacggttcggctgaacaggccgatatgaatccataggagagggaacatgcaagcaggaaaagccctgaaaaccgccgccgcgttcatgttgagcgtggccatgctcgccaccggcgcggcatgcggcaccagcgacgacagcgacgcctcggcgtcgaaatccagttcgaagtccagcgaactgaccggttacgatgtttccggcgtgaagaaggacgacgcgatcgccaaaatgctgccggattatgtgaacaaggacggcaagctcaccatcggcatggatacgtcgtacgcgccggccgaattcctggccgcggacggcaagacgccggtcggcttcgacgtggacatcgccaaggcgctggccggagtgttcggtcttgaggccgatccggaaaccgcgaacttcgattcgattattccggccgtcggcgccaagtacgacatcggcatctcgtcgttcaccgtcaccaaggaacgcctcgaggcggtcgacttcgtcagccacttcaacgccggctccgcatgggccgtgaagaagggcaacccgaacaaggtcgacacgtccgatctgtgcggcaagaaggtggccgtgcagaccgccaccatgcaggagaccgccgccaacaagatggccaagcaatgcaaggccgatggcaaggcggagatggacgttatctccagcaagttgcagaccgatgtgaccaccaacgtcgtcaccggcaaggccgacgtgttctacgccgattcgccggtcgccggctacgcgatcgcgcagaccgacggcgaactcgaaacgcttggcaagaccgaaggcatcgccccggaaggcatcgtcgtcaagaagggcgaccagcagatggacgaggccctgcagaaggccctgcagaagctcatcgacgacggcacctacatgaagatcctcaagtactggggtgttcaggacggtgccatcagcaagccggagatcaacacccccggcaccaacgagtgactgtttcggaacttttgcgtccgttaatacgctcgtagcaatccgctcttaggttatgccatagccacgtttggctggttgatttggctgggttgaagagaggacttgccatgatgaggaacctgaaaggttgggcggcgctcgcgttgagcgcggcgatggtcgtctcgatgggagcctgcggaacctccgacaaaacggattcccaagcttccgtcgattcgaattcgtcgtcgaccaccggttacgacgtgtccggcgtgaagaaggacgagaagatcgccaagatgctgccgtcctccgtcaccaaggacggcaagctgaccgtcggcatggatacgtcgtacgcgccggccgagttcctggccgcggacggcaagacgccggtcggcttcgacgtggacatcgtcaaggcgttagcgaaaacgttcggcctcgaggcggatccgcagacgtcgaatttcgattcgatcattccatcaatcggttcgaagtacgatatcggcgtctcgtcgttcaccattaccccggaacgcatgaaggccgtcgacttcgtcagcatgttcaaggccggttccacgtgggtggtcaagaagggcaacccaggcaagatcgacacgtccgacctgtgcggattgaagatcgcggtgcagaccggcaccacacaggaggaggaagtcaacaagggcgccgaacagtgcaaggcggacaacaagcttgacatccagatcctgtccaacaagctgcagaccgatgtgaccaccaacgtcgtcaccggcaaggccgacgtgttctacgccgattcgccggtcgcgggttatgcgatctcccagaccgacgaccagcttgaggccctcggtgaggacgtcggcgtgaccaaggaggccgtggccatcaagaagggtgattccgacacggccaaggcggtgcaggcggccatgcagaagctgatggatgacggcacgtacatgaagatcctcaagcattggggcgtcgaatccggcgccgtcgacaaggccgagatcaacccgaccgatttgggctgatcggcgcactgacgctgcgggcgtaggggcatcggacgtatatagatcgatgcccctacgctttttgccgattaacgtcggcgtagcattgcggttttatcgtgtgcctttggaatactggacgtctgattggcaaatggacgattaccgttcagtggatgggaagagaatagaaggagaacccactatgtcgttgaaattcaaatcgtttgccgctctcgcgctgagcgcggccatgatgttctccgtcgccgcatgcggcaccacggattccggtgacgccaaaagcgactcgaaggcgaagaacaccaccgttggttacgatgtgagcaccatcaagaaggatgacgagctggccaagctggccgcctccgcgaagaccgtcaaggacggcgagctgtccgtcggcatggaactgtcctatgctccggccgaattctacgccgaagacggcaagacgccggtcggctacgatgtggacatgtccaaggccatcgcccagacgctgggcctgaagccgaagatcgtctcctccatgttcgacaccatcgtcccgtccatcggctccaagtacgatctgggcatcaccgccatgaccatcaccgaagagcgtctgcagtccgtcgacttcgtgagctactaccgcgccggctccacgtgggccgtgcagaagggcaacccgaagaagctcgacacctccgacatgtgcggcgcgaagatcgcagtgcagaccggcaccgtccaggaggacgaggccaacaagatcgccaagggctgcaaggccgacaagaaggccgaagtgatgtcctacaagcgtcaggccgaagccgccaccgcagtggccaccggtaaggccgacgtgttctacgccgattcgccggtcgccggctacgcgatctcccagaccgacggccagcttgaggccctcggcgacgttgaaggcgtggccaagcagggcatcgccatcaagaagggcgaccagcagctcgacgaggccgtgcagaaggccgtgcagaagctgatggatgacggcacgtacatgaagatcctcaagcattggggcgtcgagtccggcgctctcgacaaggctgagatcaatccgaccgacctcaactgatctcatcagatagatagaaaaaggaaacagcatcatggcgaagaaacaagtcgacggcgacggcctcgatattcccaatcgcattaaagccttgcccgtcaagcgtacgggtccgatcgtggcggccatcatcgtcgcgctcttcgccgcgatgctggtgcaggctttggtcaccaatccgcgtttcgaatggaatgtggtctggaaatacctgttcaacgagaacgtactggaaggcatcaagtacacgctgctgctgaccgtcatctcgatggtcatcgccatcattctggcggtcattctggcggtcatgcgcaaatccatcaacccggtgctgcgcggcgtgagctggttctacatctggttcttccgtggaacccctgtgtacacgcagctggtcttctggggtctgttcgcggtgctggtgccacgtatcggcgtgggcatcccgttcacctcaatcgaattctggagcattgactcccagtctgtcatcaccgcgttcaacgccgcatggctgggcttggccctgaacgaagccgcctacctggccgaaatcgtgcgcgccggcctcgaggccgtcgatccggggcagacggaagccgcaaaggccctcggcatgaagcgcacgctcatcatgcgtcgcatcgtgctgccgcaggccatgcgcatcatcatcccgccgaccggcaacgagttcatcggcatgctgaagaccacgtcgcttgtcaacgccgtgccgttcacgctggaactgcagttcgccaccacggcgatcgcgacccgtctgtacaagccgattccgctgctgatcgtggcgtgcatctggtatctggtcatcacctccatcctgatggtcatccagtcgcgactcgaaaagcacttcggcaagggcttcgacgcccgtcccgccggagcccgcggcaagcgcacgccgctaccgggcaagaccttcggcgaacccaaggatgacgtcgacaagcagaacgaagccacgttcgcgggaatgaccgcgtgaggggaatgaccatgagcgaaatcacaaccaacgaaatcgttcccgccgtcaaggcgacccaggtgcacaaggccttcggcaacctgcacgtgctcaaaggcatcgacatgaccgtcatgcccggcaccgtcaccgtgattctcggaccgtccggttccggcaaatccacgttcctgcgtctgatcaaccagctggaaaccctgaccggcggcgaaatcgacgtcgacggcgaaatgatcggctacaagtacgtcgacaaaggcggcgaacgtgtgctgcagaccctgaacgacaaggaagtggccgaacagcgttccaaactcggcatggtgttccagcgcttcaacctgttcccgcacatgacggctcttgaaaacgtcatggaggctccggtccacgtcaagcacatggacaagaaggaagcccgcgaactcgccattcaggagctgaaccgcgtcggcatgggggagcgtctcgactactatccggcacagctgtccggcggccagcagcagcgcgtggccatcgcccgcgcgcttgccatgaagccggagatcatgctgttcgacgaaccgacatccgcgctcgatccggaactcgtcggcgaagtgctcaacgtcatgctcgacctcgccaaggaaggcatgaccatggtggtcgtcacccatgagatcggcttcgcgcgcgaggtcgccgaccagatcgtcttcatggacggtggcgtggtcgtcgaacagggcggaccggagatcatcgaccatccgaaggagtcgaggtttaaggacttcttgcagcacgtcctgtagcaagtaaggctgtcgtactgccgtaaattcccaatccactgacgtcaagcgtccgcagacgtccggtgggttgggttttctttttgccgccgacgatgggcgcgttgcgtgcgtcactggttcgcacgatttccctgggggagtgggatttcgcatatatggcaaagatttgtaaggacgcgcggcttggtttcatgattgacatccttacccgataggctaaggagctatgtgtggaatcgtaggatatgcaggaaatgttcggaccgcgtgcggcaaacccttggaggtctgcctccagggtcttcagcgattggaataccgtggatatgattcggccggcgtggcgttgaccgcgcccggcatggaccatgtggcggtgcgtaagaaggccggccgtctcgccaacctggtgcaggacatcgaacgcgatccgatgccggaagccaccgtgggcatcggccacacccgttgggccaccaacggcgtgccgaacgacaccaacgcgcatccgcacacctcgcgtgacggcaaagtggccatcatccacaacggcatcatcgaaaacgcgtcccagctgcgtcttgacctgcagacggaaggctaccatttcgtttccgaaaccgatacggaggtcgcggcgaagctgctgggtaagatcagcgacaagatcatcgaagagaccggcaagcctgacctgttcaaggccgtccgccgtctcgcacgcatgctggaaggcgcgttcaccatcctcgccaccgatgtgcgccagccggacatcgtggtcggcgcccgtcacgattcgccgctggtggtcggtcttggcgaaggcgagaacttcctcggctccgacgtggccgcgttcgtggcctacaccaagcgcgccatggaaatcgaccaggaccaggccgtgatggtgtccgcagacaaggtcgtcgtctccgacttcatgggcaacatcgtgcccgatccgaagacctacaccgtggactgggatgcgtccgccgccgaaaagggcggttgggactccttcatggacaaggagatccatgaggatccggccgccgtgcagcgcactctgctggggcgtctcgacgagaacggcaacatcaacctcgatgaggtgcgcatcgacgagcatgatttcaaagccatcgacaagatcatcgtcatcgcctgcggcacggccgcgtatgcgggcatggtggccaaatacgccatcgagcattgggtgcgcattccggtagaagtggaactcgcccacgaattccgctaccgtgacccgatcctcacccccgaacgttggtggtggccatttcgcagtccggcgagaccatggacacgctgatggcgttgcgccacgcgcgtgaacagggctccaaggtattggccatctgcaacacgcagggcgcgtccatcccacgcgaatccgacgcggtgctctacacccacgccggtccggaagtggcggtcgcctccaccaaggcgttcgtggcgcagatcaccgccgcatacgtgctcggcctgtatctggcccaagtcaagggtgccatgtatcgagacgaaatcgcccagactttggaatctctgaaggacatgccccgcaagatccagtggattctcgacacccagaccaagaccgtgcaggaagccgccgaacagatggtggatgcgaaatcgttcctgttcctcggccgccatgtgggctatccggtggccatggaaggcgcgttgaagctcaaggaaatcgcctacacgttcaccgaaggcttcgccgcgggcgaactgaaacatggtccgatcgctttggtggacgaaggcgaaccggtcgtattcatcgtgccgccggcgcgcggccgcaacgtgctgcactccaaagtcatctccggcatcgaagaggtcaaggcccgtggcgcctacatcatcgccgtggccgaggaacacgatccggacgtggaacgttacgccgacgtggtcttctggcgtcccgcatgcccgacgctgatgagcccgctggtggacgtggtgccgctgcagctgttcgccatggacatggccaagctcaagaactacgacgtcgacaagccgcgcaatctcgccaagtccgtcaccgttgagtaacgaacgcaggcaccggtacgtgctcgaggaacctcatattcccttcgaatatgaggttctgtacgaggacgagaacatcatcgtcatcgacaagccgcatttcctcgccaccacgccacgcggcatgtggtatcgcgaaaccgcgctggtccggttgtgcgagcggtacgacgagccgaacatcacgccggcgcaccgtttggaccgactgaccgcaggcgtcgtcgtgttcgtacgtaatccgtctgcgcgaggcgcgtaccagatgctgttccaaaatcgcaaaaccgtcaaaacctacgaatgcctggcaccgctcgccccgacgcagcggccgcgatatggaacggcggtgcgcatcgaccggcacctgccgtttccgctggtacgcaggtcgcatatcaacaaggatcgcggacgattgcaggcgtacgaaagcgccgacgtgcccaacgcggaaacgctgatcgaacggggaagcggcatccgcttcgttgccggcagaccgtacgtgaattacacgctgcatccgaaaaccggcaagacgcaccagttgcgcgtgcatatgaattcgctcggactggcgatattgggcgacgatttctacccggacatcgtgcagcgcgcgtacgacgacttctcgcaacccttggaattggtggcgcgcgaactgcgattcgatgacccgctcaacggcgagccacgtcgattcgtatcgcacgtgccgttgggcgcgggcttatagaaacccacgattttggacattcccctatctcgcccgacacgcccgattatcatggcgttctgttgacttgccggagcgtttccggcatcacgagagtaagagagaaccatgggtaaaatctcgaaagccgtccgcggcgtcgccgacatctacaacggcgcatcgctgatcgtccgtatcatcgtcggcctgatcatcggcaccgtgctggcattgaccatgccccacgtgacctggatcggcgaattcggcaccctgttcgtggccgcgttgaaggccgcggcaccgattctggtgttcgtactggtggccagcgcccttgcgcagggcacgtcgaaactcgaccgccgtttcggcaccgtgctgttcctgtacctgttcaccacgttcctggcagcggtcgtggccgtgctgacctcccgtctattcccgcagaccctgtccttgggcaaggccgccaaagccgacgtggtgccgcaaggcctttccgaagtcatccagacgctgctgaccaacatcgtggccaatccgatccaggccatcatcgatggcaactacatctgcatcctgatgtgggcctgcctgttcggactcgccatgaagtccatcgccaacgaaagctccaaagcgttcatggccaacgtggccgacgccgtgtcccaggtgatccgctgggtcatcaacctcgccccgttcggcatcatgggcctcgtgttcaccaacgtggccgacaacggcctgtccgcattcaccaagtacggcagcctgctgctcctgctcgtcggcaccatgctgctcatggtgctcgtgttcggcccgctcgtcatcttcatcttcctgcgccgcaacccgtacccgctggtctaccgctgcttcaaggaatccggcctgaccgcgttcttcacccgctcctccgctgcgaacatccccgtcaacatgcagctgtgcgagaagctcgggcttgacaaggacatgtactccgtgtccattccgctgggcgccaccatcaacatgaacggcgcggccatcaccatcaccatcatggccatggctgccgccaacacgctcggcatccagatctccctgccggcggccatcctgctgtccgtggtctcagcgctcggcgcatgcggcgcgtccggcgtggcaggcggctcgctgctgctcatcccgatggcctgctcgctgttcggcatcagcaacgacatcgccatgcaggtggtgggcgtcggcttcatcatcggcgtcatccaggattccgtggaaacctgcctgaactccgcgtccgatgtggagttcgcggccaccgccgaataccatgcctggctcaagcagggccgtcagctgccggccttcatgtattccaagaaggaacgcgccaagctcggcatcgaagcttgattgcgtaccggcttagccgccgatgcgatatcgcagggaaccgctttggaagttcgcttccggagcggttcttccgcattcggcgtatttgggtggatatggggagcctttccaggcttgtgcgtggcttccgcatgacccgtataatcttatggtggtaatcgcaggcgaaatacaaaacggaggtccgtgggcgtggtgctgaaatcggcgaaactggtgaagcagctcatcgccatctgctgcgcgggcgtcatggcgtccagcgccgccgcatgcggggccaatacggacacacgcacacagatcaccgtatggtcgtgggagccgagcatgaaacaggtcatcgccggcttcgaaaaagacaatcccgacatccgcgtggtttggaagaacaccagcggttacgacaaactcaacaacgccatccaagacggttacggcattcccgacgtggtgcagctggaatattacgcattgcgccagtacgcggtcagcagccagctcgtgcccatcaccggcagaaccgaaggctatgccgatttctacacgcccggcacctgggcgtcggtgcagctcaacggacgggtgtacgggcttcccatggactccggcccgatggccttcttctataacaacagcgtgttcgaacaggttggcgtggacgcgtccaagatccgcacatgggacgactactacgaggccgccaaaaaactcaagaaaatcggcgtgtacatcaccgccgattccggcgacgccagcttctacgacacgatgatctggctcgccggcggacgcccgttctccacgtccaacgatggcaagaacgtgaccatcagactcaccgaagataaaggcacccgcgaattcaccgaattctggcagaagatgatcgatgagggtttggtggcaacaaacctcacgtcatggtcggatcgatggaaatcggccgtgggacaaggcaaagtcgcctcgctgttctccggcgcatggctgccttcgctgctcatgtccgacattcccggcgcggccggcctgtggcgcgtggcccagatgccgacgcccgacggcaaggccaccacatcggaaaacggcggttcggcccttgccgtgctgcaacgttcccgcaaacccgaagcctcataccgtttcatcgaatacgcctgccacaatgccaaaggcatcacaacccgcgtggatggcggcgcgttcccagccgacaaaaacaccctatccgactcgaaattcctcagcaagaccacggtgaccgacgaccgtggcatcgaagtgccctatttcggcgggcaggaatacaaccgcgtgctgtcccaggccgcggagaacgtgtcgaccggataccagtatctgccgttcgaagtgtatgcgcgcagcgacttccggtccacggtgggcaaggcctacaaatggtcgagcctgctgcgcaaagagcagaacaggctcaacatcatcgccgcaggcggtcaggtctccgacacctccaacatcggcgatgcgttgaagaacaccgaatcgtccgaccgcatcaaacttaagggcggcatagccctatggcagaaggacctgaaagaatacggagccaaccagggcttcaccatccaatagcgtctgtgtaattggtttaatcgattgcggcctgcggatagcgcattatccgcaggccgtcggttttcagattgccgggctatgatcgccggttcccgtcgctggctcttgaatcagcggacgttgcggtcgtagatgtgccacatgcccttgaaaatcaggtccggatcgtaaatgtcgatcatgttcgtgccgtcggcgaacacgcggctcaatcctcccgtcgccaccacacggaaatcctcgtcgatctccttatggaactgcgcgatcgtgcgttcgatgccgccgaggaagttgtagtacaggcccgcctgcatggccggtttcgtggacttcgccagaatcgacttcggacgggtgatctccacttccggcagctgcgccgtcccttcccacagtgcggccgcggcggtgcggataccggtggtgatcagtccggaaatcaccgacgcgtccgcggtgacgtagttgaacgtggtggccgtgccgaaatcagccaccagaatcggcccgccatactcgtaatacgcgcccgcgcagtcggcgatgcagtccgcgcccatgttctgcggattgtccatgcggatgttgagtcccgttttgatgcccggtcccacgatcatcggatcgatgtcgaggaacttcacgatgctcgcacggaacgaatgcatgaccttcggcaccacggacgaaatgatcacatcatcgacatccgccggcttgtagccgctcaaagccaggaactgcgtgatcatcagcccgtattcgtcggacgtgtggttcgccttcgtggtgatgcggtacgtgcccgcgatgcgcccatcgtcgatgaaaccgatcacgacgttcgtgttgccgatatccacagccatcagaagcatgttgcgttctccttcgcgttttgcggaagttccgttgaaatattgcgattattgcgattgatacggttattgcgattcgaaaatgctgcggttagcgccgttcgccgtccgcacgcatggctgcgagcttgacaagaatacgtttcgcaagtgcgtccttgcccatcttgctccatcgttcgatgcttggcctgtctgcggtttcgcccggcgtcagcaccgtcaccacgttcgtgtccgctgcgaaaccggcgccgggggtgcgcagattgttggccaccagcatgtcgcaatgcttgccgttaagcttcttcgccgcgttggcctcaaggtcgcgcgtctccatggcgaatccgcacaatgtctggtccggccgcttatgctcgccggcccaagccagaatatccggattcgacgtgagctcgagctcgatgccgctgcgcccgttcttcttgatcttgtcccgggcctgctcgaccggacggaaatcgccgacggccgcggccatgacggtgatgtccgtgtccgagaaacggctcgtcaccacatcgaacatatcccgtgcggtcgtgacatcgaccacatccacgccatacggggcgtccaacgccaccggaccggacacaagcgtcacctgcgcgcccagattgcgtgcctgttcggccaaggcataccccatcttgccggtggaatggttggtgaggaaccgcaccggatcaagcggctcctgcgtcgggccggcggtgacgagcacggcaagtcccttaagcggcagctcgccgtccggacgattcgcaagcagcagcgctttcaccgccgtttcgatgcgtgccggctcctccatacgtcccttgccggcgtcgccgcaggccagcatgccgctttccggctccacaatcgtccaaccgagctcacggcaggtattgagattgcgttgcgtcacggcgttttcatacatatgcacgttcatggcggggcacaggatcttcggtcccttgtcgtacgcgagtatggtgctggtcagctggtcatcggcgatgccgcaggcgattttcgcgatgatatcggcgctcgccggagcgactgccagcagatccgcccacttcgcgtcggccacgtggctgatctgcagcggaccgtccggtccgggtgccacgtcggccgtagcgccgggacgatgtccggcggcgaacatggacatgcgtgtcggcgtgtgggtgagggaactgaacgtcaggggagtgacgaactcctgtgcggcggcggtcatcaccacacgcacctcatgcccctgcttgctccaatcggaggcgagatggcaggccttgaacgcggcgatgctgccggtgacccccaaaagaatatgcgccatggatcaaccgtccttctcgttgtgacctgccgcgactgcgtcaagtatataaccgggccgaagcctccgcgcgctttgcgggcgaatccgaacgggccgcgggtatggcggacggtagaatcaggccgtggtgatcgacctcacgcaggcggtcaaccgcaatcacaacacataatcgaaaatacgaagaggagaaatcccatgtcgtcacctaccggtgcgcacggcgaagccgacgcaaccaaacaggagaacgaacagcagccgcagtccacggcaagcaccgacgccacgctgaacgcgcgtgcgaaatcgtcgaacggcgcgaaatcgcaaggcccgaagaagtggcttatcgcgttgatcgccgtcatcgccgccgtcgcggtgatcgtcgccattgcagtgacgcgcggcaaaaacgatgacgcgaacacttccggcgtaactaaagccgacaccgtcaccatcgggctcaaactcgccccggtcagcctcgacatccgccaccagtccggatcggccatcgaacaggtgctgatcggcaacgtctacgaagcgctgctgtcgcgcgactccgacaacaaagtgcagccgggcctcgcgaaatcctgggacatttccaaggacggcaagacctacaccttccatctcaaccagaacatgaccttctccaacggcgacaagctcgacgctgacgacgtggcctggtccatcaaccagctcaaggagaagcagtactacaacgccaaccaggtggccagcctcgacaaggccgaagcggtggacgccaacacggtcaagctcaccctttccacccccgactccaacctgctgtggtatctgaccggacgtcctggcctcgtgttcgacaaaaacgccaaatacaacgcgaaaaccgaagcggtcggctccggcccgtataccgtcgaatctttcgactcggccagcaaaatggtgctcaaagccaatgcgaaatattggggaaccgcgcacaagcccgccacccagaacgtggtgatccgcttcctcaccgacgacaacgcagcggtcaacgcgctgaaaagcggtgacgtcgacgtgctttccccggtgaacgccacgctcgccaaatcattggatgccagcacatacacggtgtccgcggccgacggcagcgacaagttcgtcctcgccttcaactgcacgaacgccaaactcaaggacaagcgcgtccgccaggccatccgctacgccatcaaccacaaggagatcatcgcctcccgaggcaacgtcgactacgcgctcggcggtccgatcccgtccgtcgaccccggttacgaggacctgaccggcctgtacccgtacaacgtggacaaggccaaggaacttatgaaggaagccggttataccaccgacaagccgttgcggctcaccctcacctacgccaacacgtacggcaccgaactgggcgaccagctcaagagccagctcgccaaaatcggcatcgatttgaagatcgactatgtggaattctccacatggctgcagaacgtgcacgccaacggcgactacgagctgtcattggtggaccacgccgaaagccacgacttctacaagtggaccacgccggactactactaccattacgacggcaagcaggcgcagaaactgtacgccaaggctttggaagccaccgacgaggccgacagcgcgaaatacctgaagcaggcggcgaaggccgtaagcgaggacgcgccggcggactggctgttcggctaccgcgtgacggtggccgtcaacaagcacgtgcagggcttccccagcaagctcagtcagacggtgctgccattgtggcggatctccaggaataagtaagggaacggtatttccatgcgattcgtgggaaagcggctggcgctgttcgtagcggctttggtgggcctgtccgcgctggtgttcgtgatgctgcgcgtattgccgggagacgtcgccgcggtcatcgccggcacgaacgccacccccgaacgcattgcgtcgctgcgcgccgaattcggcttggacaagccgctcgtcgcacaatatggcgattggatggcgggcatgctgcatggcgacctcggcgtgtccgcagtcggcggacggccggtcgcgcggcaggtcgccatgcgcgccgccgtaacgttccctctgattgtgctgagcctgctgatcgcgctggcgatcggcctgccgcttggctgcgaggccgtcctgacacgcaatccgcggctgcgcggcctgttccacggcattgcgatcgtgggcggcgcggtgcccgcattgtggggcggcctactgctgatcctgctgttctcccgtggcaggggactgttgggattgctgcccgcgcaaggcttccccgacaccggctgggccacgccgggaaaggccctgtcctgtctgctgctgccggcgctcaccaccggcatcacagccggcgcgtccatcatgcgctacacgcgtgccgcagtgggggatatggcctcatcgcaggcggtggacatggccatggcctgcggcatgacccgcaaacaggcggtattgcgcgtggcgttgcgtctggccactgcgcaactggtgtcggtggtcggcctgaccttcgcgcaaatgatcaccggcgtgatggtggtggaaaacctgttcgccctgccgggtcttggcgccatgctggtcaccgacgtcggcaaccgcgacttggtcgcggtgcaaagcgaactgtttctattggccgcattcttcctgctgttgggactcgtggtcgatatgacgcatcgcgcgctggatccacggctgaaggcctccggcgtcgtttcggggaaggtgaacgcatgagcagatcgaatcctacgcaaactccgaacgctacggatggtgaagaatcagcgtccacaacgccagcggaagctactatgagcacgacgggtgcggtcgtctcgtccatctgggccaaggcgagcggcagatacgcgacgatcgtcatcggactatggctgctgaccgctgcggtgtccttggtctggacgccgtattcgctgctcgacaccgacggtttcaacgcgtgggcctcgccatccgccgcgcatccgttgggcaccgatggtaccggagcggatgtgctgagctggctgatggccggctcccgcacgaatctcatgatcgccgtgctcaccgtcgtcgtcgcggccgcgatcggactgctgttggtggcagccatggtatcgcgttccggtgcgctcgcgtccacatcggtggtggtggccgacgcgctgatctccattccgacggtgcttatcgcattgattctttccgtgccgttcggcgcgtccgccgcggtggtcatcgccgcctgcggttgcgcgtacgggctgaacctggcacgcatcctacggccctccgcactgctcgccgcacgttcggcatacgtcgaatcggcattatggtcgggggcaagctccgtccgcgtgttcttcacgcatatcgtgccgaacacgctgccggtattgtgcgtgcagttgtccatgagcgccggcacctcgctgctggcggaggcgggactcacgtatctgggcgtcggcgtcggagccggcgtgcccagttgggggcattcgctgtccacgtccgtgaaattcatcagcatctatcccatggccgtcctatggcccggcttggtcgtcacgatggtggtggtcgcgttgaacctgttcggcgacgcgttgcgcgacgcgctcgatccgctaaccaatcccgcgttgagggaggccgcatgagcgccgtcatacgtcatctgaacatcgccatcaacggcaagccgatcgtcgatgatgtcgatttggacatcgccgacggcgaacgtgtcggcttggtcggctcgtccggttccggcaaatcgatgatcgcccgcgccatgatgggcctgctgccggctaccgcacaggtgacgggcagcgtcgaattgggtggtacgcagattgtcggcgcgtcggacgcagcggtcgccgacctgcgcggacggtacgtgggcatggtgttccagaatccgtccgccgcgttgaatccggtgatgaccgtggcgcagcaggtcggtcttccgctgtacctgcattacgatctgtcgctcgccgaacggtcggaacgcgtcacagcggtgcttgccaaggtcggcctcggcgaggacgtgctggtgaaatacccgcatgaactgtcgggcggccaacggcagcgtgtcggcatcgccacggcgcttgtcacttcgccgcggctgatcatcgccgacgagccgaccaccgcgttggattcgatcacgcaacggcagatcgtggacctgctcacgtcgctggtggacgagtcgggcgcgtcgatgctgttcatcacgcacgatttcgcggtgctgaacagggccaccacacgctgttatgtgcttgaatgcgggcggatcgcggaatccggcgatacggacgcgcttctggaccaaccgcgcaccgacgcgggacacaggctggtccggtcggcccgcgcgttgtcgttgcacgcagggcaggatgccgggcgggaatccgtgcggaatcccgcgcaaaaggaggtggaccatgactgacgtgaacgaaggaatggtgctgcgcggccgcggcctcgacaaatggtatggcgcgaaacatgaccgccgtcaggtgctgttcggtgtggatgcggatgtacgggcgggggagtgcctcgccgtgatcggcggctccgggtcgggcaagaccacgctgacccgcgtgctgctggggctcgaatccgcggacggcggcagcgtcgaatactgcggcgagccggtccgtggcgacgtggcgcacagtctgcgcctgcagtccggattggtgttccaaagcccgttcgattcgttggatccgcgatggcgcatcggccgatccataggcgagccattgcgaatgcatcatccggattggccacgggaacgcgtcgcggaacgtgtgaccgaagtgctggaaatggtgagcctcgatccgggaacgttcgtcaaccgtttccctgtcgacctgtccggagggcaggcgcagcgcgccgcgatcgcccgcgccatcgtggacaagccgaagatgttgctcgccgacgagccgatgagcgccatcgacgtggctgcaagggtccggatcctcgacgcgttcgtcgcgattcgcgaatcgcagcccgatatggcgatcatcatggtgtcccacgatctgggcgtggtgcagcacatcgcggaccgcattctggtcctgcacgacgggcgcgcggtcgaagtcggcccgacggaccaggtgctgggccatccgcaggacgagtacaccaagcgattggtgcaggccgcctcgctgtaggtgtcgctccgcatgcctcattcgtgcgcgccataccgtctcgcatattcgtggtgcgtctcttttctataacgatttgaccgattgcgtgtcggtcgatattgttggttacatggttagttagttatgtaactaaccatgtaaccaacaggatggatggtccggcatgaccggatgttcatgatcgggggactgcgatgacgcatggaacatatcaaagccacgggatgcaacggccacggcgaatcgtgacaatactgacggttcttgctttgagcatatcgttgggcgcgtgcggcacggcaggagatcggaagcaagagcagtcgtcacggggccaggcgtccgccatcagcggcgatgcggacgccaacgccgcggacgcgtcgtatcgggacgaaatcgcaaaaatcaagaactccggtagcactgaagccgcccagattctcgaggacggcaaaatcacggaagaggagttggtccagctcggttccagctacgcgcaatgcctgacctcgaaaggcatcacagtggacgccggcgaggcgcgataccccggtgggtcgatcggcccgtcctacggagacgacgcgcttgacaagcgcaacttgagcgaagatgagattgccgccaccaatgccgctgacgaagcctgccagaatgagacccaatacaagaacatcgtcgacctgtatctgagcctcaaggagaatcccgagaacgtcgataacgaccaactcgcgcgccagcagaacgacaagacactggcctgcctgaaaaaacacggcatcgtggacgactccgtgaccgccgacgcctacgacgagctggcgacgatgggcgaatccggcggaacgagcttcgatgacctgatcggcaaatacgccctcaaggacaatcccgcctacgacaaacgcaaagcggccatcatcgaacaatgtggggcattgtgatggcgggcggcaaaacacccgtcagagcatggtcgcatgttcggaaccgacggacggatgcggatggaaagcggtggccggcgacgcgacgacgtcagccattggccatgtcggtcgtcgcgctgttggtggtcatcgcattggcggcaggcgtcggatgcggattcctgctggtccgaccggccataccccaatcgttgcgatcctcaacggcctccggctcgatcactgcggcgaaaagccggttcgatgatgcccgagacgtcaccgtcacggtccataccggaacggggcgcaccgtggcctcgcccaaatcgggcaccatcaccgcctatggttgcgcgcccggacaaaccatcgattccggaacaagcttcatcgcagtggatgaagtgccgctgctgtcgttgcataccgccgttccgccgttccgcgacctgcagtccggtatgcgaggccgcgacgtggcggcgctgaacgccgagctgcgacggcttggatatgcggcccccgacggcgatgcgatgacctgggacacgattctcgcatacaatgcgctcgccgataccgtcggcgcggcacggctggtcaaggacaacgggtggacgctagccaaagacgcttacgtgtggttggatgggcaatccgtgacgatccgttcctgcgttgccggcatcggcgcatcaatcgacgtgaaatccgaactgttgaccaccgattcgcaatcgcaatcggtatccgtgaccatgccgcaggacgaggtggtcgcaggagatcgggtgcttgacgtggacggtcgaatggtcgacatgccgcaacaaacgacggcaatcaccgactcgtcgacgctggctgcattgctgggcagcgacgcctatcggcaggcgtccggcacagctgagtcctccgagagcgcgtcggatggcgcgtcggatgtgaccttcaccctgcaatggcgtctaaaaactccaatcgatgtatggtcgctgccacccaccgctttctacgcgcaacatgatgaacaggcctgcgtggtgtccgatggcaagcccgtcgcggtcaccgtgatcggctcccgtttggggcgctcaatggccacggtcgattccggcgcggcattgggcaaagtgcgcacgaatccgcaaggaggcaaaccatgccgatgagtgatcccgttgattccacgggtcctctgatgaagggggatgatgagcggacgccgggaaaactggtgacgttgcgcgatgtcggtcacacattcactggagacacttggctgttccgttcgttaaatgctgacctgcggcccgatcgcgtgtacgcgctggtggggccttccggttcgggcaaaagcacattgttgtccatattggcgggatgggtgaagccgtcggaaggatccattcagcggctgaacatcgggaaaaccagctgggtgttccaaaatcccatcggagtggcgcgccgaaacgtgatcgaccatgtgactctgccttatcttgcgcgggggttggatgtgccgcaggcggaggcatgcgcgcgcgagctgcttgcccagttcggtctggcggagcgcgcgtccagcgaataccgggagctgtccggaggagaggctcaacggctcatgctggcgcgtggcgtggcgtcgggcgccgatctgctgctggtcgatgagccgaccgcgcaactcgatgtacatacggcggatacggtgaatgcgcgactgggcgcgttgtcaagacagggcatgatcgtggtggtcgccacgcatgatcatcgcacgcgcgacgccgccaccgatgtcatcgatttggaggattaccaatgaaatcgatgcggttgaaagcggtgctgcgtgagacttggcgcaacgtcgccactggtacgagccgatgcgcgcttatctcgctgctgctgtcgatatgcgcggtcgcatgcatgtgcgcagacctgacgcagatgacggggttgatcggcgacgcctggaaatggaaggaatcaggtgcctccacctatgcgatcactttgcagggaggaatcgacggcgcggcctgcgaagggctgcgttccgcgaacggagtgttgggcgccgccgccctccggcagtcgtccgaccgcgtgcgcatcgcgtcattgcccgcgaccgagattccgacatacgaggcaagcgcacatgtcgcgcaggtattcgcggcgacagggatacggaaggacaattccggtgtgatcatgtcgacggctgtggcgcgcacgtatggcgcgcatgccggcacggtgctgccgctcgtcggtggcgcacgcatgcgtgtttccgcgacgttcgattggccaagcgacggaaggcaaccaacatacggctatgcgattatctcgcccggcaacgataccaaggcctatgacacctgtctggtccgtgcgtggccggttcccgacggtatcgaaagcctgctgcgtgtctccattcgcgccgatgccgaatccggtgtcggcgccgctgcgagctccacctctgccgggacgagtggaagcaacgaaacgccgcatgcgaaaatcagccggatcaataccatgctggggtcgcatatgcctggcccggcggatttcgatgcccgcatcacccggtatgcgccactgttgatgttcgtcatcgcaatggcgttggggttcgcatcggtttgcatgcgcagaatcgagatagcgagcgcgttgcatgcggggtatccgaaaaccgcgatgctgctgcagctgtctttggagacgctggccacggtggcggcgtcttgcgtggcatgtctgccggttgtcgcgattgtgccgctcatattgaccggatccggtgacgcgatgccggttgtcgcgatgctatgccgtgttccgggcgccatgtcggtcgggatgcttgccgggactgcggttgggggtatgacgatccgtgaacggcagttgttcgcctatttcaaggcacgcgcatgacgtgtgccgtgtccttgagagatgcttcgccggctgttcgttgccgcatcgcggcagaccaacggttagagtggatgacgttgatattgaaccgactaggcggctggaggcgtcggatgcgattcgatttttcgggaacgacgccattgttccggcaggtggccgaacaaatcagcgaagctatcgtctccggtgccttcgcggaaggcgaacaggtgcccagcaccaccgagatctcgtccacgtatgcgattaatcccgccacggtgctcaaaggcatgaatctcctggtcgatcagggtctgctggagaaaagacgcggccttggcatgttcgtcaccacgggagcacgggagaaggctcgtgacgccaaacgcgaggaactgctcaccacgcgggtcgtcgaactcgtcgcgcaggcaaaggcgcttggcatcagctgcgaacaactacagcgcatcatcggaaggacctatcgatgagtctggtcatcagcgatctgagcaagagccgtcatggaacgtccctgctcaacggagtgaatctggaattacggagcggtgcgatacatggtctgttcgggcgcaatggtgccggcaaaagcacattgctgaacatcatcgcgaaccgactcgtggccgatgccggcagtgtgtcgttcgacggcaaccgtatgacggatggcggcggcatgtgggaacgtctcatgctgatggacgagacttggccatatcctgtcgaatggcgtctgcgatcggtgttccgtctgatctcgcggcgatacggcggattcgatgatgtgttggcggggcgtatgatgcaggctttcgggctgcggcctgatgctcgtttcatgagactgtccaccggtcagcgtggcgcggcgaagctggttgccgcgctttgcgcgccgaccgatatcgtgttgcttgatgaagcgactgatggtcttgacgctgcggcccgtgacctgtgttaccgcttcgtgattgagtcgtatggcgacagacctcgcaccatgatcatatccacccatctcataacggaggtggagggactggtcgaacatgccgtggtcctcgaccatgggcgggtgctggaatccttcgacatgaacgagttggcacaacgtgggcggatgctgtcggggccggtcggatcggtgcggcggtacttggccgacaatggtttgcgtacgctgtcggaaaccgttctcggtggtctgctgactgtcggcgtgcgtggcgtgccatctgcaccgatgccggaggacgttgtcatgaggtctttcgatctcaatgagtatgtcatccagattaccggcatggacaaggggtatgcgtcatgatggatgaagtgaaaggcttgtcggccgggatgcggttcgcgctgacaaggcagcttgccgcgcgttgcgtcgtgttgatggcgtacgtgttggccggttattgcgtgccgtggctgtggggtctgattttggccttggtatccggaggtcattatgtggtggaataccatgtgcttggcccgacgttggtgatgtgcgcggttctgacggcggttccggctgtcagtggctttcgttccctgatatccatgggcgtgggccgggccgtgtatttctggaccgagatgttcgccaatctttgcttctcccttgcctgctcggtggtcatgacgttggggttcgtgctgacgccgaaccatgatgccgatatcctcatcacgttccgtgtcggcagtgacctgcagtggctggcttgtgtgccaccatccgattcattcggacgattgcgattcctgaaccgtgatctgggcggttcatacgcggccatgagaacaggcgtgcgaggcgatacggccaatccgatgctgctgttcctggcgctgttcctgttgaccgcctcggtggcgattctgggtcaatgcgtcggggaactgctggcgcaggtcaatcggtacggggcaatcgccctggcggtgtcggcatgcatagcatgggtcgcgcgtccatggctgttgaacagaaccgccaccgatgtcaatccgatgatatggaaactgctcgaggcactgcggggacgctggtgtctgatgtggcgtgaggggcaagcggcgtccgcggcgatgtacggaacgtccaacgagcgtctcgtatacgatcaggcctacacgttctggccgatgatggtgcttttcgtaggtgtgatgatcttcggcaacttgttgtgctggctgttgatccggcgtcgtgaggtgcgtgttccgcagttgctgccggtatggtggtgacgatgctcggcatgggcaacacgccgatgtccacgtccgtgctatcgtatgagccatgttcaatttctcatgttgttgctgtcgctgaccaaccgcccgaggggcgcgtggttcatcgacgcataacttgagataggacattccaacaagcggtcgcgcatatcgcaggccgtatgcgaatcgccaaacgatcattcgaaatagcgcatcagccgaggttggcgcacgcgacgcacgcgaatgagcaaggcagcatcgcaacaggtcccgtttcaacaactgcacgcgacggacgcgagcttctcgaacatacgaaaccaaaaccattcgaaaagcccacgaaccgcaccgtgcaaaggaaacgtcatgaccatccacaattccctgtccgaactcatcggcaacaccccgctcgtcaaactcaaccacgtgactgacggcatcaaagccaccatcgcggtgaaggtcgaatacctgaacccgggtggctcgtccaaggaccgcatcgccgaacgcatcatcgacgcggccgaacgcagcggcgaactgaagcccggcggcgtgatcgtggaaccgacctccggcaacaccggtgtcggactcgcgctcgtggctttgcagcgcggataccgtgcgatcttcaccctgccggacaaggtttccgaagccaagcgtgcggtgctgcgcgcatacggcgccgaagtggtcgtaacccccaccgacgccggtccggacgatccgcgctcctactaccaggtggcagaccgcctcgccaaggcgattcccggcggctaccgtcccaaccagtacgacaatccgaacggtcccgaaagccactatcacaccactggtccggaaatctgggaggccaccgaccacaaggtcacgcatttcgtggcgggcatcggcaccggcggcaccatctccggcaccggacactatctgaaggacgtgtccaacggcgcggtgcaggtcatcggcgccgatccggaaggctccatctactccgacccgaacgacgtgcaccaataccagatcgaaggcgtcggcgaggacttctacccgaaggccttcgaccggagccttcccgacgagatagtgcaggtcaccgacgcggaagccttcgaaatgacccgacgcctcgccaacgaggaaggactgctcgtcggcggctcatccggcatggccgtgttctccgcgctgaaatacgcccgcgagcacgacctcgacgaaaaccagctcgtcgtggtgctgatgcccgattccggccgcagctatatggagaagatcttcaacgacgactggatgcgagccaacggattcgccgacgtcgtggaacgcaccaccaagcccagcctcgccgaacagtacctgtaaaagaccgtcaaacgactgtccggcagcccgatcgcacctttgaaaccaatgcccatcatccgaacgacccaaaccatccgctacttccaaggagttcccatcatgaccatctcgaccaacaccgaagccctcaacgccaccgctctcgccacccgcgccatccacgcaggccaggaacccgacccgaccaccggagccgtggtcacccccatctacatgacctccaccttcaagcaggacggcgtcggcggcctgcgcaacggctacgactacagccgttccatcaacccgacccgcaacagcttcgacgagcagctcgccgccgtggaaggcgcgaaatacgcgttaagcttctcctccggacttgccgccatcgacgtgctgctgcgctccaccctgaagcccggcgacaacatcctgctcggcaacgacgtgtacggcggcacctaccgtctgctgtccaaggtgttcgtgccgtggggcatcggcctcgacgtggtggacatcaccgacacggccgccgtctcagccgcgctcgccaagaagcagtacgcgtacatctgggtggaaaccccgtccaacccgctgctcaacatcaccgacatcgccgccaccgcggccgtggcgcacgcgcacggcaccaaagtggtcgtggacaacaccttcgcatccccggtattgcagcatccgctcgcagacggcgccgacgtggtcgtctactccaccaccaagtacatcggcggccactctgacgtggtcggcggcgcggtggtcctgaacgacaaggaaacacgcgacgcggtggccttcctgcagaacgcggccggcgcggtgccctccccgttcgactcctggcttgacatccgaggcctcaaaaccctcgacctgcgcgtcaagcagcacagccgcaacgccatgaaagtggcccagtggctcgaaacccgccccgaagtggaacgcgtatggtatccggggctcgaatcccacccgggccacgacatcgcggcacgccagatgcacggcggtttcggcggcatgatctccatccagatcgccgccggtttcgaagcggccaagaagttcgccggagccaccgaagtgttcaccctggccgaatccctgggcggcgtggaatccctgatcgagcatccgggcgccatgacccacgcctccgtggccggcaccacgctcgaagtgcccgccaacctgatccgcctgtccgtcggccttgaggacgcggacgatctgatcgctgacctggagcaggcgttccgccagatctgaattccctatttccgatagaagcatgaaacggccggcatgggcaagacccgcgccggccgtttcgctctccgcggtcaacgcacggcattgctacacttggaaaccatgacgcaagctgttgattccgccgattccgtagacccccgcgcattggaggcgctgaaccgctatttcggctacgattcgttccgtcctggacaatccggcatcgtctcggccatcctcaccggacacgacgtgcttggcgtcatgcccaccggcgccggcaaatccatctgctatcagattcccgcagcgatcctgccgggcgtcgccatcgtcatctcgccgctgatctcactcatgcgcgaccaggtcgacgccctgaacgacgtgggccttccggccgcgttcatcaacaccactcagacgccggacgaacaggatctcgtcttcgcgcaggcgctctccggccagatcaaactgctgtacgtggcgccggaacgtttggaaaccgaacgattccgcaacttcgccgtccgtgtgccgatctcgctcgtcgccgtcgacgaagcgcactgcgtctcccaatgggggcaggacttccgttcctcatatcttggcatcggcgaattcatcgccggactgcccacacgtccaacggtcgccgcgttcaccgccaccgccaccgaacgcgtgcgccgcgacatcgtttcgattctgggcctgcacacaccgtccatcaccgtcaccggtttcgaccggccgaacctgtatttcgacgtcatcagcatgccacgcaaagacaaagcatcctgggtggcgtcctacatcgccagccatccggacgaatccggcatcgtctactgcgccacgcgcaaggaaacggaagcgctcgccgaatcgcttaacagcgccgtcgccgaattgcgtgccgcagggggtgcggatgtgtcggatatcggcaccatcgccgtcgcctaccatggcggtatgagcgccgacgcacgagagaaggcgcaacgcgatttcgtcaccgaccgtgtgcccgtggtcgtggccaccaacgcgttcggcatgggcatcgacaaatccaacgtgcggttcgtcatccaccacaacatgcccgaatccatcgaagcgtactaccaggaggcgggtcgcgccggacgagacggcgaaccaagccgctgcacgctgttgtggaacgaatcggacatcgtcacccgccgccggctgctcgattcggattacgaaaacgaacgattgactcccgaagagcaggaggccgtacgcgcgtcgaaacgccggctgctcgacgcgatggtcggctactgccgtaccacggactgcctgcacgcgtacatgacccggtatttcggcgaaaccgcgggcgcggcggcgaaaacggacggcaaatgcgtgggcggttgcgccaactgcgagcacacattcgaaaccatcgacgtcaccgacatcgcccgagccatcagccgttgcgtgcacgatgtgaaccagcatgtcggcagcggcaaaatcgtcaaggtgctgcgcggctcgaaggcacaggatctaagctatctcaaccccgaaagcctgccgtcgttcggcatgctcgacgaagtgccggaagcgcgcatccgcgacgtgctgagccagatggccaccgacggcttcctgacgatcgcggaaggacgcctgccgatcgtcggcttcggaccccgtgcggcggaaacggtcgcacccgaattccattacgacatcaagaagatcaaacgtgctgacgcccgtgcgcgtcgaacgcccgacgtgtccactcccgctgtcggatcgtacgtgccggatgacggcgacgaggcgctattccagaagctgcgtgcgctgcgactggacatcgcgcgcgaacttggcaaaccgccgtacatcgtgttctccgacaagacgttgcgtgacatggtacgggtcaagccgattactgacgaccagttccttgccgtcaacggtgtgggggaaagcaagctcaaacagtacggcgaacggttcctggccgcgattcgggaggattccggcgacgaggcttgaaccggccataaccgacacgcatggcacgacggttgacgttgagcccgcgaaccgtgaatagtggaatgtgaacacaacaacgaaaggacagaacatggcggaagacaagccggtggtggaaagcttccaattggaccacaccaaagtaaaggcgccgtatgtgcgctacatcgatacggaaaccggcctccacggcgacgtgatctcgaactacgacctgcgattggtgcagccgaacgagaacgccattccgaccggcgggctgcacaccatcgaacacaccatcgcggtgctgctgcgcgaacgcatccccggttacatcgactgctcgccgttcgggtgccgcacaggcttccacctgctgacgtggggcgagcattccaccgaggatgtggctcgcgcattgaaggaatcgttggaattcatcgcctacgaggccacatgggacgacgtgccggcaaccaccatcgaaagttgcggcaactaccgcgaccacagcctgttcaccgccaaggaatggtgcaaggacatcctcgccaagggcatcagctccgacccgttcgaacgccgccttgtgtgagcgttaccatgcctgtgcggtgggcgtggtagtttggacggctggaatgcttgagagaggtacacagtcgaattgaggtgaaagggttgagcgaaaccacttccgaacgtcggttccgtcgtgccaccatggatgatctgcctgtcatgctgaaaatctaccagcatgcgcgtgagcttatggcggccaacgggaatcccacgcaatggggaaacacgttcccacgtgaggaagtgatccttgacgacattcgccagcagcgcaccatgctgctggtggacgaggctgacggcaaggagcgtgtgctcgcccagttcgccctgtgcacgggcgaggatcccacctacgcgcatatcgacggcgcctggctggacgacgactcgtatgtgaccatccaccgcatcgcctcgtcgggaatcgtcaaaggcgcggccaaggactgcatcaactggtgcatcgaacattacggcaacgtgcgcgccgacacgcatccgaacaacaaggccatgcagcacgtgctcgaatcgaacggattcgcccgctgcggcctgatccaactgcttgaccgccccaccgataccacgcgtatcgcctaccagcgtcacgaatggtgattgcgcatacatagaaacgtagaaaaaaggacgtctcccgtaaaactgcgggagacgtccttttccatatgaagggatgattagaacagtcccggctcgttaagctgagaatgcttgcggctgtacgtgaaatacacgaccagtccaagcgcgaaccacacggcgaaacgcacccacgtctcccaattcaaaccgaagatcagaatcaggcagaagatgatggcgcagattggcgtgaacggcacgcccggcgcacggaagccacgatgcgcgtccggctgggtcttgcgcatccacaggatgccggccgacacgatgatgaacgcggacagcgtaccgatgttcaccagctcgaacagcacgttgatgttgatgaaaccgccggcgatggccgtcagaatgccgaagaaccacgtgcccttgaacggtgtgcggtacttcggatgcacttcgccgaagaacttcgggaacagtccgtcgcggctcatcgcatagcagatgcgggactggccgtacagctgcaccagcatgacggtggtcatgccgatcaacgcgccgaggttcacgatgaacgccagccagttgaggccggtctcgagaatcacgcccgccaccggagcgtcgatgaacttcgcgaactccttgtacggcaccacgccggtcatgatgagcgtcatgatgatgtacagcacggtggacacggccagcgagatcaggatgccgcgcggcagcgtcttgttcggattgatggtctcctcggcggaggaggagacggcgtcgaagccgatgaagctgaagaacacaatcgacgcggccggcacgatgccgtacggctgcgtcgaacccggctggaacgtgtagatgccatacggggagaacggtttccagttggcgggattgatgtaccagacggtgcacacgatgaacagcacgatgatggccagcttgatcatcaccatgatgtcgttggtcttcttcgtctggttgatgccgatggacagcacccacgtgatgataagcacgatcacgaagcccggcagattgaaatacgtggtgactcccggcgtggtgccgtacgcggcggtcagttcgaccggcagatgcaggccgaagccttccaacagcttgttgaaatagcccgaccagccggcggacacggtcgccgcctgcaacgcgtattccaaaatcaaatcccaaccgatcacgaaggcgatcaactcgccgaacgccagatacgcgtacgaataggcggagccggaaaccggtgccatcgcggcgaactccgcatagcacaggcccgcaaaaccgcagcagacggcggcgagcaggaaggacacgcacaatgccggtcccgcggtgagcgcgcccttgccggtgagcacgaagatgccggtgccgatgatggcgccgatgcccagcatggtcaggtcgaaggttttcagtgttcgcttcagcggagtcgattcggagacaagttggtccaccgacttcttgcgaaatagatccatggtcgtcagattccctgtgattgtttcaaaaatgggctggaccggacggatttccgggactctggcacgccttaacgccagaaatcagaaaggccgcggcgatatgcgcaacagccttgtgtatggaaagtgtaaaaaacactgccggacaaaatcgtgaaaacatcgtgaatcgtctcaccatatgtccctgatgttccatacctgtcacatagcggcgcgacaatgggagccatgactttgagcgcaacacgtgaatgggatttctcctccgaacaaggcaaagcgaactacaaggccgcccagcggcggtatccggcgcaggccatcgtcgacctcgccgcactgcgcgacaacatgcgccatctggtgagtgtcgtcggcggtccgcattccggcaccgccgtcatgggcatcgtcaaagccgacgcgtacggccacggtctggttccggccgcgctcgccgcgctcgcgggaggcgccacatggctcggcaccgcgcaatcgcatgaggcgctgctgctgcgcaaagccggcatcggccccgatcgctgccatattctgacgtgggtctacagcggcgccgaagtgccgttcgacgagctggtcgacaacgacatcgacatttccgtcggctcgctcgccggcatcgacggcgtcgccgcggccgcacgcaggctcggcaagacggcgcgcgtgcatgtgaaggtcgattccggcttcggccgtaacggcttcacgcccgccggtttcgacgcggcgctcgccaaactggtgccgctcgccaaggaaggcgtgctgcacatcgtcggccagtggagccatctggcggtcgccgacgcgccggacgtcccggaattcgtggcatccaccgacatgcaggtcgaaacgttcaaggacttcacccgtcgtatggaggcggccggcattccgccggaaatccgccacctcgccaacaccgcggcgacgctgtcccgtccggaaatccacttcgaactgacccgtccgggcatcggcctgtacggttacgaagccgatccggccatgggcacgccgtccacgtatagcctgaagcccgccatgaccctgcaggcgcagctcggcaccgtcaaggatgtggaggccggacatggcatttcctacggccgcacgtatctgaccccgtccgacacctccaccgcgatcgtgccgctcggctatgcggacggcatccaccgctccgcctccggattcgacatggaaggcgccaagcatgtgaccaagcccggcggcccggtgcgcgtgatgacctcggaaggcccgcgcctgtaccgtgtgtccggccgcgtgtgcatggaccagttcatcctcgacctgcacggttccgccgccgaactcggcatccacgaaggcgacaatgtggaactgttcggtccaggccgcggcgaggattacgccgaaccgaccgcggacgattggggtcatgccgccgacaccatcagctacgagatcttcacctgcctgcgcaaccgcattccgcgcctgtacgagcatgccacggacgtattgtccgccgaggacctcgccaagctcgacccggcaagcatcctgtaatcccgtaaaaagcggcggcagccgccgcacccataggaaggcggtgcatcatgacgagcgaaggatacagcgcgttcgacgaggagcgttgggctccggaaccacccaaatccagctcccgcaccgccttccaacgcgaccgcgcccgactcatccactcgtccgcattgcgcaggctcggcgcgaaaacgcagattctggtagccggcacggacgatttcgcacgtacacggcttacacacacgttggaggtcgcgcaaatcggtcgacagatcggcacttcgctcggttgcgatcccgacgtggtcgactgcgcctgccttgcgcacgacctcggccacccgccgttcggccataatggggaacgtgcgcttgccgaaatcgccggcaatatcggtggtttcgaaggcaatgcgcaaaccttgcgattattgacgcgcctcgaaccgaaaatactgtttcccgacggacgttccgcaggcgtgaatctgacgcgtgccgcgctcgatgcggccgtcaaatacccgtggacgcttgccgaagccgccgcgcatccgaaaggggagcgcagcgcgaaattctgcgtctatccggatgatacggacgtgttcgcctggctcaaacaacacgcgcccgacaccacccgccgtcccgtcgaatgccaggtgatggacctgtccgatgacatcgcctacagcgtgcatgatgtggaggacgccatcgccaccggcgcgttcaatccgggcgtgctgcatgaaagcggcgtgatcgacgcggtcgtcgaggacgcgcgcgcctggtacggaccgcaatgggacacagacaagctggtggccgcgttcgcacgcatgcaccggcgcgacacgttcccccggctatttcgacggttcgcgacgcgcgctcgccgcattgaagaacatgaccagcaatctgatcggccgattcgccggttccgtggaacaagccacgcgggacacgtacggcaacgagccgctgacccgatacaacggcgatctggtgattcccgaggaaaccagttacgaaatcgtggtgctgaaaggcatcgccgtgcatttcgtcatggcgcccggcgaacgcgagccgatgcacggcgaggaacagcggatcgtcggcgatctggtggacgtgttcatggcggacaatcccaaaccgtccagcgcgttggagaacgtgttcctcgacgattggcgcgaggccggcagcgacggcgaacgcctgcgcgtggccatagaccaggtggcgagcctgaccgacacgtccgccctgaccctccactcccttctctgctgaacggggctggtaggctggaccgtatgccgggaatgatcaagaaggaagacatagaaaaggtccgcgccaccgccgacctgtatgacatcgtatccgcgaccgtcacgctcaaaccctcgggaaccggcacatacgtaggcctgtgccccttccatgacgagaaaacgccaagtttttccgtacgtcccgcgcttggcgtgtggcattgcttcggctgcggtctcggcggtgacgtgttcggctacgtcgaacatcaggagaacatcgatttccgcgacgcggtggagctgctcgccgacaaataccatatcgaactgcattacgacaaggccgacaacgtgcccgcgcacaccggttcgaaacgcgcacgcctactcgaagccaacgaggcggcgcaggaatacttcgtctcccagctgatgaccaaggaggcgctcgccgcgcgcaagctgttggacggtcgcaacttcagccaggccgactgccagcggttcggctgcggatatgccccccaaggatgggataacctggtgcggcaccttgccggcaaaggcttcacccagcaggagatgctcgacgcgggactcgcccgtcagggccagcgtggcgtatacgactatttccgtggccgcgtgacatggccgattcgtgattcgaccggtcgtacgcttggcttcggcgcgcgcaagctgtacgaggatgacacgatcaatgcgaaatacatcaacacgcccgacacgcagctgtaccgcaaaacacaggtgctgtacggcatcgaccttgccaaatcggcgattgtgaagaaacgccaggcggtgatcgtcgaaggctataccgatgtgatggccatgcatctggccggcatcgacacggcggtcgccacgtgcggcaccgcattcggcgccgagcatgcgaagatcatccgccgattgatcgcggacgattcgttgggcgccgtgcagctggttggccccctgaaggtggaggggcaggcgttgagctcgcgtgtcgtgttcacattcgacggcgatgcggctgggcagaaggccgcgatccacgcgttcggtttggacgccgcgttctcgacgcaggcgttcgtcgcggtcgccgaagacaacctcgacccgtgcgatctgcgcatcaaacgcggcaacgaggcggtgcgcgcgctgatcgccaatgcgcggccgctgtacgatttcgtgatcgattcggcaatcgaccgtttcgacaccacgtacgcgacaggtcagatgggcgcggtcaaggcggtcgccccgctgatcgcgcaaatccgagaccgttcgctgctcgacctgtactcacgcaaggcggtacgtcgcatcggcgtcgatctggacatcatgcaacgcgaagtggcgtaccagcgtcgcaaactgaacatgcgtgacgaggacgcgtacgcgccgaaacgtcgattccaaaacaatgcggggccgtcggctgaaccagcatatgcggaacgtggcgcgaatccgtatgcgaatcccgccgcacgcaaggcgttggagcatcgcgacgcggccgagcaaagctactatcgcatcgacgacgccgtgttcatctgcgaacagcagttcatggccacgctgatccaggtgccgttggccgtcgatccgacgatgttcgccagcctgaccttgtcgagtttcatgacgccggtgttccgcacgctgttccaagcggtcgccgcggcgggcgggcttccaggggaagacgtgccgcagggactgtggatgcacaatctgacgaaggcgggcggtccgatgcttgaatcggtcatcaacgagctggccgtcatgccgctgccattgccgccgagcgaagcggacgcgaaccgcaatacaggcgagtcgcaggaacaatcggcgcaattgcgcaagccgacgcaggaggagcggcggtacgcgtccgaactgattgtcagactgcttgataccggcatcatgcgcaaaatcggcgcggcccagcgccgcatggcgcaactgccggacggtgcagagaaaatcgaactgctcggacagatcaccaaactggaaacgctgcgcaaggacctgcagtcgcgtgttttcggcaacaacgttgcgtgacacgcccatatggtgaatcgaaggcgaacggaagatgatttttagacaaaatcttggcgcacgcggggttaatttgtgaagatttgcgggccttgttttcggtttcgccggtttgcaaaagcatgcggcagtaagcaatagtggatgaaaatcgttggaatggtcggaaaagcagcacgccgagggttcgtgctagtcgcatttttgggtaaagtggtctaggcgtttgcatgaaaatcgcttgggttttgcaaggtgtgcaaggcggttgcaaacgggattgacggaggaatgcatgcggcgattggtcgtcaaggtcctgaagaacgagaccattctcgtagtcgcttccatactcgcactcatatcgtgcttcatcgtgccgccagacaaggaatacgccggctacatccacgccagcaccatctcgcagctgatctgtctgatgcttgtggtgtgcggcttccagcgcatcggcgtgttccgcatcatcggctcgcgcctgctgcatcacgtcaaaaccgcgcgtggcctggtgctcacgttgatcgcattgccgtttttctccggcatgctcatcaccaatgatgtggcgttggtcaccttcgtgccgttcgcaatcgcggtgttgacgatggcgcacatggaagagcatgcggtgcttgtcggcacgctgatgaccatcggcgcgaacgtgggcagcatgctcaccccgatcggcaacgcgcacaacctgtatctgaaagcgttgacgggcatgccgacgtccgagatgatcggcatcatggccccgtattccgctaccgcagccgttctgctgataatcatcacctgcgtgattttcggcagcaaaccggtttccgaattttccgcgatcgatagttccggcatcgaacagaacgtactcgccccgcattccgaccggccgcagcctgacgagattcgcgtgaccggctacggtgccggttatggcggctggcgtacgattgtgtattcggtgctgttcgtggtctgcttgctggcggtgagcgatttcattccgctgtggttgatgtgcgtcatcgtgttcgtggcgttcctgctatgcgaccgccgcgtgttccgcaacgtcgattggggactgccgctcacgttctgcatgttcttcatcttcatcggcaacatgaaacgcgtgccggaattctacgagctggccgcctcgctggtgggcgcgcatccgctggaagtggccgtggtgtccagccagttcatctccaacgtgccgaccacgctgctgctgtccggcttctgcgaccagtggcgtgaactgatcatcggcaccaacctgggcggcttgggcacgctgatcgcgtccatggcgtcgctgatcggctacaagaacgtgacgcgcgcctacccggacaagaaaggccgttatctggccgtctacaccgcggtgaacgtgctgttcgtcatcgtgctcgtcggcctgagctggattatcgagtagcgtttggccgtcgaccggtttccctgaccgctaatctcaaggtcgccggttcgcaccttttgctgggattgcatgaaaacccttggaatcattggatttcaagggtttattgttacgtcggctgatggtctggtgctgtgataatctgtgccgggaagcgtgtgccgagaaacgtaggaaggctgaacatgctgcaaggattgctgggaattttctccggactgatcacgccggtgcagaccgcggtgaacacgcggctcggccgttccatcggctcgccgttgcgcgcctcgctggtgtcgttcagcatcggcctcattgcgatgctgactttgacgctgctgcttggcccgtatccgctgattcccgccaccgcggcgaacggcccatggtggatgtggttcgcgggcgtgttcggtgtcactttcctgaccggcaatgtgctgctgctgccgaaactgggcagtctcaaaaccgtgatcatgccagtcaccgggcagatcgtcatgggcctgctgatcgacactttcggctggttcggcaccaccgcgcagccgatttccccgctgcgcatcgcaggcgcggcgatcacgctggtcggcttcctgcttgccgtcgccggaccgaatctgcgattgaggcctgccatcgatcgtccggctggcggttcggaaaattccggcgattccgaaaaatccgaaactgacggaaaagccgtacatgtgccaggttccgcgaccgtgctgtggagttgcgcaggcatcgcgttcggcatgtgttcggccgtgcagacggcgttgttgggcaagctgggcgtcgcgttgggatcgccggtgaaggcatcactcgcctcgttcgtggtcggtctgatctcgcttgcgatcgtcgtcgcattcgtcgaccgcacctacagcctcggcgacgcgctgaagaaaggcaatccgtggtggatgtgggtaggcggattgctgggtgcgacgctggtgatgtgcaacgcgtacctgtccgcgcatatcggcaccggcatgacggtgatgctggtattgctcggtcaggtcggcggaggattgctggtcgaccgtttcggcctgcttggcgtgccacgcaagcccgtggccggcatccaatacgtcggcgtgctcgtagccattgtcggcattgtgctcaaggcgatgtgattgccgtgtcgagttggcaaccgtgtgcgaactgactatactgtgtttagtttggccctgtagctcagctggatagagcatgtgacttctaatctcaaggtcgccggttcgagcccggccggggtcaccatcaagccctcgcgtcgtttcatgcggtgcgggggctttcctgtccattgaacggcaagccattggcttgcgaagataggggagaccatgaagcgaatcgtcgcgggcattctggcgcatgtggacgcgggcaagaccacgttgtcggaggcgctgctgtacgctaccggccaagtacgcaaactcggccgcgtcgaccacggcgacgccttcctcgacacggacgccatggaacggcagcgcggcatcaccatcttcaccgagccggccgtcatcgccacgcccgacctcaccatcaccctgctcgatactcctggccacgtcgacttctccgccgaaacggaacgtacgctcgccgtgctcgactacgccatcctcgtcatctccggcgcggacggcatccaaggccataccgaaacgttgtggcgactgctcaatcgctatcaggtgcccacattcgtcttcgtcaacaaaatggacgcgcctggcgccgacaaaacgcaactgctcgcccaactcaagaaacgcttctcggacggctgcgtcgacttcaccgagccgattgacggcgaacgcatggaggagatcgccatgcaaaacgaaacggccatggacgcgtatctcgacaccgaaaccgtgccggacgaaaccattcgcgccatgatcgcccgccgtgagctgttcccctgctatttcggatcagcgctgaaaatggacggtatagaacagttcgtcgcaggtttcgaacggttcgcgcaagagccgcaatacaatggcgaattcggcgcacgcatatataaggtgtctcatgacgcgcaaggcaaccgtctgacctggctcaaggtgaccggcggcgaactgaaggccaagatgatgctaagcggcaccgcgcacgccggcgacgcggatgcggttgccgaagacggccaatggcatgagaaagccgaccaggtgcgcgtctattccggcgcgaaatccaccaccgtcgacacggtccccgcaggcaccatctgcgccgtcacgggtctgacgcagacattccccggcgaaggcctcggcatggagcgggacgccggcagtccggtcctccagccggtgctcacgtacacgctggaaccgggggagtgcgacattcacaaatgtctcgtcgccctacgcgaactggaggacgaggatccgctgctgcacgtcgtctggcagtctcgcctagaggaagtgcacctgcagttgatgggcgcggtgcagctggagatcatccagcagatcatgcacgaccgtttcggcctggacgtcacgttcggaccgggcagcatcctgtacaaggagacgatcgccgctccgatcgaaggcatcggccatttcgagccgttgcgacactacgccgaaacgcatgtgctgctcgaaccgctgccgcagggctcgggcatggcatacgccaccgtgtgcagcgaggacgtgctcgaccgcaactggcagcgcctcatcatgcagcatttccaggaacgcgagcatctgggcgtgctcaccggctcgccgatcaccgatatgagaatcacgctgctgacgggccgtgcgcatctgaagcacacggaaggcggcgatttccgccaagccacctaccgtgcgatacgccagggcctgatggaagcgaagaagaagggcgattgccgtctgcttgaaccttggtacggcttccgtctggaagtgccgcaggacatggtcggacatgcgatggccgacatccagcgcatgtcgggcacgttcgacacgcctaccggcgacggcgaatatatggtgttgaacggcacggcgccggtatccgaaatgcgtgactatgcgatggacgtgaacgcgtacacgcacggccgtggccatttaagctgcgtgttcgccggctaccagccgtgccacaatgccgacgaggtgatcgagaacatggcttacgatccggaatccgacctggagaacacgccggattcggtgttctgcgcgcatggcgccggctatccggtcaaatggtacaaggtgcccgaattcatgcatctcgactacgcgtgggatggcatgcgcgaatagaaccgaaagacagacgggtgggaagcgccgattgcttcccacccgaggcctcttgtcggataccgacaaacggataaacgaaaagccccaccgaatcggtgaggcttcatgctggagcggacaacgggactcggacccgcggtctcaaccttggcaaggttgcgctttaccaactaagctatgtccgcaaaggattcctgccgtgagaagcaggcatccagtgggtgatataggaatcgaacctatgaccccttccgtgtgaaggaagtgcgctagccgctgcgccaatcacccgtgggatgtctccaccggtttcccggcttcgtcatccgcttcgcgtgggcgatacaagattcgaacttgtgaccccttccgtgtcagggaagtgcgctacctctgcgccaaccgcccgaagcgagtgctaacttacgtggattctcggcggaatgcaaatcgtcggcgtgtcgcgatgttcacgtgaagttcgccggccgttcttcacgcggtgggttcaacctgcggaaactccaaggtttccgtgtcgtggtccacgccgctcatggcggtcgtatccgcatcattggttcgctccgcggtcttggcggagccgttcgcagtagggtttcccgtgccgacggcgtgcgtcagcgcgagcctcatctgatgccagaccacgttgccatgcgtcgactcggacagtccttcgtccacgaatcccagccgtgcgtaaaaatcgaccagccgttccttgcaggtgagcacgaggcccttgcgtccggcctgtgccgtgtcgagaatcacctggcgcagcagatagctggcgcagccgcgatgctggtagacgggtgccacatccacgccgaaaatcatctgccaatcgccatgctcgtcatgcatatcggcgtcgtcatacatggcatcggcaagattcggctcgtttgtggccatgccatcgacgaaaccaaccaacgtgccgtcctctacacgcgaggggaacggggtatcgtcgtcatcggtgttgaccaacagccagaaatggtccggataagcggccacgcgtgcggtaaggctttcgttgcttgcggcctccgcaggtgggaagcaggcggcctccacagcctcgatcgcgtccagatcctccatcgttgcatgtcgaatgagcatgtgcatactctctcgcaaggcatacccaatcttcacatttcgatatgcgccgacggcgcaatccgccaacatgccatactgtagaagaaccttggagggatcgcaggacgactgtttcgcgatacctgataagtccttatacgaaaaaccgataacgaaactggctcgtagtggcgaataaagcgatagtatgagccgcgttcgccggaacaaatacgaaaaatccgttgagaagagaaggaggcgcgcgtgttcgactggacgttcatctcgcactacgcgccgttcttcgtcagcggtgccgaaatgacgctgttcatttccgtcttcggcatcatcctggcgatcgtggtcggcttggtctgcgccggcatcgagatcgcgcgcatccccgtcctgcggcaggtcgtgcgcgtctacatcgagctgagccgtaacacgccgttgctggtgcagctatacttcctgtattttggcctgccgaaactcggactcgtctggtccgcggaactgtgcgccatcgtcggactcggcttcctcggcggctcctatatggccgaagcgatgcgcggcggcctggagaccattccggaagtgcagcgcgaatccgcatacgtgctgggcttgagcaaatggcagacattaagccgcgtggtcattccacaggccatcagcacctccattccaggcgtcgtggccaatgtgatcttcctcatcaaggaatcgtccgtggtgtccgccatcgcgctcgccgacgtgatgtacatggccaaggacctgatcggcatgtactacgacacctatgagtcgctgttcctgctgattgtggcgtatctggtgattctgctgccgatctcgctgttcggcacttggctggaacggaggttcgactatgagcggcgctgagattctgctcgagccgggcgtgattccgcgcctgctacagggcctgtgggtcacggtgtggatcgccggtgtgtccgtggcgttgtccgtgcccgtcggcctgattgtcggctggctgatgacgatgaaaaatcccgttgtgcgagtgctgaccaggatttatctggatttcatccgcatcatgccacagctggcgctgctgttcatcgccttctacggtttcgcgcaggcatggaattggaatttggatgcgaccggcgcatgcgtgttcgtcttcgttttgtggggcggcgctgaactgggcgatctggtgcgtggtgcgctcgaatcgattccgaaggcgcagtacgagtcgtcgtacgttttgggattgagcggctggcagacgttcacgaaagtgattctgccgcaggcgttgcgccggctgctgccggcttccgtgaaccttgccacgcgcatcgtgaagaccacgtcattggccgtgctgctcggcgtggtggaagtcatcaaggtgggccagcagatcatcgacgcgaaccgtttccagtatccgacgggcactttgtggatttacggaacgattttcttcatgtacttcatcgtgtgctggccgctgtccatcgtggcccgcaggttggaaaagaggtggaagcatgactgagcaggctgaacaggttacgcagaccgcgcaaaacagcgggaaatcgcagacaagccttgaaatcaggcatctggtcaagcggtacgccaatgccgacaagccagtgctggacgacatctccttcgacgtgccccatggcaaggtgttcgtcatcgtcggcccgtccggatcgggcaagtcgacgttgctgcgcaccatcgcaggtcttgagccgattcagggcggcaccatcgcgctgaacggcgagattatcgaaaccggcaagccgggcaccgaatcggccggccgcagcaagcgcggcagcgagctgcgcacgcgtgtcggcatggtgttccaaagctacgacctgttccccaacaaaactgtgctcggcaacatcacgctcgctccgacgctcgtgcagaagcgcgacaaggcggaggtcgagaaggaagccatcgctctgctggaacgcgtcggactcgccgaccgcaaggatgcctggccgcatgagctgtccggaggccaacgccagcgcgtggccatctgccgtgcgctgatcctgcatccggaagtgctgctgttcgacgaggtcaccgccgcgcttgatccggaaatggtgcgcgaggtgcttgacgtgatgctggaactcgccgattccggccagaccatgctcatcgtgacgcacgagatgcaattcgcacgagccatcgccgaccaggtgatcatgctggaggacggcggcatcgttgaacaatccgacgacgccgaagcgttcttcaccaatccgaaaaccgagcgtgccaagcgtttcttgcacacgttcgaattcgacaggcatcgcaggccggcggaaacgccgacggaaccgacgggaacttccgccgagtaatcgcaagttttgatagcagtcatccgtacaagagaggagtaaccatgaccgcatcaatcatcaacaagacaatcaagagcatcgtggccgcatcggccgcgttgatcatggccgcctccgtggctgcctgcggtcccaacgccgccaccccgagcgaggagaacaacgcctccaacggcggcgtcaccacgtccaaggtgaccgcccgctccctggacgagatcaagaagtccggcgtgctcaaagtggccgtcttctccgacaaggccccgttcggctacatcgacaaggacggcaagaacgccggctacgacatcgtcttcgccgagcgtctcgccaaagatctgggcgtgaaggtcaagtacacgtccgtcgatccggccgcccgtgtggatgtgctcacgtccaacaaggtggacatcacgctggccaacttcaccgtcaccgacgagcgcaaggagaaggtcgacttcgccaagccgtacatgaaggtcgcgctcggcgtggtctccccggagaacgccgaaatcaccgacgtgagccagctcaagggcaagacgctgatcatcgccaagggcaccaccgccgaaagctatttcgagaagaacgaacccgacgtcaagctgcagaagtacgaccagtacgccgacgcctacaacgcgctgctcgacggccgtggcgacgccttctccaccgacaacaccgaggtgctggcctgggccaagaccaacaagggcttcaaggtgggcatcaccaagctcggtgacgaagacaccatcgcgccggccgtgcagaagggcaacaaggagctgctcaactggatcaacgacgagatcgtgaagctcggcaaggagaacttcttccacaaggattacgaggagactttgaagccggtgtacggctccgacgtcaacccggatgacattgtggtcgaaggcggccagctttgattcttacctgacctgacggcggcctgccgtccgtcaatcctgtttccaagccttccgtggcacacgccgcggaaggttttttcatgccgattccgggccggttatgtcacatccttcgaaaccgtttacagtccacgcgggtgtatgtttccggaggtttcgtaccatccgataacccctcataaataaacgctatggcgattcgcacgttgtataagcaacgtcgataatctccggcgcgtggcgctttccaagacacggttaagtaggaaccagcgatcgcgtgaacggcacgcggcagggaaaccacaccgagggggtgcgcaccatgaccagattcaacactcagctcgtccacggactgccggtcaacgacaacaacaccggagccgtgaacccgccgatctacaactcgtccacctatgctttcgaatcggtcgggaccatgccccgctgggattatgcccgcagtggcaatccgacgcgcgagttcctggagaagcagatcgcgcagctggagcatggcacgcgcggtttcgcgttcggttccggcctggccgccatccacgcggtgctgtcgatcttccaacccggcgaccgtatcatcgtcggcaagaacatctacggcggcacctactcgctgttccacgagtatttcgaacgctggggcgtcatcgtagaggaagtgggcaccaccgattacaaggcgctcgatgcggcggtgtccggcgaatccgccaagggcaatgcgcatggatgtccggccaaggccgtgtacttcgaagtgctcaccaacccgcttctgcaagtcaacaacgtgacggccattgccggaatcgcccaccgtcatggcgcgatcgccatcgtcgacaacacattcgtcaccccgtatctgcagcagccgctcgaccaaggcgccgacatcgtcatccattccgccaccaagtatctggccggccattccgaagtcaacgccggcctcgtggtggtcaaggacgatgagctgggcaagcgcgtctacttcgcgcagaaccgtttgggtggcgtgctcgcgccgaacgaatgcgattcggtgcgtcgcggcatccagacgcttgccttgcgcatggaccgtcagcaggagaacgcgcgtgcgatttccagctatctgctgctgcacccgttggtcaagtccgtgcattatccgggactgcccggtcacgaatacgagctggcctccaacggtctcaagggcggtggtgccgtactgagcttcgaagtggtgccgggcgtcgaccctgcggacgtgctcgacaacctgcatatcttccgtctggcggtttcgctcggcgcggtggaatcgcttgccgaactgccgtgccgcatgacgcatttcgaactgccgcgcgaggagcgtctgaaggtcggcatcaccgacgaactggtgcgtctcgcagtcggcatcgaagacaagcaggacctcattgaggatctcggccaagccttcgacatcgcgtacgagaactatctcaagcgtcacgccggcgagagtctgttcaccttcgcgcaacacgtatatgcctgaaagttttgctatcggtagggatttgaatattaactggcacgctatctcacgaaccggacaggggaaagcgcccctctgtccggctcgtgggcgtatgtgggtcagctcctggacaggcgatggttggttcgtggacggcccttgcccagctcgcggacattgtctgcatacgattgcattctttggtaaatttttactcgggttcggcaatggttgcagaacctacgaaaggtcatgcgacaagacctttaaagagaaaccaaagaagggagtaatgccatgccgttccttgtagcgctccttgtcattgcgctgatcatcgcgttcctgttcctgtccacgttgttcatcgtgccgcagcagcaggcatacatcatcgaacgtttcggcaagttcaacaaggtccagttcgcgggcatccacatccgtatcccgttcgtggaccgtatcgccatgaaaaccaacatgcgcgtcaaccagctcaacgtgcagctggaaaccaaaaccctcgacaacgtgttcgtcacggtcgtcgcctccacccagttccgtgtgaacccggaaaacgtggccaccgcctactacgagctgcgcgacccggccgggcagctgcgctcctacatggaggatgccctgcgttccgccattccggcgttgagcctcgatgacgccttcgcccgcaaggacgacgtggccttcgacgtgcagaagaccgtcggcaacgaaatgtcccgtttcggtttcaccgttgtcaaaacgctgatcaccgccatcgacccgagcccgcaggtcaagaacgccatggactccatcaacgccgcccagcgtgagaaggaagccacccgcaaccgcgccgaagcccagcgcatccagatcgagacccaggccgctgccgaggcggagaagacccgtcttcaaggcgagggccaggccaactaccgtcgcgagatcgccaacggtatcgtcgaccagatcaagagcttgcaggctgtcggcatgaacatcggcgatgtgaacaatgtggtgctgtttaaccagtacctcgacgtgctgcgctccttgagcgaatccaacaacgccaagaccgtcgtgctgcccgcatccacccctggcggctaccaggacatgtacagccagatcacgcaggccatggtgacagccaacgaaaccgtcggccagcactcgactgtgccgacaccgccgcacgtcgctccgacgacgccgcgtatctgacacatgtttggtgatgcctgcagtcgtcgggcatacgttgattggccgcaggcatgtgaatcgcaggaaagcgaaaacgaaaaaaagaatcccttctttcgtcggggagccacgtagatgtgacggagagtgcggaaacgatgaaagaagggattcgtgttgcaagtgcgccgtcgtaccacgacacacgtctgttatacggaaggcttcgctcggacgtcaggccagagtgacaagcttcccgggagaaggtgcgttgagacattcagcagcatgcgcttccatggaacggagctggtcttgcagatccatgactttcttttccaaccatgcgatggtcatggattgggagatgacgagcaggtcgcgctggtcagctgcggcttcgttggcaaacgattgtgcttcggtcatgatttgcggatctgctttccaccgtgcgatggcgcgttcgatacgtttactgccaacgattttcgggttaagacctgcgctggcgaagatgctggtcggcccgttgccccgtaagtattgcgccatgcaacgcacttggaattcccttgaataggtgatacggtccattgatgccctttctaccgcgggcaaggtgttgagatagtagacttccgcctgggtgaaatgacgtttcatattgttcccctttggtgtgaaaccgtttgacattccacaatctgaagattattgctgatggtttcattttatttttgacattttggtcgaaaaggtcatttggcacgaaacaagggtttctggcacgaaacaacatgttccatatcgttcaggcggggtttcttgaacggttttcgagtttcaggcacgcgcggaccgtggcttcagggtgttcccttaagggtggcgaagcgcggtgaaacactttagacttaggagcaattatcaacatattcccagaaaacgaggaggtgaatgtgccggtaggtatcacatccaacgttgggaaaaccggtcgcggtcccattatcgaggttaaaaacctacgcaaggaatatccagtgctcgatgagaccgtcgtagcgctggaacgtgtcaatctcgccattccgcaagggcagatttgctgtatctatggtgagtccggatccggtaaatccaccctgctcaatcagcttgccggcatggaaaaaccaactaaaggtggtgtacgtattgcaggtgtgcccatcagcaggcttgacgaacggcagctggccgaattcaggcagaagcaccttggcttcgtgttccagtcgtacaatctgctgcccaatctcaatgccatcgagaatgtggccatgccactgatgttccgaggcgtgccgaagcgtaaacgcgagatgatcgcgcgtgccatgctcaagcgggtcggccttggcaaacgcatgaaccattatccggcccagatgtctggcggtcagcagcagcgcgtcggcatcgcccgcgctttcgcggcacgtccgcaagtggtattcgccgacgagccgaccggcaatctcgattccaaaaccaaaaccgaagtgatggatatgatttgctcgttcgcacgcgatttcaaccagaccatcgtgctcgtcacacatgacgacaatatggcgcaatacgccgatcgcatcgtcacacttcttgacggccgcatcatcggcgaccggcttacgtaacattcacgacaacgcatatcgacaactatgacgacaacagaagggccttccatgggcaacaacacaagaatcgcaacactgctcaacggggcaatctcactattggcggtggtcgccatcacgttggtatgcatcgtgccgacggcgttcgccgaagatggcgccaatacttccgatgctccgggtgcgggagcggacaacagtgttgagcagattgctgggccggtgccgaacatcattatcaccaatttcacctatggcgacgggtcggtggcggtcggcagcaccttcaacctcggtttcaccttccaaaacatgggcaaagtggcggtgagcaacatggtggtcaccgtggacggcggtgagaattttgccatctccggcggtacgaacacgttctactacgatgcgctgaatgcgggagctgcgttgacgcagaccgtgccgatgcagacactggccagtgcgaaaaacggcgcgcagggcatcgacatcagcttcaaatacgagtacgtggacggtgccgcacgcagctccaacacttccgacatcaaaatttccgtacccgtttcgcagcctgatcgttttgaattgaacgatccagtggtgcccaatatcgtcaacgcaggtgaggaaactactatcaccatggattacgtgaacaagggcaagggcgacgtttccaatgtcgaggcgagcgttgaaggcgacggtatcaccgccacgcaggccaagcagtacgtcggcaatgtggcgtccggcgcgtccggctccattggattcgcattcactgcggacaagcccggcgaaaccgaggcgaaactgacggtgacgtatgagaattccgatggacagccgcagaccaaggaatttccggtgaaaatcaatgccgttgaagctcctgttccggatgattccgatacggatgttgacgtccaggatcagagcatgccggtctgggtgtggatagtggcggcggccgttgcactcgtcgtgattgtattgacggtcgtattggtggtccgtcgccgccgtaagaaggcaaagcaggtggccgatgatgacgattgggattgggagactgccgatcttggagccgataagcagggtaaatctactgccatggctgccgatgcgccgacgcaggtaatcgccacggcaggtggcacatcggccgcctccgtatccgcaacgtcatcttccactccatccgtcaaggagtaggcatgcgattttcggatatcgcacatacttgcgcgcagaatttgctgcggcgcaaatcgcgtacgattttgacggtgctcggcgtgatcgtcggctgctgctccatcgtcctgatgatttcgattggacaaggcatcagcgagcagaatgagcagatgctcaagagcatgggcaatctcaacgacattaccgtcacagctgccggcggctcgggcgcgtacgacagctctggcgtcggtatgtcgagtttgtcttcgtcggacatgacatcatcggatcagcaggccaagcttgacgatgctgcggtacagacgttccgtggcatttcaggcgtcgcagccgtgatgccacagcggtcggcgcagagcaccgtggatctcactgcgggagccggatcccgatacgtggctcaatatgcttctgtgatgggtacggatatgacccagcttgaagcatcgggatacaagctcgttcaagggcgtatgccgaggcgtgccggagaagtattgctcggcaaatacgcggcataccagtttatggataagtatcgttccgatgatgactccaggcgtatcgctcccggtgattatgagtgcgatgagaacggttgcaaggagagcgagggggagaagccgttcttcgacgtactgaccacgaaactcaatttgattaccggagccgattatcaaagccctgacgattaccgcaaaataggcagcacttcgatgagttccaccgattcaggcgacggcgatggtattgccagttcgcagaatcctgtggtttccatgcctctcaccgtggtcggtgtgttggacgctgcaaccaataattacgatgcattcagctccggtgtagtcatgtcgctggaggatatggacacattgcaggccaaaatcgacggcaaaaccaataccaccagccggaccaaaacaaactacgaccaagtggtggtgcacgctcaaaatatcaaggatgtgccgggtatcgaagcgcagatcaaaatgtctggctaccaaaccacgtccttcgaacagacccgcaaggagattgaaaagcagagtcgtggcatccagctcgcattgggaggcattggcgcggtgtcattcctggtggcggccatcggcatcgccaacaccatgattatgtccgtgtcggaacgcactcgggaaatcggcattatgaaggcgctcggctgctatgtgaatgatattcgcacgatgttcctatgtgaagcaggtgccatcggtctggtcggtggacttatcgcctgtctgatttccgccttggggtcgctgagcatcaatctgctgtcgtttggtggattcagtatggaaaacgtaggcaaagcgattatgggcggtgacgacgtgaaccgaatctccgtgattccatggtggctgtttgtcgtggccgtgttgttttcgattctggtgggcatactcgccggttttgggccagctaataaggctgtgaagattcctgcgttggacgccatcaagaacgagcaatagcgattgcgattgacaataatgcttatggtcggccatgtgctgttcagcgtgggccggcatttcgcgattgttcaacgttccctgtcgatttttgacggtgccggctagttgcgtgattaacgggccaagacgcggcgaatgcgatcagccaccgcttccacagtcagcccgtaacgttcgtcaagctcggcaaggggcacacgatcggtgaattctttcgatgcgccgaaattgagcgcatgcacagtggctgctttcggattagtggaattcgcgtagaacgcggtcactttctcaccccagccgccttccagctggccatcctccaaggtgacgaccacacgatggccgtcggcaagcacgtccagcagctcgccatccatcgcggaatactgctgcgcgtcgataagcgtcgcattgatatcgtcgtcgttttcgagcgttgccgccacctcggccgccaacggcagtgtattgcccaagccgagaatcgccacttcacgtcccggacgcacaatctggtaccgcgtgaaagggcaatcgccggtaatatcgatcgtcgtctcgtgcgtgtcggcacgttcggccgggtcgaacgccatatcggcggaacgctccatggcaagaatctgctcgccgggcatgcggatagccgtcacaccatgatcagacggccccgtggcccatgcaagcatgtccagcatctgctctccgctggtcggtgccagacaggtcacatcaggcgtgttggcgaacatcgtcatatcgaacgtgccggaatgtgtattgtccgcgccggaaatgcccgctccgaaaatcagcagcgtcgccggaacatgattcaacgccagctcctgctgcaactggtcgtaaatacgctggaagaacgtggcggaagtcgccagaaccggccggcctccagccttcgcgatgcctgcggcgaacgcggccgcatgctcctcggtaatgccggtgtccacataatgcgatccggcacgttcacggaaatcacgggtgatgccattcgaaccaggggtggcgggggagatgaccaccagtcccggctcgttttcgaaacgggactccaacgaagccatggccatctgaccgtagtatttgcgcgcgtcaagcggcttgccgagcgcgctgtccggatcctgccaatgattcgcctcgcattggccggcatgcggctgcggattggtctggttgcatccgtcggaaccatcctgcgcctcggtctcatcgctgaaacccaagcccttggtggtgtggatatgcagcacgacgggatggtcgatatccttcaagtcttcaagcgccgcgaccagcgtgtccacatcgttgccctgctccacataacggtagtcaagtccgaacgccttgaacagattcagctccgcggttccgttcgacgcgcgcagacgggcaagattgccgtacatgccaccgaaatcctcggcgatcgacatctcattgtcgttgacgacgatgatgagattaccgccctgttcggcagcgttgttcagtccttcgaaagcgatcgccgagctcaacgaaccgtcgccgatgatggcgatgacgttgccgatttcgcttgctcccgcagcggtatgttgcatatcacgtgttttggcaagaccgcaggcaagggagatggacgtgccggtatggcccagcacgaaggaatcatgctcgctttccaacggattggtgaaacccgtcacctcgccgaaccgcgactcgtccagatacgcctcggcgcgcccggtaagcatcttgtgcacgtagctctggtgggagacatcgaaaacgaaacggtcacgtggagaaccgaacacgcggtgcaacgccacggtaagctccaccacgccaagattcgaaccgatgtggccaccatgcttccggccgtaatccaacagcgtggaacgaatctccagacacagatcacgcaactgttgcgaagaaagggcatgcacatccgccggagaatgaatcgaacccagtatgccagcggtcattatgcgcaactgtccttccctgaacctgtcttctttaccgcggaaaatcctatcccactgtatgcctctgccggggtgtcggttgtgaaatacctgcaaagtcttctcaactgcggcacaatggaaacgatgaaatgaatcgaaccaccgaaaaaccgcgaaggagcgctgaccatgaaagccgtatacgtagcaggaaccgattatgacaatccgctgtcgcaactcaaggtgggggagctggacacgcccgaaaccaagccgttctggagtaccatccacgtggccgcagccagcgtgaaccaccacgacatctggagcctgcagggcgtgggactctccgccgaacagacgccgatgattctcggcaccgacgcgtcaggcgtgctcgacgaggacattcctgttcgcaaagggctgaaagccggagccgaagtggtgctctacaccttcgtcggcaccgacggcgccggcgtcatgccgggggagcggcgcaccatcctatccgaaaaatacgcgggcaccatggccgaaaccacccaagtgcccagcgccaacgtgttcgccaaacccgccaacctgaccctcgatgaggctgctgcgctcggcaccagctggctgaccgcctactcactgctgttcacatcggccaacgtgaaaccgggagacaccgtgctcgtccaaggcgcgggcggcggcgtgtccacagcggccatccaactcgcccatgcggcaggactggaagtgttcgtcacgtcacgcagcgaagagaaacgagaccgcgcgatcgccatcggagccgacgccgccttcgaaaccggcgcgcgactgccgcataaggtcgacgccgtcatcgaatcggtcggcgcggccacctggagccattccgtcaaatccgtacgccccggcggcaccatcgccatctgcggagccaccacaggagaccagcctggagccgaactgacccgcatcttcttccaggacattcgcgtgcaaggcaacaccatgggttcgcgtgacgacttcgcacgactgctcaaattcgtggaacacgccgacctgcaccccgtcatcgactccacctacgcgcttgccgacgcgcccgcggcgttccgcaaagtggtcgacggcgacgttttcggaaaggtcgtgctgcacatcgagccgagtaagtaaagtaggcggtgttctggaacacataagtctacgtaaatccttcggaggttttgatggcagacaacaagcctgaagtcgcggtgatcatgggatcggcaagcgattgggagaccatgaagcacgcatgcgagatgctcgaccagttcgaggtgccgtacatgaagcaggtgatttccgcgcaccgcaccccggaactgatgggtgagttcgcgcacaacgcccgtgccaacgggctgaaggtcatcatcgccggcgcgggcggcgcggcccacctgccgggcatggtcgcggcgcagaccacactgccggtcatcggcgtaccggtacgctcccacgcgctgtccggctgggattcgctgctgtccatcgtgcagatgccgggcggcattccggtggccaccaccgccgtcggcaactccggcgcaaccaacgccggcctgctcgcggtgagcattctgagcgccaccgacgagcgactggccaaggcgctgcaggactatcgtgactccctgaaggaaaaggtggctgaatccaatgcccagcttgtctgaggaaaccaacggccgtatcgaacgactgatgcccggcgcgaccatcggcatcatcggtggcggccagctcggccgcatgatggcgctgtccgcacgctacatgggcttccgcatcggcgtgctcgacccgacatccgactgtccggccgctcaggtcgcggatttccaagtgaccgccgaatacgacgacatcgccgccatccgcgaactggctgaaaagtccgacgtgctcacctacgagtttgagaacgtggacgccgacgccatcgaccaagtgcgttccctcgcggcggccccgcaaggcaccgatctgctgcgcgtcacgcaggaccgtgtcaacgagaagcggttcatcaacgaccatggcacgcccaccgcgccgtggaaggccgtcaacagcgtcgaggaacttgaagcggcacttgatgagatccactatccggctgtgctcaaaacccgttccggcggttacgacggccacggccagaccgtgctcaagtccgaagccgacttggagcaggtgcgcgcccgcgccgaccatgacggcagcttcccgccaagcattctggaaggcttcgtcgatttcgcgttcgaagcgagcatcctcgtcgccggcaacggcaagaattacgtgaccttcccgatcgtgcgcaacgagcatcgcaacaacatcctgcacatgaccatcgcgccggccgaagtggacgaaaccgtggccaaggaggcgcacgagctggcgttgcgactggccaaaggcttcgaactcgccggtattctggccatcgaactgttcatcaccaaagacaacaaggtcatcgtcaacgaactggccccacgtccgcacaattccggccactacaccatcgaggcctgctcgttcgatcagttcgacgcgcacattcgcggcatcgccggctggccgctcgaacagccgcagctgctcaagcccgccgtcatggtcaacgtgctcggccagcatgtggcgccgacccgtgcgctcatcgccgaccatcccgaatggaacgtgcacgactactgcaaggcggaagtgcgccacgaccgtaagatggggcacatcaccgtgctgaccgacgacaccgccaaaaccgtggccgaccttgaggccaccggctgctgggacgacttgaagaaagcctgacatcataggtaatgagtgaacatatcgtgcggcagacccgccagaaagacgccatccgcgacgcgctgaacggctgcgacgaattcatctccgcgcaggagctgcaccgcaagctggaagaccgtggcgaacatatcggactcgccacggtctaccggcagctcaacgccctggctgaagccggccgcgccgacacggtccgtctcgacgggcagcagctgttccgcctgtgcggcgatgacgggcaccatcatcacctcgtctgtacgaactgcggcaaaaccgtggaaattgaatcgccttccgaaagctggctgaaaggcatctccgacaagtacggcttcaccatcgaacggcacacgctggaggtgttcggcctgtgcgaggactgccggaaggcggacaagtagcggctgtctgccgtatttccgttggaatcgtatcgccatcggcgcaatccaatcgtaaaaatcgtaaagaaaaaacgttggacgttgtctttttcagacgcatatatgacaatagggcattgcaaacgaactaagtggggttatgcgtgaccaaagcaacatcgaaaaacgagccgattgaggagctcgacatcgctaccgtggacccgatggccaagaaagcgggcaaggagttccccggctggctctacggcgtgctattcgtgctgttcgatgcggtgggcgttgccgccctgcagatcggtgtcagcgaatccgccactcgagtccaactatcgaacaacatgtggctcaccggttggggattcgtcggcaagatgttcaccagcgccaatttcgtggcggtgctgaacctcatcctatggggcgtcctgtatgtcattctgctgatgctcaccaatcgtttctgggtggccacgccggtttttctggcagtcacgttcatcatcgccgtgattgagcatttcaaggtttcaatacgatacgaggcgattctgccaagtgatttgaactttctgaaggccgacgccggcaatctgatgagtttcatgccgtccggcgcgcaatggaccattctgatcgcggtggcggcgtttgccgcgttcgtggcgctgttcgtcttcctgaaccgcctcgacgcgcgtcacggcagactgtttcgcggctccgataagcgatcccgctccgtgaacgcgatcgcaagactgctgctgatcctgcttccaggcctgttcttcacgctgtattcgatgcaggtgagcaccgtcggctcgtgggccaaaggcttcgccaccgtcatgggggacaagccctccatgtgggactccgtatacgacgcccagcgcaacgggccgctggtggcgttcacccgtcagctcaacccgaaagtcatggtcaagccggacgactattccgaagagaccatgaagcaggtcgcggcccgctatgagaaggccgcgaagaagatcaacgcgaaacgttccgcgaacatgaccgacagcaccgtcatctacgtgctgtccgaatccttctccgacccgtcccgcgtgccgggactcaaagtcaacaaggattccataccgaacatccgcaagattaagcagaataccacgtccggcctgatgctgtcctccggatacggcggcggcaccgccaatctggaatacatgggactgtccggcctgagcatggcgaatttcgattcctccctgaccagcccataccagcagctggtgccgagcgagcattggacgccgaccatcaaccagatgtggggcgcgtccaagaactccatcggactgcacccgtacgagtcgtccatgtattcgcgcgccaccaactacaagaagttcggcttctcgcatttctacacgctgaccgggccggacgtcatctcgcatcaggacaagatcgacgattcgccgtacgtctccgacgaggccacctaccaaagcacgctggaggaagtcaggaaaaccaagtcgaaccagttcctgcaggtcatcaccatgcagaaccacatgccctaccatgactggtacaagcacaacgacttcaaagcctcctccaccacgggaaagccgttgaaggacgacgagaaggaatccatcgaaacctaccaaaagggcgcgtccctgacggatggggcgaccgccggattcctcagcgaactcgacaagctcgacaagccggtcaccgtggtcttctacggcgaccatctgccgggcatctactcgtcggcttccgctgatgacggcaactcgctggcgttacatcagacggactacttcatctggtccaacaaagcctccggcacgcaaggcaacaagatcgacaacgccgaatactcgtcgccgaacttcttcgtggcccaggcggccgagcacatggatgccaaagtttccccatacctggcgttcctcaccgaaatgcattccaagatctccgccatggaaccgccggtcgtgaacaacatccaaggctgggaccgcatccccgaaggacagaacatctatctggactccaagggcgagcccatggccgaagacgatttcgacgccgaaaccagacagctgctggccgattaccggctcatccaatacgacatcaccacggggaagaattatctgaaaaacacctcgttcatgaccctgccgtaacgaggacggcgcgccttccgcacggcactacactcgacgtacctttgtacgccttcgtgtcgtgccgcgtggaattcgcgcgcgtctgagaatacgctaaggggcttgttccaattatggaacaagccccttaaaacgtttcacggcgtcagcatgacgtcacatcatgcgttcaacgccttgaaaccgatgtcgtgacggtagaacattcccgtcgtgtcaagcttgtcgatgatgccgtagaccttgtcctgcgcggttttgatatcggccgcggaggtctccacgaaaagcacgcggccggaattcgccaccaggccatgctcgccacgcgtcacgccggcatagtagacgtgggaatcgtcgtcgaccttgatctcaggaatcgcggcacccttgaccacattggtcggatagccgtcggaagcgagcaccacgccgagagtggcattgtcctcatcccaagtgaattccggggtctcatcgttcagaatggcgttgatgccggcaccgagatcggacgtgagcttcggcagcaccacttcggtctctggatcgccgaaacgcgcgttgaattcaatgaccttcggtccgtcggcggtggcgatgaggccggcgtacagaatgccggtgaacggcgtgccctcgtcggccatggcctgaacggtcggcttgacgatggtttcgatggcggtgtcgatcacatcctgaccgatctgcggaaccgggctgtaagcgcccatgccgccggtgttcggccccttgtcgccatcgtaggcacgcttatgatcctgcgaaatcggcatcggccagaaatcggtgccgttcacaaagctcatcagagagaattcctgaccctcaaggaaatcctcgataaccaccttcgcgccggcgttgccgaagcggtggtccacgaaaatgtcctccaaagcggcgatggcggtctcctcatccatcgccacggtcacgcccttgcctgcggccaggccatcggccttgatgacgatcggcgcgccatgctcgcgcacataagcggtggaacgctccaaatcgtcgaacgtctggtacttcgcggtcggaatgtcgtgacgttccataagctgcttggcgaagtccttggaaccctcgatctgcgcggcggccttgttcgggccgaacgccttgatgccggcggccgcgaaatcgtcgacgatgccttcgataagcggcacttccggtccgacgaacacccaatcgtaaccattgttcttcacgaaatcgatgagcgccgcatgattggacgggttgagctgcgtggtgcggatgccgtcaagttccatgcccggattgcctggagccacagtgacctcgctgacgctgtcgccacgcatgagcgcgtgggcgatggcgtgttcacgcgcaccggaaccaatgaccagaaccttcatatttcctcctgttgtatcccttatggggaagagtgccaatctcaagaaataatatcgggggtgcctgttcggctacccccgtatgttcgtttactgcagttcgacgtcctcgccggtcttcttgacgatattgcccagcacatagccggcctcgccattggacttcagcagttccatggtcttatcggcatcttcggcgctgaccgccagcaccatgccgatacccatgttgaagatgttgaacatttccatatggtcgatttcgccggccttctccagcacgtcgaagatcggcagaaccggccaagagccgaggttgatatgcgccgcgagaccatcggggatcatacgcgggatgttctcgatgaagccaccgccggtgatgtgcgcgacgcccttgaccacgccggccttgaacagcggggacagcgtcttgacatagatcttggtgggggtgagcagcacgtcgccgagcttctcaccgccgagctcatccagctgggtgtcgacggtgtatccggcctgttcgaacagggccttgcgcaccagggagaagccattggaatgcacgccggtggagggaaggccgatcagcacgtcgccttcgacaatcgaggaaccatcgactatggcggacttctcggccacgcccacggcgaaaccggccaaatcgtactcgtcctcgtcgtacatgcccggcatctcggcggtctcgccgccgatcaggccgcaatcggcctgcacgcagccgtcggccacaccggatacgacctgctcaagcagggcaggatcgttcttgccgcaggcgatgtaatccaggaagaacagcggttccgcgccctgggccgcgatatcgttgacgcacatggccacgcagtcgatgccgatggtgctgtgtttgcccgccatcttggcgacgaccagcttggtgcccacgccgtcggtgccggaaatcagcaccggctccttgtaacccagggaggcgagatcgaacaggccgccgaatccgccgatgccgccgaccacgcccggacgattggtgcgcgccacatgcgacttgatgcgcttgacgacttcgtaaccggcttcgacgcttacgccggcttcttcatatgcttttggcatatcaaacctttcttgggtctcagtgttcttcttggggtgaagtggtggtgtactcgttgccttcgtacttgctcttgtacagggcgaattcgggtagtcggacacgatcctccggagtgagcgacttcaggaagtcggcttcgtaatcgtccaacgcggtcgggtaatcgccattgaagtaggccacgcacaggccgccatacggtgcgtccgcacccagaccgatggattcgaccaaaccgtcgagggaaaggaacgccagggaatcggcgccgatgtattcgcggatctcctcaacggacttcttcgcggcgatgagctctttggtggtggagatatcgatgccgtagaagcacgggtatttcagcggcggcgagctgatacgcatatgcacttcggccgcgccggcctccttgagcagctgcacgatgcgcttggacgtggtgccacgcacgatggaatcgtcgatgacgatcacacgcttgcccttgaccacgccacgaacggcggacagcttcatgcgcacgccctgctcgcgcagttcctgcgtcggctggatgaaggttcgcgccacatactggttcttgatcagacccatttcgttgggcaggccggcctcttccgcatagccggaggctgcggacaatgaggaattcggcacgccgatcaccatatcggcgtcgaccggcgactcctgcgccagacgtgcgcccatacgcttgcgggcggaatgcacgttcacgccgtagatatcggaatccgggcgggcgaagtagatgaattccatcgagcagatggccagctgcgtctgattcgtgtactgcacgatcttatagccgtggtcgtccaccaccacgatctcacccggacggatgttacgtaccaattcagcgccgacgacgtcgagcgcgcaggtttcggaagcgagcacatacgcgccgttcttcatcttgccaagggagagcggacggaaaccgttcggatcgagtgcgccgatcatggcgttctcggtcataatcagataggcgaaaccgccatgcacgatgttcagcgcttccttgagcttgtccataaacgtgcgttgcgtggagcggcggatgaggtgcatcagcacttcagtgtcggaattggaatggaagatcgcaccctcatcttccagcttgcggcgcagggacaggcaattcgtgagattgccgttatgacacagcgccatatcgccgtcatggaaacggaagatgaacggctggatgttgtcggtgccgccggagccggcagtggcatagcgcacatggccgatcgccctgtcgcctttgagtcgtttgatttcacgctcgtcgctgaatacctgggtcagcagacccgttccgcgatgaccgatgagatgaccgttatcgttggagacaatgccggcaccctcctgaccacgatgctgcagcgcgtgcagaccgaagtaagtgagtcgggcggcgtccgagtggccccaaacgccgaaaataccgcattcctcgtggatgtcttcgagttcagctgacaagccaaagctccttccaaaaccatggagacaaggggttcgctaccgtccaacagtatcaatgggcggctacaagagtcgggttttgtccagttctcagacggtatatggaaccggacatgcaatcgaacagccgttcgaaaaagctgttatgatggaagacgttgaaaacgcgaatcacggtcgtcggggtgcgggaagtcccccgtatgagccattgcatggaaggagcatcatggccggacggatatacgtggcaatcgacctcaaatccttctatgcgtcctcggaatgcgtggaacatggattccctccgctatccacacacttggtggtggcggaccaggagaggaccgacaaaaccatctgccttgcgatctcgccgtcgttgaaggcatacggtctgcccggacgcgcccgcctattcgaagtcaaagcgaaactgaaggaaatcaacgcggtccgtcgcgccgcggctccaggcggtgtgctgacggggaaatcgtatgatgcgaaggcgctcgcggccaatccgaatctggccgctgacgtgttcatcgccaaaccgcgcatgtctcattacttggcgatgagtgcgaaaatctacggtatttatctgaaatacgtttcggctgaggatatccacgtctattcggtggacgaggtgttcatggacgtcaccggctatctgcgcgcctatggcaaaggggtggaggagatgacccgtgacatcatccgtgatatccacacccagaccggcatcaccgccaccgcgggcatcggcacgaacatgtatctggccaaagtggctatggatatcgtggccaaacacatccaggcgggggaggacggcattcgcatcgcccggcttgacgagatgtcgtaccggaaattgttgtggaatcaccggccgcttaccgatttctggcgtgtggggcgtgggtatgcaaggaagctcgaagcgcacggactggcgaccatgggggatatcgcgcgctgctccatcgggcgtgccgacgaatactacaacgaagatctactgtacaagatgttcggtgtgaacgccgaactgctcatcgaccatgcgtggggttgggaaccgtgcaccatcgcggacatcaaagcgtacaagccggcggggcacagcttgagttccggacaagtgctgacgggaccggtgggttttgatgccgcccggcttatcgtgcgtgaaatggcggatacgctgtctctggatttggtggcgaagggcgtgaaagccggcagagtgggattgatggtcggctacgacacggcaagtcttgatccgaaacggcttggcaaggatgtttccgctgatttgaaggcgattgccgaacatgccgcggcaacatacgacggccctgtttcgatcgacaggtatggccgccgcgtacccaagccggccaccgggtcgatcgcattgccggagccgacgtcggctacgtcgcgtatttgcgacgcggtcgataagcttttcctttcgattgtcgacaggcgtttgctggtccgtcgggtgaatgtggtcgccgccgatgtactgaccgacgagcaacttgaggaacggcggcaggcggccgcgtccgaatatacgcagcctgatttgttcgccacgatggaagcgccggtggattccgcttccgctgatgcggccgaatgcgaggctatgcgttccgccgccgatggtggttccaaggattcgccgcaaggggacgccgaactgcatatgcagcaaacgcttctggacatcaaacgcaaattcggcagaaattccatcatcaaggccatggatatgttcgatgacgccacaggccagcagcgcaacaagcagataggaggtcatgcggcatgagccttacggaaacccatcgctacgacgacatcatcgatctgccgcatcaccaatcgcagacgcatgcccatatgagcatgcataaccgtgccgcccaattcatgcctttcgccgccctgaccggttacgacgacatcatcagacaaaccgcgcaatccagcgatgatgcggtggaacgcgccaacaggcccgtcgatctcgccgagggttacctttccgcctgaagcggctgctatgacgaatgtcgcggattgctgtatatgaaagggtgggttcggaatcatgagatttcgaacccacccttgattatgtgagcgtgaaaagagtcttgatgctcaggcggtgaagtactccacgccggctgcgaacagcggctgatccttctcgccgggcacgttcacgaacgtgccgttgctgtagcgctcggagtggcccatcttgccgaacacgcggccgtccgggctggtgatgccttcgatggccagcagcgaaccgttcgggttcacgtccagatccatgcccggcacaccgttctcgtccacgtactgcgtggcgatctggccattggccttgagctgggcgagcacgtcgtcggaagccacgaaacggccttcgccatgggagatggcgatggtgtgcatgtcgcccacctcggtcttcgcaagccacggggagaggttcgatgccacgcgggtgcgcaccagacggctctggtggcggccgatggtgttgaacgtcagcgtcgggcattcggcggtcatcggcacgatgtcgccgtacggcaccaggccaagcttgataagcgcctggaaaccgttgcagatgccgagcatcaggccatcacggttgttcagcaggtcgcgcacggcctcggtcacggccggagcgcggaagaacgcggtgatgaacttggcggagccgtccggttcgtcgccgccggagaagccgccaggaatcatgatgatctggctcttcttgatctcctcgaccaaagcggcggtggactcggccacggcagccggagtgaggttgttcacgataagcgtgctcacgtcggcgcccgcgcgttcgaaggcggctgcggaatcgtattcacaattgttgcctgggaacacagggatgatcacgtgcggcttggccacaccggtgccggtgtacacggtcttcttcggagcgtcgaaggacacggtttcaacggtcttgcccttctcgtcgccattggaacggtacgggaacacggattcgatgccgccctcccacgcgtcctgcagttcggccagatccagcgtctcaccggctgccgcgaactggtaggcctcggtggtctcgccgacctcactgacctcaaccaggttggatacggccggaaccttcgcgttgtcggcaagttcgatgatgaaggaaccataggccggggcgaacaggtcgtccacgctgatgccatcggccagcttcacgccgatctggttgccgaccgtcatcttgaagatagcctcggcggtggcaccgtagccaggcgtggacacggccagcgcatcgccgaaatcggtgagctcctcgaccgcggagaacacctccagcagcgcgtccttatccggcgtgagaccatcggcgttatagcgcggggcgatgcggaccacacggtgaccggcacccttgaactccggggatgtggcgcgcttcatattgcccacggctacagcgaaggagatcagggtcggcggaacgtcaagctgttcgaaggtgccggacatggaatccttgccgccgattgcgccagcgcccagatccacctgggccatcaaagcacccagcacggcggccatcggcttgccccagcgttccggctcgtcgcgcagcttctcgaagtactcctggaagctcaggtatgccttctcatgctcaaaaccggcagcgaccagcttcgagagcgactcgaccacggacaggtaggcgcccgtgaactggttctgctccatgatgtacgggttgaagccccaagccatcgcggaggcggtggtggtctcgccaaacaccggcagcttggccaccatggccatgttcggggtcagctgcttacgcccgccgaacggcatgagcacggtgcctgcgccgatggtggagtcgaagcgttcggaaagtcccttgttggaggccacgttcagatcggtgagcatggtgtgcatgcgttcggcgagcgtgccggtcttccacggggtggcgtagccgtgctgcgcctcgacatgcaccacctgatgcttcggagcgccattggaggcgaggaactcgcgggacagatccacgatcgtgtcgccgttccacaccatcgtcatgcgcggctcttcggtcacggtcgcgatgacctcggcctcgaggttctcctccttggcgtagcccaggaactcgtccacatcttcggcggccacgtccacggccatgcgttcctgcgattcggagatcgccagttcggtgccgtcaagaccctcgtacttcttggacaccttgttgaggtccacatacaggccgtcggcaagctcgccgaccgccacggacacgccgcccgcgccgaaatcgttgcaacgcttgatcagacggcacgcgtcaccacggcggaacagacgctgcagcttgcgctcgaccggcgcgttgcctttctgcacttcggcaccgtcaagctccagcgattcgacgttatgcgccttggaagcgccggtggcgccaccgatgccgtcacgaccggtacggccgccgagcaggatgaccttgtctcccggagccggggtctcgcggcgcacatgatcggccggagtcgcggccacgaccgcgccgacctccatgcgcttggccacatagcccggatggtagatctcatccacctggccggtggccagaccgatctggttgccgtaggaggagtagccagccgcggcggtggtgacgagcttacgctgggggagcttgccctcaagcgtttcggaaaccggcacggtcggatcggcggcaccggtcacacgcatcgcctgatacacgtaggaacggcccgacagggggtcgcggatgcagccaccgatgcaggtggccgcgccaccgaacggttcgatctcggtcgggtggttgtgcgtctcgttcttgaacaggaacagccaatcctcgtcgtggccgttcacatccaccttcaccttgacggtgcaggcgttgatttcctcggattcgtcgaggttcttcagaatgccgttcttcttgagccacttcgcgccgatcgtgcccatatccatcaggcataccggcttggcgtcgcggcccagctcgtgacgcatctcaagatacttgtcgaacgcggccttgacggtggcatcgtcgatcgaaacctcgtcgagctgcgtgccgaacgtggtgtgacggcaatggtcggaccaatacgtgtcgatcaccttgatctcggtgatcgtcgggtcgcgctgctcctcggtgaaatgctcgcggcagaactgcaggtcggccagatccatggcgagaccacggtcttcgatgaactgctcaagctcggcgtcgctcatagaacggaagccgttgatgacctccaccttgcctggcaccggcacctgggccttcagcgtggtcttgacatccagagaggcttcacgggcttccaccggattgatcacgtaatgcttgatggcctcgacgtcggcttcggaaagctcgccttccagcgcatacaccttggcggaacgaaccgtcggacgctcgccttgggagatcagctggatgcactcgctggcggaatccgcgcgctggtcgaactggccgggcagatactccaccgcgaacacggtgtcggaaccgaaatcaggcaggtcggcgtagacgttgtccacctgcggctcgctgaacacggtcggcgtggcctgggcgaacagctcctcgctgatgccttccacgtcgtaccggttgacgagacggacgttcttcaaagctccgatgccgagaatggtgtgcaactcgttggcgagctgctgggccgcgacgtcaaagcccggcttcttttccacgtacacgcgaaaaaccatggtcaactccttgaaaaagaggggttattggatttggattgacaaaagaatgaaggattgcgatataacaaggaagcccgcatccggctttcgcttcagatgcgggcttgcaaacgcattactctgcgacttcgatgccctcggacttggcgagctcggccaagcggctttcgatctcctcgtatgccgggatgatgtcgcccaggtcgcggcggaacaggtccttatcaagatgctccaccttgccggagtggtcgcgctgatcccacaggcggcaggaatccggggtgatctcgtcggcgagcagcagcgtgccgtcggaggtgcggcccatctcgatcttgaaatcgaccagcttgacgtcgatcttggcgaagatttcgatcagggcttcgttgatgcgacgggcgagcggcgcgatttcggccagatcctcgcgggtgcacacatcgagcgccaccagatcgtcgtcgttcacgaacgggtcgtgcagttcgtcgttcttcaggaagtactccagcaccggttccttgagctcgatgccctcttcgacgcccaggcgggagcagaagtggccggccgcggtgttacgcagcacgatctcgagcgggaacatcgtgaccttcttgaccagctgggaggtctcgcccacgcgtgccaccaggtggctgtcgatgccgcgcttcttgagcagatcgaagatcagcgtggtgatgaggttgttcagcctgcccttgccggcgaagtcttccttcttttcgccgtcacctgcggtagcggagttcttgtattcgacccagaggacctccggatcgtcagttgcgtacagttgcttggccttgccctcgtagagcttttccaacttctccattactcgcctttcctggtgtttgggaggtagatagtttggtgaacttgacagttaacaagataccaacgggaggctacaatcgcgcgacttttgggcgcgttccggcagcctcgtctcagcatccggcgatagccgtcaaacgattgcgatgtcgagcgattcggccacgttcccggctttggcgcgcgcgtccgcctcgtcgccgccgacggccagcgcgaccgccatgcgtcggtgcccatgcacttccggcttcgcgaagacacgcaggtcggtacccggttcggcgagcgcggcggcgacgttgcggaattccgcttcgccatcgccttggacgacgatcgcatggcttgccgcgacggtgccttccggaatcgacagggcgacatgttcctgtgtgatcggcaggccgaggatcgcgcgcgcgtgcaatgcgaattcgctcaaccgctgggaagccatggtgaccatgccggtatcgtgcggacgaggggagacctcgttgaacagcacgtttccgtcggtcagcacgaacagttcgacgccgaacacgccccagcctttttcgccggaagcctgggccttcgccaccagaccttccacggcggttcgtgcgatgtgctgcgcctgttcgagcacgtccggcgtgaaggtggccggctgccaggattcgcggtagtcgccgctttcctgacgctgtccgatcggagcgcaggtcacgatgccggcgctggagctgacggtcagtacggtcagctcgtagtcgagcggggcgagcgcctccacgatcacgcgtgacacgtcgccttcgtcgtgtgcgcggcggccttcctgcgcttccgtccatgcggcgtcgatcgcatccgcggaacgtaccacggactgtccgtggccggaggagctcatgatcggcttgaccacgcatggatagccgacgatttgcgcgccctcacgtagttcttccagagagccggcgaaacggtacggggtggtcggcagtcccagttcctcgtgtgcgagcacgcgcaggcgctcgcgatccatgcagatcgccgcgatttcggcgcttggcaccacctgcgcgccacgtgctgcggcggccgcgagttcggaggtggcgatcgcctcgacttccggcacgatgatgtccggctggatttcgtcgaacagcgcgcgcagctggtccgcgttggccatgtcgagcacgcggtattcgtgcgccacctgttgtgccggcgcgccggcgtaggaatcggccgcgcacacccatgcgccgagtctcatcagttcgatggtgacttccttgcccagctcgccggagccaaggaacagaacacgggtcggatgcttgccaagcggagtgccgagggcacgattctcttcagtcatgacttctattgtgccatcggcgtaggatggaacgcatgtccgagaatgaaaagaatgaaacgcagcgccccctgaccattgccatggtggtcgacacgtcggggaatcggggcaatggcacctcgaattcggcgttgcagtgggcgcaggagctggagcgccaggggcatcatgtccgtttggtgggcatcggcgcgcccgaatatcccgcgcgcgtcaatcatgtgccgttggtcagctgggtggcgaagaagcagcagatgcagttcgccgagccgagcgacacgctgtttcgcaaggcgttcgatggtgtggacgtggtgcatatctacacgccgttccgtttcggccagcatgcctgcaaggtcgccaaacagatgggcatcgccgttacggccggctaccacgtgcagccggagaacgtcacgtattccgcggggcctttgaaatatgtgcccggcatcgactcgttcatctactggctgttcgacatatggctgtaccgcaagatcgaccatgtgcatgtgccgaccgaattgggtgcgagcctgctgcgctcgcatggatacaagtcgaagctgcatgtcatctccaacggctacgaatcgcggttcacgccgaagcggcagcgcaaggcggacgagccgtcgccggtgccgttccgtatcgtcgcgtcgggacgactgaccaatgagaagaaccatgtcgcgttgatccgggcgatcgcccgctgccgtcacgcgcaggacatcgaattggtgatcgccggcaccgggccgcttaagaagaggttgcagcgtatggccggacggctgttgtctcgtccggcttcgatcggattccaccggaatgccgacatgccggcgttgctgcgttccggcgatctgctggtgcatccgtcgatcgccgatctcgaatcggtgagtgtcatcgaaggcatggccgccggtctggtgccggtgatcgcctcgtcgtcgctgagcgcggccggccagttcgcgctgctggacgaatcgttgttccccgtggacgatgtggacgcgctggcccgtcgtatcgactggtggatcgaccatccggcgcagctcgccaagtggggcggcacctacgccgaacatacgaaaaccaattattcggtggaatcgtccgtacgtaagttcgtcgcgatggaacgtgaggcgatcgccgataaccgtcgctgaatggcgcctgccgcaatcgcaatacaatcgttatacataagcggaaagccgggagcgatttcccggctttccttgttttgcggactgtcttttacagcagtgcgaccagctcgtccacctgctcgtcggtcgtggcccagctggtgcagatgcgcatcacggtatgcgcgtcgtccgccttttccgtgaagccgagacggacgtcgcgttgcagacgttcggaggtctcgttgtcgagcgtgacgaagatctggttggtcggcgcatcgaaagtcagcgtgtagccacgttccaccagcaccttgcggatacggtccgcggcatcgttggcgtggcgggcgatgcgcaggtacaggccgtcggtgaacaacgtgtcgaactgcagtcccagcagccatcccttggccagtagcgcgccatgctgcttgacgatcgtcacgaaatgctttggcatgttgccgtgcgtgaacaccacggcctcgccgaacatcgcgcccaccttggtgccgccgatatagaacacgtcggcgagacgcgcgatgtcctcgatcgtcacgtcgttgccggtggcggtcagcgcgtagccgagacgcgcgccgtcgatgaacaacggcatgtcgtacttcgtgcagaccttgcggatcgcctcgagttcggccagcgtgtacagcgtgccgtattcggtggcctgcgaaatgtacacgcagccggggaacaccatatgcgtgtagttgccgtccgcgtagaacgtggcgcagtattcgtcgagttcatccgcgttgattttgccgtcatggtgggggagcgtgagcaccttgtggccggtgaattcgatagcgcccgcctcatgcacgttcacatgtccggtggtggccgccaccacgcccgcatacggcggggtgatggcgtcgatgacgacctggttggtctgagtgccgccgacgaggaagaagatttcggcgtccgggcatgcgcaggcctcgcggattttggctttggcgctttcgcagacgtcgtcggtgccgtagccgggatactggttgggcgcggtttcggcgagacgggcgatgatttccggcgtcgcggcgcaggagtagtcgttttcgaaagacagcatggtcgttccttttgttgtgggttgcttgcgatcgggaaagtctggttccgcgcgttcggcctccgcggatagcaaaaaacctcggaatttcttccgaggtttcaccggggtggctaacgcggctcgaacgcgcgaccttctgaaccacaatcagatgctctaccaactgagctatagccaccatgttctcacttccatgcggaagcgcaacgaatggatactatacacgattttttggatgcgcgcgcgtcggcgtgttgcgctttcggctgccatgtgatgtgcattatgtgaacggaatgttacgcacttgatggatgggtgcctaatttgtaggcaattccaacggaagatgtcacgacggggtcggcagaaagccggtcccgttttgttttcctcggaaatgacttccatggaaacgtgattgagaaaagaggaaacgataatgcagaagatcaaggcgtttggtgattggctcaccaaatggttcaccgtgatcgtgatcgtatgggccgtgttcaactacttcgtgccgcaaaccagcctgtggggcaagtcctacaccggatacttcctgggcatcgtgctgttcggcatgggcctgacgctgacgctcgacgatttcaaacgtatcctcacccagccgctgatggtcgtcgtcggcacggtggcccacttcgtgatcatgccgttggtggccgtgctgctgtgctggatcttccgtctcgacggcccgcttgccgtgggtgtgattctggtcggctgctgcccgtccggcacctcatccaacgtgatgagctatctgagccgtggcgacgtggcgctcgacgtgtccatcggcatcctgtccacgctgtgcgcgccgttcatgattcctctgctgatgcagtggctcgcctcccagtatgtgaccgtgccggtcgagtccctgttcctcaacgcggtcaaggtggtgctgttcccgatcgcgctcggtgtgatctgccacgccatcttcaaggagaagatcgagaaggtcacggtggcgctgccgatcgtgtcccaggtcgccatcctgctcatcatcggcgtcgtggtcgcagccaatggtccgaagctgttcgtggcatcctcgctgcttgccatcccggtggtcatcctgcacaacctgtgcggttacgcgctgggcttcggtttctccaagctcatgtacaaggtgtatccgaagggcttccgctacgcgcagcagaaggccatcaccttcgaggtcggaatgcaggattccgctttgggcgccacgttggccttgagctccttcgcgtccaacccgcttgccgccgtgccgtccaccttcttcagcgtatggcacaacatctccggttcggtgctgtccagctggtggcgcgagcacgatgacaagcatcagatccacccggattccgacaatggcgagaagggttccgcggccaaggcttcggaagccggggacgccgtcaaggatgagtccgaggaaacggtcaacgcctgaatgtgattcgtggcatcggccaggcagcctctgaaccgtacagaacggttcagaggctgttctgttttgacctgtttttccatggcgatgttagattgtgttgctttgcgctgaagttcggttaagtattgaaaatattgggatttaggggtgttttgccccgtgtcatatgttcgtttgcggtatactaaaggtgaaggccggagttgcggatcggtcgagaattcgtcaggtcgcaatgaagcgccgatggccgtgaggcccatgcgcaacgccttcaagatataactgaagaacaaccgaatatagcgattcgagatggcggcataggcagtacggcgaggacgccgggccgcatggggttatgaaaagactcagaggtttgaagcgatgcgcgcaaggtggcgcgtgggagagtggctccgatgccaggatggcgtcggagccactcttcgtataacggccgttgctgtcgcgacacgattatccagcattgtccggcagacctgtatactggtaattcgtgtgtgccaacggcatgccttatgtaacaggcgtgcgggttgggatatcccggaactcgattgcatcacgcgcagcaatgcggcggtgagagagggacgggccatcgggccggtggactgtggctatctttacgattcagtgtcgtggagtgtgggtgcagtgcggcggtcacgcgaaaccaagagaaaccactgaatcggagaattcaagttgcctactattgaacagctcgtccgtaagggacgtcaggcaaagccgaagaagtccaagactttggcactgaagggaagcccgctgcgtcgtggcgtgtgcacccgtgtttacaccaccaccccgaagaagccgaactcggcactgcgtaaggtcgcccgtgtgcgcctgagctccggtgtggaagtcaccgcatacatcccgggcgaaggccacaacctgcaggagcactccatcgtgctcgttcgcggcggccgtgtcaaggatctgccgggtgttcgttaccacatcgttcgtggcgccctcgatacccagggtgtgaaggatcgcaagcagggtcgttccctgtacggagcaaagaaggcgaagtaagagatatgtcacgtaaaggaccttccaagaagcatcagctgctgccggatccgatctacggttccaccgttgtggcacagctcatcaacaagattctgcttgacggcaagaagtcgatcgccgaggacatcgtctacagcgctctcgacatggtcaaggagaagaccgaccaggagccggtcgccgttctcaagcgcgctctggacaacatccgtccgtccctcgaggttcgctcccgccgtgtcggtggcgctacctaccaggtcccggtcgaagtgaagccgggccgcgccaacacgctgtccctgcgctggctcaccgacttctcccgcgcccgtcgcgagaagaccatggctgagcgtctggccaacgaaatcctcgatgcctccaacggcctcggtgcttctgtcaagcgccgcgaggatactcataagatggcagaggccaacaaggccttcgctcattaccgctggtaattagtcgagaacgagagttaaggaacaatcatggcactagacgtgctcaatgatctcaaccagatccgtaacatcggcatcatggctcacatcgatgccggtaagaccactaccaccgagcgtattctgttctacaccggtaagaactacaagatcggcgagacccacgatggcgcctcgacgatggacttcatggctcaggagcaggagcgcggcatcaccattcagtccgctgctaccacctgcttctggaaccgtcagacccatgacgagaagcagaagttccagatcaacatcatcgatacccctggccacgtggacttcacggccgaggtggagcgctccctgcgtgtgctcgatggtgctgtcgccgtgttcgatggcaaggaaggcgtggagccgcagtccgagaccgtgtggcgtcaggctgacaagtacggcgttccgcgtatctgcttcatcaacaagatggataagctcggcgctgacttctactactccgtcgacaccatcaagaccaagctgggcgcgaccccgctggtcgtccagctgccgatcggcgctgagaacgacttcgccggcgtcgtcgacctgatccgcatgaaggcctacgtctggaacgacgtttccggcgatctgggtgcccactacgacaccaccgacatcccggccgacctgcaggacaaggctgagcagtatcgttccgagctgctcgaccaggtcgccgagtccgacgaggagctgctcgagaagtacctcgagtccggcgaactgaccgaggacgagatccgcgccggcatccgcaagctcaccatcaaccgtgaggcctacccggtgctctgcggctccgccttcaaggacaagggtgtgcagccgatgctggacgccgtcgtcgactacctgccgagcccggaggacgttccgtccatcgtcggcttcgacccgcaggacgagtccatcgagatcgaccgcaagccgaccaccgatgatccgttctccgcactggtcttcaagatctccacccacccgttctacggcaagctcgtgttcgtgcgcgtgtactccggttccgtcaagccgggcgacaccgtcctcgactccaccaaggagaagaaggaacgcgtcggcaagatcttccagatgcacgccgacaaggagaacccggtggatgccgccgaagccggcaacatctacaccttcgtgggtctgaagaacgtcaccaccggtgataccctgtgcgacgagaagtccccgatttccctcgaatccatgaccttcccggatcctgtgatcgaggtggccgtggagccgaagaccaaggccgaccaggagaagatgagcatcgctctggcgaagctgtccgacgaggatccgaccttccaggtgaagaccgacgaagagtccggccagaccctgatctccggcatgggcgagctgcagctcgacatcatcgtcgaccgtatgcgtcgtgaattcaaggtggagtgcaacgtcggtaacccgcaggttgcataccgcgagacgatccgcaaggccgtcatgaaccaggaatacacgcacaagaagcagaccggtggttccggccagttcgcaaaggtcctgatgaacttcgagccgctcgacaccgagaacggcgagacctacgagttcgtcaacgaagtcaccggcggccacatcaccaaggaattcattccttccatcgatgctggcgtgcaggaagccatggaatccggcatcctcgccggcttcccggtggttggcgtcaaggctaccgtcaccgacggccaggtccacgacgtcgattcctccgaaatggccttcaagatcgcaggttccatgtgcttcaaggaagctgccccgaaggccaagccggtcatcctcgagccgatcatggccgtggaagtgcgtactccggaagagtacatgggcgatgtgatgggcgacatcaacgcacgtcgtggttccatccagtccatgaccgactccaccggtgtcaaggtcatcgatgccaaggtcccgctgtccgagatgttcggctacatcggcgatcttcgctccaagacccagggccgcgcaatgttcaccatgcagatggactcctacgctgaggttccgaagaacgtctccgaggagatcatcaaggcccagcgcggcgagtgacacgcgctgccactgaagtggaaactgtctccagtcagcgctagtattttgtagcgctgactgggttcgggctccaaagtggcacaaacccgtcaaacccagtaaaatgtagcgagtgccttgaagtgagttcaaggcttactacgagacgtccaggaggacaaacacatggcaaaggaaaagtacgagcgtactaagccgcacgttaacattggtaccatcggccacgtcgatcacggcaagaccaccctgactgcagccatctccaaggtgctgcacgaggagtacccggatgtcaacccggagtacgacttcaaccagatcgattccgctccggaagaggccgcccgcggtatcaccatcaacatcgcccacatcgagtaccagaccgagaagcgtcactacgctcacgtcgactgcccgggccacgccgacttcgtgaagaacatgatcaccggcgccgctcagatggatggcgccatccttgttgtggccgccaccgacggcccgatggctcagacccgcgagcacgtgctgctcgctcgtcaggtgggcgtcccgaagatcctcgtcgctctgaacaagtgcgatatggtcgacgacgacgagctcatcgagctcgttgaggaagaggtccgtgacctcctcgacgaaaatggcttcgatcgcgattgcccggtcatccacgtgtccgcttacggcgcactgcacgatgacgctccggaccacgagaagtgggttgagcagatcaagaagctcatggacgccgtcgatgactacatcccgaccccggtccacgatctggacaagccgttcctgatgccgatcgaagatgtcttcaccatctccggccgtggcaccgtggtgaccggccgtgtcgagcgtggtaagctcccggtcaactccaacgtcgagatcgtcggcatccgtccgacccagaccaccaccgtcacctccatcgagaccttccacaagcagatggacgagtgcgaggctggcgacaacaccggtctgctgctccgcggcatcaaccgtgaccaggtcgagcgtggccaggttctggctgctccgggctccgtgaccccgcacaccaagttcgagggcgaagtctacgtgctgaccaaggacgaaggcggccgtcactcgccgttcttctccaactaccgtccgcagttctacttccgtaccaccgacgtcaccggcgtcatcaccctgccggaaggcgttgagatggtgcagccgggcgatcacgctaccttcggcgttgagctgatccagccgatcgctatggaagagggcctgaccttcgcagtgcgtgaaggcggccacaccgtcggctcgggccgtgtcaccaagatcatcgagtagtttctacccgacatcaagacacgcttgaattagcgttttaaagaaacctcccaaggatgcgaatccgagggaggtttctttatatatggaagggcaatgctccaaagtatgcacgccgtggcataatgagcaaggctttttgtaagcttttccgtcagatgaagaaataggtgagttaatttggcacagactaccaatgacatcaagaacggttctgttctgaacctcgatggccagctgtggaccgtcatcaagttccagcacgtcaagccgggcaagggccccgccttcgtgcgcaccaccatcaagaacgtgctttccggcaagatcgtcgacaagaccttcaacgcgggcatgaagatggaattcgaaaccgtcgacaaccgcaacctccagtactcctatgaagacggcgacaacttcgtcttcatggacatgaccacctacgaccagatcttcattccgaagaccctggtcggcgaccaggccaagttcctgctcgaaggcaccgactgcgtcgtgtccttccacgacggcaccccgctgtccgtcgagctgccggcttccgtcgtcctgaccgtcacccacaccgagccgggcctgcagggcaaccgttccaacgccggcaccaagccggccaccgtcgaaaccggcgccgagatccaggtgccgctgttcatcggcgaaggcgagaaggtcaaggtgaacaccaccgacggctcctacctcggccgcgagaactgagagtaaggacagcgaagtttcatggcacgttccaccgctcgcaagagggctctgaacacgttgtatgaagcggatgagaagggacaggacatcctgtcccttcttgctgagcgcatcgagcagcccggcgctcagaccccgctgcccgactacgccatcgaaatcgtccgtggcgtggcggagcatatcgccgccatcgacgccatgcttgacgaacattccaccggttggaaggtcaagcgcatgggcgtcgtcgaccgcaatatcctgcgcatcgccgcatgggagatcatgttcaacgatgatgttcccaacatggtggccatcgatgaggcgttgagccttgccaaaacgctgtgcgacgacgattcgccggcgttcatccatggtctgctcagcgcggtgagcgccgatgcggaagccactgaagtggccgaacaaccgaccgaaccttcggctgaataaagccgaaagttaagcgattcggccgggtcgcgagtcctaaccggccgctatccttggtacgaataccttgactataagggggttttggtgaaccagtatgattccgaagccgtgatgtttgaccctcaggatgccgttcttgttctcgaagacggacaggtgtatgtgggcgagccatacggcgcgatcggcacgaccagcggggagatcgttttcgcgaccggcatgaccggctaccaggaaacgcttaccgatcccagctacgaccgtcagatcgtggtacagacgttcccgcacatcggggacacgggaatcaacggggaggatccggaatcctccagaatctgggtcgcaggctatgtggtgcgcgatcccagcccgaatgtgagcaactggcgcgccaccggcagccttgacgacgatctcgaatccaaccacatcgtcggcatcagccatatcgacacgcgcaagctggtacgccacctgcgttccgccggtgtgatgcgcgcggccatcttctcaggcgacgcgctgctcgacggtgacggcaaactgcgcaccatcgactccatgctcgacgaggtcaaggccactccgcagatgaagggcatgagcctctacgacgaggtcagcaccaaggaagcctataccatcgaaccctgcggcgaattcgaaggcaaggaaccgctgtttaccgtggcggccgtcgatctgggcatcaagtccatgaccccgcatcgcatggccgaacgcggctgccgcgtgcatgtggtgccgtccaccatcaccttcgacgagctccagtcccttaatcccgacggcgtctttttctccaacggtccgggcgacccggaacaggccgattctgaagtgaatctgctgcgtcaggtgctcgacgccggatatccgttcttcggcatctgcttcggcaaccagctgctgggccgcgcgctcggcttcggcacgtacaagctcaaattcggccaccgcggcatcaaccagccggtcaaggatatgaccaccggcaaaatcgaaatcaccgcgcacaaccatggcttcgccgtggatgcgccaatcggcgaaaccgtcgacgcgccattcgagaacggcaaatacggcaaggtgttcgtcagccatatcgatttgaacgataacgtggtcgaaggcctgcagtgcgtcgatatcccggcgttctccgtgcaatatcacccggaagccgccgccggcccgcacgatgccgcatacctgttcgatcgtttcgttgatctcatgcgttccgtcaaggagggaacccgcaatgcctaagcgcacagacatcaagtccgtgatggtcatcggctccggtccgatcgtgatcggccaggccgcggaattcgattattcgggcacccaggcctgccgcgtgctgcgcgaagagggcattagggtcattctggtcaattccaacccggccaccatcatgaccgatccggaaatggccgacgccacctacatcgagccgatctccaccccgatcctcgagcagatcatcgccaaggaacgtcctgacgcgttgctgccgacgctgggcggacagaccgcgctgaacgcggccatggcgctgggcgaggcgggcgtgctcaagaagtacaacgtcgagctgatcggcgcgtcccttgacgccatcgatcgtggcgaggaccgcgaactcttcaagaaggtcgtggaggaggctggcgccgaatccgcccgctccgacatcgcgcattcccttgaggaagtcgacaagatcgccgagaagttcggctacccgctggtggtccgtccgagcttcaccatgggtggtctcggctccggcatcgcgcacgacgaagacgagctgcaccgcatcgccggcgccggcatccactattccccgaccgacgaggtgctgatcgaagaaggcatcgaaggctggaaggaatacgaactcgagctgatgcgcgacaagaaggacaatgtcgtggtcgtctgcccgatcgaaaacgtcgacccggtcggcgtgcacaccggcgactccatcaccgtggcaccggtcttcaccctgaccgaccgcgaataccagaagctgcgtgacattggcattgccatcatccgtggcgtgggcgtcgacaccggcggctgcaacatccagttcgccgtcaacccggacaccggccgtatcatcgtcatcgagatgaacccgcgcgtgtcccgttcctccgcgttggcttccaaggccaccggcttcccgatcgccaagatcgccaccaagctggccctcggctacacgctggacgagatccagaacgacatcacccagtccacgccggccagcttcgagccgaccatcgactacgtggtcaccaaggtgccgcgtttcgcgttcgagaagttcccgggcgccgatccgacgctgaccacctccatgaagtccgtcggcgaggccatggctctcgcgggcaacttccaggagtcgcttggtaaggctatgcgctccatcgacaagcgtcacatgggcttcaactgggatggtgacaagccgtccgaggacgaggtttcccagctgctcgacgccatcaaggtgccgaccgagcaccgttatctgcagattcagcgtgccctgtggggaggcgccaccgaagagcagatcttcgcggccaccaagatcgacccgtggttcatccgccagttcgcgctcatcaacgagactgcgctggaagtcaagaacgcggagaagctcaccaggaagctgctgaagaaggcgaagctcgccggcctgtccgacctgcagatcgcgcacctacgccgtctgggagacgagggcgagaacaccatccgtgagctgcgttggtcgtacgacctccgcccggtgttcaagaccgtcgacacttgcgccgccgaattcgacgcggcaaccccgtactactactcctgctacgcggatgagaccgagctgcgtcctcgcgaccgcgaggccgtgatcatcctcggctccggtccgaaccgcatcggccagggcatcgagttcgactacacctgtgtgcacgccgtgcaggaactgggcaagaactatgacacgatcatggttaactgcaacccggagaccgtgtcgaccgattacgacatgtccgaccgcctgtatttcgagccgctcaccttcgaagacgtgctcgagatctacgaggccgaaaagaagatgggtccgatcaagggcgtcatcgtccagctcggcggccagaccccgctgtccctggccgcccgactgaaggccgcaggcgttccgattctcggcaccacgcctgaatccattgatctggccgaaaaccgtgagctcttcggcgaggtgctgaagaaggccgacatgaacgcgccgcgctacggcaccgcgctgagcctggacgaggcccgcgaggccgcgcacgccatcggatacccggtgctggtccgtccgagctacgtgctcggcggccgtggcatggaaatcgtctacgacgacgcccaattgcgcaagtacgtcgatcgcgcattgaaggaagcccaggccgacaccgtcgtgtccggccgtctgccttcgccgctgctcatcgacaagttcctgcaggatgccgtggaaatcgacgtcgacgcgctgttcgacggcgaggagctgtatatcggcggcatcatggagcacgtcgaggaagctggcgtccattccggtgacgccgcctgcaccctgcctccgagcacgctgtccgatgaccagatccgtcgtctgcgtgaaggcacctacgccattgccaagggctgtggcgtgcagggcctgatcaacgtgcagtatgccttcatggccaacactctgtacgtcatcgaggccaatccgcgtgcctcccgtaccgtgccgttcgcttccaaggccaccggtgtggcactggccaaggccgccgcccgcatcatggtcggcgaaaccatccagcagcagcgtgacaacggcctgctcctgccccacggcgacggtggcgacatccatcgcggccagcaggtggccgtcaaggaatccgtgcttccgttcaagcgattccgcactccgctcggcaagaccgtcgacgtgctgctcggaccggaaatgcgttccaccggcgaggtcatgggcttcgaccgcgacttcccgcacgcgttcgccaagagccagctcgccgcatacgaaggcggcctgccgaccagcggcaacgtgttcatctccgtgaacgacaccgacaagcgccagctgccgctgttcgccgcgcgactggtcgagctcggcttcaacatctgggccaccgaaggcacggcatccgtgctgcgccgctacggcatcgattccaagatcgtcgacaagatcagcgtgcgtatggactccgatccagacgacccgatcaccacctaccatgcggagggcagcgtcggcaagaacgtcgtccagctgatcgaggaaggcgcgatcgacctgattctcaacacgccgaactcccgcggttcccgttccgacggctacgccatccgttcggcggctatcgcagccgacctgccgcagttcaccaccatgacggaattctccgccgtgttgatggctatcgaggcggtgcgcaataatgattatcagatcatgagtattcaggatcattccacgcagctgttcgaattggaaagccgtgactaatgatgagtagccccagcagtgaggaagtgaatgcccagcgttcggatttcggtctgcgactgagcaattcaatggccaaatacggcccgttgtgcgtcggcatcgacccgcatcggcagctcctcactgactggggctataacgtcgacgcgttgggggcggagctgtattccatgcgcatgctgcaggcggccaatggccgtgccgcagctgtcaaattccagtcctccatgttcgagcggtacggttccaaaggcatcgccgcgcttgaacgcgtgctctatgcggcacggcagatgggtgtcatcaccatcgtcgactgcctgcatggcggcctgccgaccacgatttccgcgttcgcggacgcctatttcaagccgggcgcgccattgctggcagacgccatcaccctgctgccgtattacggcgcacggtcattgggaggcgtcatcaatgacgcgctcaacaacggcaggggcgtgttcatcgcatcgttgacgtccaaccaggaaggcgccagcctgcagacggcgattcgtcaggcaggcgaatacaagggcaaaacagtggcgtacggcatcgccagcactgctcagaaattcaataagggcaatgatggaatgggttccgtcggccttatcatcggcgccaccatcgggcagtggatcaacgattcgggcgtcgacccggccaagttcaccggaccgattctttccccaggctacggatggcagggagcggagacacgcgatctgaagaccgtgttcaaaggcaccaagggcaatgtgctggtcacggtatctcgttccatcgccacgcacggtcccgacatcgcaaaattgaccgaagccaccgcgtcggtcgccagggatattcggcaggcattgaccgaggctcaaaacgaaagcgccgatgatgcggctgatggagacgtcgaataaattctttttctgaatagcttcctttttggaaaacaagacataaccaagagtggggatggaatggctgattctcaacatggacgtttgattgtgctctgcggacccgccggagtgggcaaaggcactgttctggggcgcgtacgcgaacagcaccccgaaatctggctgtcggtgtccgccacgacacgccagcctcgtccgggcgaagtgaacggcgtgaactatttcttcatgaccgaacctgaattcctggccaaagaaaaggcgggggagtttctcgaaaccgccgacgtgttcggcctcgcccactacggcacacccgtgaaaccagtcgtggaacatctggaacgcaatatccccgtggtcttggaaatcgacctacagggagcccggacggtcaaacggcgcgcgaaggaactcggcctcgaagtgcttaccgtgttcattgagccgccgtccttcgaagaactgaaacgtcgtctgatcggccgtggcaccgaaacccctcagcagcaggccaaaaggcttgagaccgccaaggtcgagttggccgctgcgccggaattcgacaaacgcatcgtcaataacgtggtcgacgaggccgcagacgagctttggcatatcatcgccgaagagttcggcctgtaatccgtcaatccgactatccagccaataaaaaccggcatacgaaaagggcctgcacgatttcgcgcaggcccttttcgtatgtttgaatcaggcgagaccggacagcttgtcaatcagctccggatcacgggtcgctcccttgtcagcggagcgggcgaaggcggcgtaagccttcagagcctgagaaaccttgcgatcacgatgggcgacatagccatcgccggcctccagctcggcgcggcgctgagccagctcctcgtcggaaagctcgacgttcaccgtacggttcggaatgtcgatgttgatgatgtcgccgttcttgatcagagcgatcgggcccttgttcgcggcctcaggcgcgatgtgtccgatcgccagaccggaagaacctccggaatagcggccgtcggtgagcatggccacctgcttgccgatgcccttgcccttcacgaaggaggtcgggtacagcatctcctgcatgcccggaccgcccttcgggccttcgtaacggatgaccagagccatgcccggcttcaacgtgtcgttgaggatgacctcgatggcctgctcctgggattcgacgaccagcgccggtccgcggaacgtccagatctccttcggcacgcctgcggtcttcaccacgcagccgtcaggcgcgaggttgccgcgcagcacggccagaccgccttcggtgaccgccggatggtcgatatcgtggatggcgccgttgacacggtcacgatcgagcgaatcgaacagcgtggtgtgcgtccacggttcaggggagacgatgtggcccggagcggccagatacatctgcttggcttcctcggtgcaggtgtcgcgcatgatgtcccagtcgttaagcttgtcttccaacgacttgtaatcaatggaatgcacgtcgcggtgcagcttgccggcacggtcaagctcgccgaggatgccggtgatgccgccggcgcggtgcacgtcggaaatctcccattcgccggacggcgacgccttgcagatgcacggcacggtgtgggagatacgctcgatgtcatccagtgtgaagtccacgtcggcggactgcgccatggcgaggatatgcagcacggtgttggtggaaccgcccatggccacatccatggtcatggcgttctcgaaagccttcttggtggcaatggaacgcggcagcacggaatcgtcgtcatcgtcgtaatactgcttggcgatcttcaccacctgctcggcggcgcgcttgaacaggtccttgcggtaggaatgggaggccagaatggtgccgttgcccggcagagccagaccgatggcctcggtcaggcagttcatggagttggcggtgaacatgccggcgcaggaaccgcaggtcgggcagacggtcttctcgtaggcgagcagatcctcttcgttcagattgtcatcggcggaggcgtacatcacgtcgatcagatcggtgttcttcttcacggtgccgtcgggcagcacggtggtgccggcctccatcggaccgccggaaacgaacacggtcggaatgttgagtcgcagcgcggccatcagcatgcccggcacgaccttgtcgcagttcgggatgcagatcagcgcgtcggcgcagtgcgcgttcacctgatattccacggtatcggcgatgatgtcgcggctcggcagggagtacagcatgccggtgtggcccatggcgatgccgtcatcaacggccatcgtgttgaactcgcgcggaatgccgccggcttccttgatggcatcggaaatcagacggcccactttgttcaggtgcacatgtcccggcaggaactcgtcgaaggaattggcgatggcgatgatcggcttgccgaaatccttgccatccacaccggcggcgcggtagagggcgcgagcgcccgcgaatactcgtccattcattagttttgcagatcgcatttccatgcctcctattgtgctggctaaacgggacacgtgttttgtcaagagtcactatgtggaaattttcggaaaaccgtgtgattcccttacaggttggataactacgctggtggagaaggcctgtgggagaggcaaggttgaggtccagtggattgcctatactaatgattttggaaaagaagcttttggcttatctgatgatttggagataatcactatggcattcggcactgagccaaccccgaccggtcttgcggatccgccgatcgacgatttgatggagcatgcggactccaagtacgctctggccattttcgcggccaagcgtgcccgccagatcaattcctatttcacccagctcaatgagggtctgctgcagaacgtcggcccgctggtggaataccagaatcaggagaagccgctgtccatcgcgttccgcgagatcaacagtggtctgcttgaggaaacccttggtgaggacgatctgaccgaaggcaactgatctacacggttcccatagagggactggcatcatttttcattcgccccgatacctgagcggtgcgctttgaatagtcaacaattaactattgattgcgtctgtgaaggacggggcgtttttcgtgggcgatcacaggatgcgaacggttgggtgttcgcgaaaggagcagccgtatggctgaattgaagttgatttccgccgagtcggtgacggagggccatccggataaggtctgcgaccagatttccgatgcgattctcgacgatatgctcgcgcaggatccgcattcccatgtcgccgtggagacctgcgccacggtcggacagttcttcgtgttcggtgaggtgaccagcgaaggctattccgacatccagaacatcgtgcgctccgtggtgcgcaatatcggctacaccagctcccgcgtgggacttgacgccgattcctgcggtgtgacggtgtcgcttaccgagcaaagtccggaaatcaaccagggcgttgcccggttgagtggcgaggaggagtcgaaggcgtcccgtgaacagcggtatgaggcgcaaggcgcgggcgaccaaggcgtgatgttcggctatgcgtgcgacgagaccgacgtgcttatgccgttgccgattcatctggcgcaccgtctggcgtatcgtctcgccgaagtgcgcaagagcggtgaggtgccgcatcttcgtccggatggcaagacgcaggtgaccatcgaatacgacgacgatgaccatcccgtgcgtctcgacaccgtgctggtctccacccagcacgacccggaagtggaccaggcatggcttaaggaacagctcaccgaacatgtgatccgtccggtgctggatgacgtgctcgccgaccgtgtggcccacgacgaataccgcgtgctggtgaatccgaccggctcgttcatccttggcggtccggcagccgacgccggtctgaccggccgcaagatcatcgtcgacacctacggcggcgctgcccaccatggcggcggcgcgttctccggcaaggatccgagcaaggtggatcgttccgcggcctatgcggcacgctgggtggccaagaacatcgtggccgccggccttgcccacaaggtcgaggtgcaggtcgcctacgccatcggcgtggccgatccggtgtccatcaacgtggagacctacggcaccgagatcggtgtgacccgcgagcagatccagcaggcggtgcgcaaggtgttcgacctgcgtcccgccgccatcatcgacgagcttgacctgaagcgtccgatctactccaagaccgcggcctacggccatttcggtcgcgaggatgccgacttcacttgggaagccaccaacaaggtcgacgaactcaaggaggccatcaaggcttgaaaacgcggccgacgtcctacgatgaaacaggcgtcggcgcatgcgttacccttgcattatgaccaatgaggatgccgagcagctggcgcttgacgggcttgccccgcgcaagcggcgcaaacgcgcgcccgccgtcaaaacgccagccgccgaacatcccatagcccaagtggtgctggacatccaggccacgcatctgggacagaccttcgactatttcgtcgaggaaaaatactctgcggccgcccaacccggcgtgatggtgcgcgtccgcttcggcgggcagcgggtcaacggcatcatatggaaacgcgccgataccagcgccacacccgaatcatcgatacgttacatcgaacgtgtggtcaccgaccgtgtgctcgttcccgaatccatgcgcgacgatatgacgcgcatcgcggacgcgttcggcggcacgcgcgccaatatcctccgcctggcagtgccgccgcgcgtggcaaaagtcgaaagccagctgcgcgtcggcaatcgcgatgccgcaggaaccgcggcgggcaaacaacggctcaccgccgtcgaccaggagatatacggccagttgcaacgtcaatacggcaacatcaatctgctgcatgacgcgctgcaaggcagacgtttccaatcgttcgtcttcgacctgctacccggtgccgaccattggcggcgctgcgcggcatggatggtggccgcggcgctcgctcagaacaagccggcggtgctggtgctgccgaccatgcgggagatcgccgacatgactgagaccctacggtcggtcggcttgaaaccgttcgctccgaccggagccgcgaacggcgtctatgacggcgatttcgcggtgctcaacgcgcagatggcgccagccgaccgttaccgggcatatctcgcgatcagctgcggacaagtgcgttgcgtgctgggcacgcgcgccgccatgtacgcgccggtggaaggcaacgcgctgttcctcatccttgatgacgtgtgctaccaggacgccgacggcatgatgccgtacgccaacgcgcgcggtgtgcttcggctccgcgcgaaatcgcataacggcgtgttcgtcgcgatggccaatgcgcgcagcgcgcaaagccaatgggaaaccgacgcggcgcacgtcggagatacgcaggtgagcggcttcagcacgcccatacacgcgttgccggccgtgaccaaggaagcgtctccatggattcgctggctcaatcgcgacgagctggcacgactcgccgatccgaccatcggcgcacgcgtgccacacaccgcggtccggatactgtccaaagctttggaaaccggtccggtgctgctgtccataccgcaggacggcatcaccgaagcgttaagctgctcgaaatgccaccgccaagtgcgatgcgcgcgttgcacgggaccattggaacggttggcggacggaacgattcgatgccgctggtgcggcgccgccaccgtgcaatggtcatgcccgacatgccataacgagcgcatgcgcgtggtcagggtcggcgccgccggaaccgcgatggaactggccagactgttccgtggcgtgccgatggtgctgtccacgccaagccagccaagaggcgtcgtgtccgatatcggattcgctccgcaactggtcatcgccacgcccggcgcggagccgcgtgtgcgcggggagagtccggcacaatgcgaataccgtgccgtggccatcctcgacgcgtggaccagtttgtatgcgtccggcatcgacgccgatgtggacacgttgaccggatggatgcgcgcggtgtcgctgtgcgcgccgcggacccgtggaggacaggcgctgctgatcggggaaacagatcccgtgctcgcacgatcgttgatgctgtggaattcgccgatgcttgcccaagtcgaagtggaggaccgcgcccagaccgcgctgccgccggtattcgccgcggcctgcgtgtggggccgacgagatgcggttgggacgatgttgaaacgaatcggcgcgttggccggtggcgacatggccaccatcgacacgatcgccggtacgatgccgtccgtcttgggtccggtgccgattccgcagccacgcaccatcgattcacgtgaattggaaggcaccgcggacagggtcaaagcagtcgtgcgcgtcccacagggcagacgtgccgaattggcgttgcggctgcgttcggcaagcgcccgccacgtggcttcacgcgaacctggggaactgcgattccagatggatccgaaggaacgcatctgacggacgtcccctcaacgtgaaacactggaacgactgatgacgttgacgttaggaatggagaaacgcatgaaaggctggccgggagagccgcaaatggaatatgacgtgcttatggccgacggcaacgccgctgcgaacgccggccggcagatcaccgacgtgatcttcgatttcggcaacgtgcttatctattgggatccggcggcggtgatgaccccacggtactcggacggactggtggaacagttcctcgacaatgacgtctccggcttctacgacatcaacaacgaactggacgccggcatgtccaatgacgatggcgtggctctgatgcgtgaacgccacggagaccagtgggccgatatgatgcggtactatctggacaatttcgtcgattcgctgaccggcgtggtgccaggcgcgcgcgtgctcatcaacgatctgaaagcagccggcgtccacgtatggggcttgagcaactggcagaaggacctgttcccggtggcgctcgaccattacgacattctgtgcagtcttgaggaccgcgtggtgtccggttacgtgggactgcgcaaaccgcaccgcgatatttacgattacgctctaaaacagttcggcatcgacgcttccggcgcgctgttcgtggatgacaaggcgatgaacatcgtcggcgcgaacgaagccggcattcgcggcgtacggttcaaggatgcccgcgcgttgcgcaccctgctgatcgacgcgggcgtggcgattcccgcggtacatgaaaaataacgacatacgcagattagacagacggttgtgcttgcggtcgctatgcgggatcgacgcatacggtcgcatgcattgatggatatgaaaggtgaggagattcgtctcatgttgaaagtgctgttcgcaggtacgccggatgtggcggtgccgtcgttgaaactattggcccaggataccgagcatttcgaagtggtggccgtgctcaccaggccggacgcgccaaccggacgaggtcgcaaactggtggcgaatccagtcaagcaggccgcgctcgaactcggtctgccggtcatcgaatccgatccgagcgaggaaacgttcgtgtccgagcttgcggccaccggcgcacaggccgccgctgtggtggcgtacggcaagatcctgaagcaggacgtgctcgacgcgctgccgatgggctggtacaacctgcatttctccctgctgccccaatggcgtggcgccgctccggtgcaacgttccatctgggcgggggagaaggtgacgggcgccaccgtgttccgtatcgtccgtgccatggacgccggcccgattctggcgcaatccaccgtggaaatcggcgcgcacgagaccgccggagaattgctgggacgtttggccgaagacggctcgcatctgctcgcagcctcgttgcaggcgctggccgatgatcagatcgcaccggtggaacagcctgccggagcgtatgaggtcgcgcagaagatcaccgtggaggacgcgcatatccgcttcgacgtgccggtattcgccgccgaccgccagattcgcgcatgcacgccgaatccgggagcctggtgcgaactgcatgcccatgcggacgccgaaccggcgaccctgcacgtattgcgcgcgcagccggccgacatgtccaatccgaacgcaccggcatcgcttgaacccggccatatcgtggccggcaagaagaacgtgtgggtcggcacctccaccgagccgctcgagctgctggaagttaaagcgcaaggcaagaaagccatgcgcgccgccgactgggcccgtggcgcccacctcgataacgccttctgtgagtaagatttttgtttctactgtaagtatgtgagtggctgcggcgtccgcgaccggcgggcggcatgcattgacgacacgctccgggccgctcaggccaagtctttacggtcttacaacgcatgccgcccaccggtcgctcgtaggtgcggaaaagttatttgagataatcgaggattttcgccagatcacgttcattgagccggtgcggagcatcctcctgcactttcggtttggcgcagaacgccacgccaagaccggccgcatgaatcatcggcagatcgttcgcgccgtcgccaaccgcaacggtctgcgccatatcgatgcccatccgcgcggcccacgcgcgcaacgattccagcttcgtatccttcgtgacgatatcgcccagcacgtgtcccgtcagcctgccatcggcagcctccaaacggttcgcaatccaataatcgagatgcgcatcggccgcgagacggtccacaacctcgtgaaaaccaccggagaccacgccgaccttccaatcatgcgcgtgaagcgtgtcaatcagttcaagcgcgccatgcgtgaaatgcactcgatggtagacctcatcgaaaatcgtggtcggcagacccttcaataacgccacgcgtgcgcgcagcgcctcgcggaaatcaagctcgccgttcatggctcgagcggtgacggacgctatctgctcgccgactcccgcggccacgccaagctcgtcgatgacctcttcgtcgatcaacgtggaatccacatccatcaccagcagtccgggagtggacagcgtgggcagggatgccatggatgcgatgttcggcgtttcttgttcaagcatggttccgattgtcggaaatcattaggacaatgggtattcttgagggttgaacgtgttggaaagcgaggtcgacatgaacgatcatgacgaagagacgctcgcgtcgctgcagcaggccaacgaccagctcatggccaagaaccatgcgctggtcaaggcgttgagccgcgccacgcaggaaatgacgaaaaccaaggcccaattgaaccagctggcggggcctcccatgactttcgccaccatggtccgcgtgcattcagccaaaacggacgggcagggcgtgcagcatgccagcgccgaagtggctgccggcgcgagacgcatgatcgtgccgatcgcggcgaatctgcaagcttccaggctcgaaccgggacgtaccgtgctgctcaacgagaacatggtggtggtctcacagctcgacaccgacacgctgggcgcggtgcgctcggtacggcaggtgtgcgatgacggccgcctgctggtcgcggatggcggcggcaacgtgacgttggtccgatgctcgggaacgcttgccaaacaggccatcagcgcgggcgatcgcgtgaacgtcgacgcatctctgcggttcgcgctttcgttggttcccccgaaaacgacgacgatttggttctggaagaagtgccggacgtcaccttcgccgacatcggcggactggacgagcagatagaacgtatccgtgacgccgtgcagatgccgttccagcatcgcgaactgttcgaacgctacgacctgaaaccgccgaaaggcgtgctgctgtacggtcctccaggcaacggcaagacactgatcgccaaagccgtggcgaacgcgctcgccgaaggcaccgacgcgggaagtggcgtgttcctgtcggtcaaaggaccggagctgcttaacaaattcgtgggcgaatcggaacgtctgattcgcatgatcttcaaacgcgcccgcgaacgagcggccgacggcaaaccggtcatcgtgttcatcgacgagatggattcgctgctgcgcacccgcggcacgggcgtttcgtccgacgtggagaccaccatcgtgccgcagttcctgaccgagctggacggtgtggaatcgctggacaacgtcatggtgatcggagcctccaaccgcatcgacatgatcgatccggcggtgttgcgtcccggacgcctcgacgtgaagatccgcgtggaccgtccgggcatccagcaggcgacccagatcgtccgccactatctgacagacaagctgccgttgtctccgaacgtggatgcgaaggcgttgatcggcgtgctggtcaacgacatctacgcgcaggacgagcatcggcacctttgcgacatctgcgacgaccatggccagtggcgtccggtgtacctcgccgacgtggtgtccggcgcggtgctcaagaacatcgtggaccgtgccaaaacctatgcggtgaaactgtccatcaccaccggacaggctgcggcgatcggcatcaatctgctggccaaagccgtggacgaagaatacggtgagacccgggacgcgctgctggatgcggatccggaacagtggagccgcatcaacgggcttgaacccggacgggtgaccggcatcagaccggtggcatgaatgccggccggcgtatgaatgctggacggtatggtatggaacgcaatctaaatacggaaaggaacggcgcgatgagcgttcgcagggtcatgggcacggaaacggaatacgcggtctccgcgccaggacaaggccgctacaatccggtgcagctctcattcgacgtggtcggcgccgcctcggatgcgtcacgcagccatatccgctgggactaccggcaggaagaccccgtcaacgacgcgcgcggcaccagactggaacgtgcggcggcccacccggacctgctcaccgacgccccacagctcaacatcaccaacgtgatcgcccctaacgggggtcgtatctacgtcgaccacgcgcatcccgaatactccgcgccggaaacaaccgaccccttcgaagcggtgcgatacgaccgtgccggcgatctcatcatgcgcgccgccgcagccaaggcaagcgagacgacgggacggaaaatcgtgctgcaccgcaacaacgtcgacggcaaaggagccagctggggcacgcacgaaaactacatgatgctgcggtcggtaccgttcgacctggtgacacgcctcatgaccacgcacttcgtctcccgacagatcttcatcggctccggccgcgtcggcatcggcgaacatagcgaaaacgccggctaccagctaagccaacgtgccgactacttccatatgaaagtcggtttgcagaccacattcgaccggccgatcatcaacaccagagacgaatcgcacagcaccgacgaataccgcagactgcacgtgatcgtcggcgacgccaaccgcatggacgtgccacaggccttgaaactcggcaccaccagcatgctgctgtggctgctcgaacacgccgacatggccgaaatcgacttgaacgaggcgctgggaccgcttacgctcgccgacccggtggaagccatgcacacggtatcgcacgacctgaccctggccgccccactaccattggaaacaggtggaaccaccaccgcatggcagatgcaggtcactttgcgtggactggtatatgcggccgcggcaacggtatacggcaccgacacatccggagagccggcatggcccgaccgctccacccgcaacatcatggcgatgtgggggcaggctctcgccgacgtcgccacagtacgccatgccgacgatgacggacgactgacgatgcgggaacaggcgtcacgtctcgaatggctgctcaaatggcagttgctggagaagctacgccgcaagaccggttcggattggaccgatcggcgcctggccgcggtcgatctgaaatgggccgcgctcgatccggccgattcgattttcacccggcttgccggacagaccgaacgactggtgacggataagcagcttgccgaggcggtcggccaagcgccggccgacacacgcgcatggctgcgcgcggagatcgtacgacgtttccccgaacaggtcattgcggcgtcgtggtcccaccttacggtgcgcggcgagtcgtccggtgatgaaaacgtggagaattcgatggtctcgttggacatgtccaatccgttgaaattcacggaatccttgtgttccgaagcgttcgagcgtgtccacactgcgagcggaatcgtggaatccctgcgttgaatctcatgttgtgcgggtaccattgccgtaggtgatggcagaggccatacccatattcgatgaaccacacggcaggacgcttgagggagagggtgcgtccaggccggttatgaggaaacgaaaaggcatactacatggaattgaggcaagtggccctcgaagtggcccgtatcctgcaagatgcaggcaagcacgcgttgaacgatcaaatgaatccgcgtgatctgaaaagttttgaaatgacggacaatcatctgagcttcacctccgacatcgataagcggttggcgcaattcatcagcaaccgcatcacgtatgtggatgtgttcgatggtttctggcagttccgtccggaagaatgccatccgggggaacggtattggtgcgttggcggcatcgacggcgcgatcaatttcgtgcgcagcatgccggaatggaccatcaccgtctcactgttcgagtttaacgaccaatgttccgcgcagccgatcctttcggtggtgcatgctccggcgcttggtctgacctacctggcggtgcgcggatccggagccatccgcatccgcaagacgccgcttggagacaaacgcgagaagattatgccgtccaccaccccgtcccttgactatgcggtggtgagcttcggcatgtcccatgtgccggaggaatccaagcgtgcgcttgaagtggtgtcgcgtatcgccggccgtccggccgacatcaagcgcgtcggccccgcctccttggatttgtgcaaggtggcggacggtacatatgacgcgtatttcgaagcgcatctgcacaagtgggacgttcccgcggtttccgccggagccgtcgtggtctgggaagcgcaggggcatctgagccggtggaacggcgatcttgtccactggcgtcaggaaaacgacgtactcgccaccaacggtctgattgccgatgatctgcgccagtatttggcataagactgattgactgccccacacctgggtaaggtgtggggcagtatgctattcgcaggagaacccgcaaggacgctttcggagaaaggaagggccatgccccagaaatttgagcagatgcaatccgccgaacaaaaacatgacgaggatgagaccattgcgcaggctggcacccagatcgatgacacggtcgatgcgcttgacgcggtgctggacgacatcgaatcggtcctcgaatccaacgctgaggaatatgtgggcagcttcgtccaaaaaggcggcgagtgatgccgcagctgcgtgacagcggcaaccattccacagcgccgcttgacgcccataccaaggacgaaatccaatccttcgcccgtattttcggcatcgaaaccgaatacggtgtgagcgtgaccggttcggaccgcccatgcgacgccggacagacggcgatgatgatgttccagccgattgtggccgaagcgagatccaccaacacatatattgaaaacggttcaagactctaccttgatgtcggctcgcaccccgagtacgccacggcggaagcccgggatccgatggacgcgctggcattggatgcggccggcgaattggtgatgagggatcttgccctggacgcccaacgtcgtctgcgctccatccagggagccggctccacggtccatgtgttcaaaaacaatgtggattccgccgggcattccttcggctgccatgagaattacctggtgcgacggttcgtgccgttgaagacgatcgaacaggagctgctgccgttcctgatcacccggcagctgttcaccggcgcaggacgtatgggggagcagggcttccagatcacgcagcgtgccgacttcctcgatgaggcggtctcatcggccaccacgcgctcgcgtccgatggtcaacacgcgcgacgaaccgcatgccgatcctgacgcgttcagacggctgcatgtgatcatcggcgattcgaaccggtcccagtgggccacgatgatgaagctcgccaccacgcatctggtgttgtgcgtcatcgaacaggccgggcgcgaaggcaaggattccgggttcgcccgattctccttcgctgacgccagtgcggccaaccataaggtaagccgtgacctgacgggcgtcgaagcgtccttcgacatggcagacggcactgtcatggaaggcggtgccgtagcgattcaggaacgttatcttgaaatcgtcgaacgattcgttggacaacatcccgaagtgtgctcctcgttgccgcgcacggacgtgcatgaggtgattcgccgatggaggcgtgtcatagaggcgttccgctcgggggttagcgaaacgttcgccgacaaggtcgattggcttgccaaacgacggctgttcgacatgctccgcaaccgtgcggggggacgactctccgtcagcaagttggaacagttggacatggactaccatgacgtggccaacggcgcgctgtacgcctcgctgtgccgtcgcggagccatgcgcacgttggtcaacgagtcacaagcacatgaggccatcgatgttcctccccacgatacccgcgccgcactgcgtggacggttcatccagtcggcacgatcgcacaacgcgcaatattcctgtgattggacgcgactatcgctgacctcgccgaacaggatggacgtgacgttgcttgatccgttcgacgcacaaccgtccgaccggttcctcacgatactagaggctttgcagtagccaaaagcctgcgatggaagactcgtctccaccgcaggcttttgatattggttggtcggattgtaactgccgctcagacttctccacggtatttggccatcatctgcgactgcagttgttgcgcgcttggcggcgtccatgtgatcgcgtcggcgcccgcatcaatggtggcgagaatacggtcttcacgacctccgcccgaagccagaatcgggatttccggatgatgcgcgcggatgcttgccacgacttgcgcggttcttgcaccggctgccacattgatgatggccgcaccggcaagaatcttgcattcggtgatttcatcatcctccgtgaccgtggcgatgacagggatgtccaccatcgacatggtcgtttcgatggtttccgccggtgccggagcgttgatgaccacgccggccgcgccctgcatctccgccaccatggccagctctgccacacgcggaccggtggtggtgcctccacccacgccgacgaacagcggcatctgcgccacggtgagcagcgcctgcgtgatcaccggttcgccggtgaaagggtacaccgcgaggatggcgttcgcgttcgtgttgcggataatcaccgcatcggtggtataggcgaacgatttgagcgtatgacctttgacggtgatgccgccgcaacgctgcgtgatgatttccggaaccctggcattgggggaggtgagtctgccttcgaccttcgccgtaccgtaggtgcttcgcgacacgtgcggcacggctgaatgctgctccacagccactgacgcgctgggggtgaatagcgaacgcttgttgagacggatgagatccggatcgtccgcaccggaatcatgttcctgcccgacgctcattcccgcacctcctcatccgtatggttcagcatgaggaattcgtggatcgccttgcggcgttcggaaatctcctcatccagaagtttggtatcggtgttgtcgatgatacgctgcagcagttcgccgagagtggaaagttcctcgtcgttcaggcagtcgagcatatgaacgtcggcttcgatgggtttggacggcttgggccgtggaaccattccccgtcttgccgcgtcgacgttccgcacgtgtgtggtggcgcgtgccatggtctgggcacgtgtcgttttgagcttggtgtggatgagcaggatgttgagtttgtggatttcgtcgatgatctgtctgcgttggtcgaccatgacatccccctttatctagtcatattgtctaatatcatagcgcatagtgtgggatgacattgcctttgcctgttataaaaagaaaaaaagagaggttccaaccatccgtggttgaaacctctcatataggtctgcgtggtcgacttacttggtgacggccttcttcagcagggagccggcagagatgcgaacgccgtaggttgccggaatctcgatggtttcgccggtgcgcgggttgcggccggtgcgggctgcgcgcttgacgcgctcggcggagaacaggccggtcagcttcaggccttcgccggactgcattgcctcgacgaacacgtcctggaaagcgttcaccgcagcctcagcctgagccttggtcaggttggacttctgggcgatcttcgagacgagatcagacttgttgtatgccataaagcatccttcttgagtcaggggatattccgcttatgaacatccacgttcattgcaataatagcgcacgcatgtgccaaaaatgccattttccaagggttttggcccttttgattcagcataggggggagaaaaaccctaaaggggggttgggctagatcaaattatgcctgtccagccatttcatagccacggctcccattggaattctcagccaatagaaggcgattcggtagacgagagtagcggagacggcgatggtggaggggatgcccacggcggtgaaggccacggacaacgcggcttcgaccgcgccaaggccgcctggcgtcggcactgcggaaccgagcgtattcgccagcaggaagatgaatgtggtctccaccggattggtgtggcatccgaaagccatcaatgcaatccagaatcccaatccggtcgagatgttgagtatcagcgcaccgagaatgccgaaggccagttctttcggatgggacagcacgttgatgagactacgtgcgtaggacttgacgatgggcaggtacttctccgtgacgatgtgccgcaccgggggaatggccatggccgcggaaatcaccaatgcgacgatggtgatcaccaaaatcagcgtgttggtgggaatcatgccggacagtgtgttgcgtccggtgaagatgccgatcagcagcagcagaatgatggtggtgccgccctgcactgcccatacggcgctcatgatggcggtggccgcggtattgcggtagccgctcttgcgcaggaactgcaggttgacaaaggccgggccgacgccggcgggcatggagaccgcggtgaagcccgaagccatttgggaacagtacaagccgatcggattgcgtttatcggcatccatgaaacagccaagggtcatggccgatccgaaccaagccagcagtccgaacagcacgcataccagagccatggcgatgttggcctctttgaccgccttgatcatttcggccggttgaatctgggtgaacaccacatacacggcgacgaccagcagcgcgatcgcgatgaaggaacggaaactgaaccgcgacagcgtgaccgtttccatggaatccgcgacctcctgcggagccaaagccgcgatacgggaacgcagcgtgttgagcatgtgcttgtcgcaggtggacagggcgcgtgtcgccgccggaaccgccgtcttctggatgaatggcgccagatcgatcagttgctcgtcgccccacgtcctgcgggcgcatgcgatcgcacggtcgatgccgttcaacgctccgagcagaaccagcagctgtactttgtccagcgcatagtttggcggcgcgctgccatagtcgccattctgccatcctgcgatcaccggctgtccgttttccatgcgcgacaacgtttcgggagtgattcgacgatgggtgaagccgtgccggtgcgcttcggacagataggtcatgaacaattccatgtcatggtcggacatggtgttcggattgcattccaagggcatgtggtcgcggtgaaacaccagaatggacgattcgctgctgtctgcgactccgtagactcccggcactgtcaatccggcgttctgcaggccgagaatcatcgcgtaatggtggtggatggcgtcgaaggaggaacggtcacggcgcatggagaccccggtcagcctgacccattgccatagctggttgagatagcctgccatatgcacttggttatcgagaacggataccgtgtattggtggccgtcgacgtcgatggcgtcgtagatgcgtgagttctcggtcagatcatcgtccaatgtggtcttcagcatgccggaatcggtgtaggtcgcgagcctgcgggagagcgacgccacgtcgatgccgatggaacggagcgcctgcgccacctggttgccccaagccccgttggtctgtgtgccgagcatgaaacgaatcagcatacccaaggcacgtcccgcggcaaaggagaccagcacgccggaaagcgaattccatgacagcaccacgaacagcactgcgaccgtgtagaggatgttccagccccatttggtaccggaacgggtgcgacgcggtccggcgacggtaaggaatgaggccatcgccgcataaaaatcgggaagcagtccggttcccacggaagtgccgttggacatcatggacatgatgagggtgccattgcccgagccgctgataagagcggaaataccccatatcgcagcgaaaccgagaataagggcgatggcggaaaccacactttgcagccattccttggcgatgagcagctggataagcacgctgacggtaatgaaaactatggcgatctgctgcaacagcgatgtcggcacatccatgagccaactgaccacgtggcccgcggaacgcacgtcggactccactccggaggtggtgccatgcaagtagatggagaacaggatgacggccgcgccgacaagcacggcgaacagcgcatggagcagatccgcgaaatcgcggttccgtttcggcggaacatcctcaatgcgcgtttcgtgtttgctggttgggaagtcgtgagacactattgacctgctttataggtacgtgggtgaatacgtccgggtgacatgcacctattatcgtctccgatgatacgccttggggcggctgtgtgaaaacacagccgccccaaggcgtatcatccgcaagatgagtgtggcgatgcgttatcagcggtcgaagtcaaccagcttgctggcaactccggtgtatgtcgccggagccaacgccttgagacgcgccgcagtggcttcgtcgaaggcctgctggtcgatgaaccgttcgacgtcatccttggagatctcgtgaccgcgcatgagctccttgaccttctcgtacggcttatccatacccggcagtccggcaagctcgcaggcgcgcatggcggtctgaatcggctcgccgagcacctcccaattggaatcgagctcggcctggatgacaacatcgttcggatggatggagttcagaccacccatcagattgttcaacgccagcagcgaataacccagcgcggagccgatgttgcgctgcgtggtggagtcggtcagatcgcgctgccaacgtgattcgaccagcgtcgccgacaaagtgtccaacagcgagcaggagatctccagattggcttcggcgttctcgaaacgaatcggattgaccttgtgcggcatggtggaggaaccggtcgcgcccttgaccggtacctgcgcgaacacgccacgggagatgtacatccacacgtccacacacaggttgtgcaggatacggttggtgtggctgatggtaccgtacagttcggcctgccaatcatgcgattcgatctgcgtggtcaacggattccacgtcagacccatacggttggtgacgaactcgcgggagacggccacccagtcaacatcagggcaggcggccagatgcgcaccgaacgtgccggtcgcgccattgatcttaccgagatattcctgggccttgaccttgttgagctgacggttcagacgatacacataaacagccagttccttgcccagcgtggtcggcgtggcaggctggccatgggtcagcgacagcatggccttgtcgcggtaggcgtcggccttctgtgccagatggtcgacaatggcctgtgctgcgggcagccacacctgctccacaccgttcttcacgcaacgggcgatggataggttgttgatatcctcggacgtgcaggcaaaatgcacgagagtcttcaatccggtcagctgggtgtcatgacccaacacatcggcggccttctccagctggtcgtcgatgtaatactccacggccttcacatcatggtgggtcttagcctcataagcggcatgctgggcaatgccttcggctccgaaattctccggaatggaacgcagatacgcctgctcatcatcggtgagcggcttgacacccggaacgatggtctgattgccgttgccctcgaaaccgttggcaagcagaatcatccactcgacttcgacgcgcatgcgctcgcggttcaacgccggttcgctcatgtattcgacaaggggagcggtctgcttgtggtagcggccgtcaagaggggtcagtgcgattgcgggggagatgtcagtaagcttcatagacaacagcatacgttcagccgtgaaccattggtcccgtcatttgctgatgcgtccctcataatactggacctcctccagctcgccttccacgacctcttggaaatgacggtcatggtccagcacggatttgcttccggtgtcgtaggcgtaccggtatcccgcctcatggtatttcgggtagtgcgtggagttcttctccccggacgaatcactgacttcggctcctggaaaagccctcttcggcgcatcttcctcatggacggagcatcgtatggtgagccagttctccgtatgggggttggcctccccgtcaagtgccgcgatgccttcatcatccatctcgatggcggtgacccgtgttttctcgggaatctcgaaattcgctatcggggagccaagcgtggcgatatgttgtatgtcgtatttgtcttggaaatccgtcgccgccgctgccgcgatgatgccgccctgcgaatggccgacgatttccacgggatcatccggctggatgccagcctgtttcatggtctcatccaggaaacggaggctttccgcggttccgcgctgccgctcatcggcactcatcagctcgaaattggtgtaccagtccataggcgaatcgtgattgccgtcggtcccgggaatgatgatcctccaagcatatgtgccatcggctttgcggtacttgcagcatgcgatggttccgtattccagaccgctttcacgttcgccgttgagaggtccttcggacagccgccgttggtcggcgatggcgtccttcgtgcttgtaccgcctctgaccactttggttttcggatacacacgggttacggagagattgtctccatggtctttgtcgaagtacggtatgagcagtctgtcgattttcttaagaccgcgattgaccgagcctttgccggaaagcccctctgctataaccgctcccggtttggtgaccatgaataaggttttcgtgatgtattccaggatggacgtgtcttttgaaggtcgttcctgtatgttcaatcggctcgcatgctctccgaggacgctcacgaagctttcctgcatccatgcggtggattccacaagatagaatttgttgaatttcccctctttggcgtaactgcgtcttacccccatcagtgcgctggcggtcaaggcgagaatcgcggattcccgtgatgacatgaaaagccctcgcaacatgatattcagccctttcctactggcttcctcagcttgggcgtataaggattgggcttgtgcgatcaatgatgatagctcattaagctgggatgccatggattgcagggcctcggcatgtgcttcgcaacgtccgagcagctgccggtacggcaattcgatatggtcctgcgccgtacaccgtggacttgccccggtcaaagcggacaggagcggtgtggcgcgagggtggattttgagttcatagcctgcggcaatgaaggatctacgggaagtgccaagacgattcgcttgatctctgaggattcttgaagcattgaagtattcccggtattcggcggtggtgaatctctttccgccaacgatgcgggccgtcactcgttggttcatgccgcacctgccgaccagagaagacgtgacgtggcgatcatatcgtcacgtagcagagcggattgccgtgcgatgcgattgagacgggtgcggtattcctcggccgcggtgccggtccagtcggccagtctgttggaggctattgccgcatcaagttcatcgagaagccgtgacgcggcaacaagtttcgcattgatcaatgtttgggtggtccgcacgccaattcggcaacgacaggacattcccgacagggatgccaacgaattgaaggctgcgacgcctggggcggcaccaagaaaagcatttgaaacgttcatggcagccatttgaccacattcggtgttgacgccaatcggaaaacagagcttgtggtcaaagaacgagtctatgaaaaaccgtcggcgtgtcgttattgggaaaacaacgaaaaccacgtcgacggcatgtggataactatattcgaaaaagccccctaccagggtttggtctgcgaggatgacgtgcttgggttctttttcgcagccgaacctgaatcgtcattgggatccgattgcgtggattgggcgttctgagccaatagctcctctattttccgacgttgttcgtcggataggttttcgtcgttcttgtgacttgatttatccgattcctgagcgtcggcggtgtttgaatccgtggaggcggactgatcgctctgctcggctttgatcttcttggacgcgtgatccgtaagctggctggaaacatgactgttatgctcgattgattcgcgcacttggggcagcagcagcggcttcatggctgatgcctcgttgaattgggcgtccgtctgctgttgcctggtgtgcagcttgtcccaatcggcatcgtcttttctgctggtcgagatgttctcctgcaggctttgcgtggcctggttgtagctattgacggctgcgagattcactatggcccatagggcggccatgaccagcaacgccgccatgacggccaaaacgatgcgaaccgtcagcgaggcacgcggtttcatggttgttctggtcatagcaaactcctcgactgaattatccaagcccccaattcgcatgcgagcagcagcagcgtgacgatggccagtggccatacgacgggcatcgtcctggtgcgcttcttggtggtttgggtgactcgccacttatcggacgcttccttggacacgccgtcacgcatggtgttggaggcgttcaacaccagcgcggtaccgctcaactcgtcggcgatggacgccatctcatccttgttcatgcgtgacactccgggtttgccggtatcagggtcggtgacccactggtccgcatttccatcgacgccgtcggcgattacgggaatgttgcctccctgctcgctgccgatggctacggtgaaggcatcggataggtatcgtcgcaatgatgagaacgtgcgccgtgcctttgatgaggtctgttctccatcggaaaacaggtacagcacgatcgcatcatcgggatgctgatcatgaatggacttgcaggtcagcagcagctggtcgataggggcatccaacgtcgaaccggccgaaacggaagtcgcctcgggcgcgagtgtatccgcccaattgtcgatcgcgttcgaatccggggtcaacggcacgtccaacgtgccggaagctccgaatcgcaaagcggcgaaactggaattgggatatagcgcggtgacgtccttcacggcttgttttgccacgtcgagacggcttgactgttcggctgaaccatattgcgcgtctttgacggccatggaaccggtcacgtcaacggccaccaccacgtcggtggcgttcaccgcacggctattggtcggcgccacgatactgggcgtcaatgccatgaccgacaccgtcagacaaagcaatacgcgccgaacgcatgcccaaacggtttcgtcgctgtcagcgcggcgacggacatgcaatacgatctgcgcaatggcgcaggccagcagaaccacggcgacggctccgccgacaggccaacccaaagcaggggaaagcgtcagatggttcatctcctcaacctccaagccaatgccagccagaccatcaaaacgatggccaaggccagtgtccaccatccgggagcatccaccatggcggccttgttgctcgactcgttttcatggttccgccgagattcgatttcctcgaccagcgaagagacggatgctccattcgattgggtgagaaacaccccatgatgagcttcgatggcggatttgaatttctgggtggtctcgtcggcctcgctttgcttcggtccggagaacaatccatccacggtgatttgggcctgcttggtcaggttcagcgcctcgtcaagcgtataggttggttttccggaaacgacgttgtccgtggcaagcacgatggatgcggcgcgttgacgctcggcattgtcggcgcttgcgttcccataggcgaatccgggaagcatggccgcgcagctcaccacgccatcgccaatcagcgaagtggactccttacggttctgcgtgccttccagccagtcggaaatcgcctgataatcgctgtccttcatcttgtcgatatcgtcttgggactcgacgcctgcgaggatgctgctggctttgccaagctgtttggacaccagttcgtagtcgtcggtcaacggaaaaacggtacgtgacgtcgaattgaagatgctcaggccgattctctcgcccttgaagctgtcgacgagttgacggtaggtgtcgatgacctcgcggtcgtaggggagcgccgagccggaaacatccaagcacagcacgatgtctcggctgctggccttctcctcgccttcatccacggtgctgggacgtgccaccagagccgtggcgagtgccaacgcgaccactagaagaatcaccgccaaacgtgaaagaaccctccactggcggaataatctcgatgcggattccgtgttgaggtcatcatccaggctgaaggtgcgggcactctcgatgccatcggttttgtggcgcgcggccaccagcaacgtgacgccggcaacggccagcaccacgatgacgcctgccagaaaggcccaaggccaatgccatgacagttgcatctatcgccacctttccacaagattggccacccattcgccagcctgctcgaccgtggcctgcctggcgatgtgattgcgctcggcatccgcgaattccggcggatacaatgcctcgatggtttgcctgagcaaggtgagaccctgctggttccccgtggtccgaggcgtctcttcgatgtcggtgagcgtctggttgcgcacgtccgttccggtggcagtggaagcaaaatccctggcgattgcggccagctgtgcgaaagcctcctcgcgctccagctcccccgggcatggcgggacacaacatcatcgatacgctgatgccagacggttttgccggcaagcgcgtcatgtcggccgcgattgactatttttgcgggcttccggctcggccgggcaagccagaccacaagagccaccaaaacgacggcaagcaacagacagaccgcgatgacgacggccaaaccgttctcaagatgaatctggtccttgatgacgaggtcatcctcggcaaggaagagcatcatgccttgtctcccaacgacaatacggacggggctctcaattggttacgtgtggactgggccaaagccgtggaaaccatgcgcacgaactcatggaacatgcgttcgctggaatcggatcgaattaccgtcgagccacagcgattcagctcatggcgaatggacgcagccaggtattcacgatgcgttcgcacttgcccagctgtgtttcccctacgcaggaacgcaggcacgcgtcgttttccagccccgtcaagcaccacgcgcgcatggctgacatcaaacggattgatggtggccacatcgatgagcaccatcggatgtgtccttgcaatcatgcggatggcgctcaaatgacgttcctccaacgcatgctcctcggtggcgatgacgaccagcgcctctttgtcccgaatgcggcgcgcgtattccagcaacgcgtcgatattgcggggcctggtccactcgcgctgcaatgccgtatccaaggttcgttcgaactgcgccaggccaccgttgaacggcacccgggtgatggaagcgctgtcgccgaacaccatggacacttcgtcgcctcggcgcaggctgagcgcggcgaacatgcataaggcgtttgccgccacctggtacgcctgttccgaggaagggcatgcggcggtcatttcctgtccgacgtcaagcagcaaccatgccttcgaagtggagggacgctcacgctgcaccaccattggacgtcccgctcgggcactggtcttccaatcgatgcgtttcgcctcgtctcccggctcataggcgtggatatccacgacatcgtcggcgccgaagcgtttgttcgatgcgtgcgcgccttcgagtatgccgagcgccttgcgtaccgtcggcagactcagcgtggttccaagcgtctcgatttttctgcggatcggatcgtcggaacggatctggtcgatcatggaacggggaccgcctgcacgatcgaatccaccacctggtcgctggtgacgccatcggcaagtgcttcgaacgtcatcagaatacgatgacgcaacacttcgtgggcgaacgccttcacatcctcaggaatgacgtaatctcgtccctgcaggagcgcgttggcctgtcctatgcgcaccagcgcgatggacgcgcgcggcgaggcgcccagcctgacgagcgaggaaagtccttggacgggcttggttccagcgccacgggaggtggccgcgatatcgaccgcatactgcatgatcgcatcggacacgtgcacacgacgtgccgcggaacgcaggaattcgacgtcgctgatggaaacggtgtcaccggtgagcgcgtgctggtctacggtatcggagccgcggcgggtcagcatggcgagcatgcgttgctcttcctgctctgtcggataggtcagtacggccttcatcatgaaacggtccatctgcgcctcgggaagattgaaggtgccctcttcctcgattggattctgcgttgcgatgaccatgaatggtttcggcagcgcgatgcgttggcctccgatggtggtcgcgccctccgccatggcttcaagcatggcggactgggttttcgcgttggaacgattgatttcgtcgagcagcacgaaattggcgtggatcgggccgatctgcgtggagaatttctgcgtggcgaaatcgaagacctgagtgccgaccaggtccgaaggcatcagatcgggagtgcattgcacacgtttgaacgagccggacaccgaagtggccaaggtctgcgcggcagtggtttttgccagacccgggacggattcgatgaggatatgaccgccggccaccaaagtggtgatcagcgattcacgaagattgtcctgtccgaccagggtctgcgcgaaacgtccgcgaatctgcgaaccgatgttcctggcgcgtgcgatgtcttcggccgacagcgtggttggtcttgcggctgcgggcatggggatgggtgccggtgctggcgccggattctttggagggaataaagccatggttgctactctaacgggtcaagctgacgggagggtccaatccaccggctgttctcctgcttcgattagcgcctgattggcgcgggagaacggtttcgagccgaaaaatccgtagcgggcggacatcggacttggatggggggatttgatgatgaaagcgttggtgagcaggggctccaacgtctgcgcctttcgtccccacagaatcgcgaccagaggcttgacgctgccgtcaggccgacggcgattgttcaatgcgctgatggccgcgtcggtgaccacttcccagcctcgcccctgatggcttcccggctttcccggttcgacggtcagacatctgttgagcagcatgacgccctgtttggtccagggtgtcaggtcgccgttggccggcatgggcacgcccagatcgtcggtcagctcggtgtagatgttcgccagactgcgcggaatgggcttgacgtccggtgccacgcagaagctcagtcccaccggatggcccggcgtggggtagggatcctggccgacgataagcactttgatgtcgtcgaatggaatggtaaacgcgcgcagaatgttcctgctggccggaaggtacttacgtcccgccgcgatttccgacctcagaaagtctcccatgagatgtatctggggttcgacatcggcgagggcctgggcccatccgggctccacaagatccttcaatggtttgatatgagtcatactttcccactgtacgacgtgccctgtggatgtccatgccgattccatgcggaaacgtgtcgaatacgcgcaaaatcgacgatgctgattgtgggctgactgcacgggccggtacactggggcggtaagtgtgagaaatgaggttgcagaaaatggctaagcaggacaaggagacctacgaatcctacgccaaggatatgttcgacaatcctccggcgggaccgatgggcgtgcaccgtggcgcacgttccatggcgtccagggctctgccgtatgtgattgtcgtgattgtggctctgctcgccggcctgctgttctggggagtctattctggtgagatcagcaacctgagaatgccttggtcggccaaggaggactcttcatcgtccgtctccacggcggataaggcggataagaagacggacgacacgtccaaagacgccaagacggagaacaagaagtccgaggacggcaagaagaccagtacttcggatggccagtcgaaggacgcttcggacgccaaccagaacgcggaacagaataacgatcagaacaatggccaggatgcggcttctgagcagagcgtgaatctggccaccgagatccgcgtggtgaacgccaccagcatcaccggttacgccaagagcaaggccgatgccctgacccaggccggatacaccagcgtgacgcccagcaatccgaccggcaacgttcccagccagacggttgtctggtatcagaatgaggccgacaaggcgacggcggagaatgtcgcgcagacgctgggaatctccaatgtccagcagagcagcggattggtcacgccgatcgttgtggtgctgttgaactgaaaaaacgccgtccgaaccggtttggaacctcgcccgaacataggcgaggttcttttattttcttggaaatccggcgtttttcaagttgattcgatgcgactggcatcttgctcacagcgcaaagaacgtcatcgggtttggcactctcgacgtgagagtgctaatctgcgaattagcactcgacgagtgagagtgataactggcggctgacggctggttctgattgtcgctccgaaggtggaaataataccgtgtagccatatgtggaggaacaatggcaaagatgattgcatatgacgacgaagctcgtcagggaatgctcgcgggtctcgacaagctcgctgacaccgtcaaggtcacccttggtccgaagggccgcaatgtggtgcttgacaagacctacggcgctccgaccatcaccaacgatggcgtttccatcgcaaaggaaatcgatctggacgatccgtatgagcgtatcggcgccgaactggtcaaggaagtcgccaagaagaccgatgacgtcgcaggcgacggcaccaccaccgcaaccgtgctggcccagtccctggtgcacgagggtctgaagaacgtcaccgccggttccaacccgatcgcgctgcgtcgtggcatcgagaaggccgccgacgccatcgtcaaggaactcgtcgcagcggccaaggacgttgagaccaaggatcagatcgctgccaccgcaacgatctccgccgctgatccggaagtcggcgagaagatcgccgaagctctggacaaggtcggccaggatggcgtcgtgaccgtcgaggacaacaaccgcttcggtcttgaccttgacttcaccgagggcatgcgcttcgacaagggctacatcgctccgtacttcgtgaccaacgccgaggaccagaccgccgttctcgaggatccgtacatcctcctgacctccggcaagctgagctcccagcaggatgtcgtccacatcgccgagttggttatgaagaccggcaagccgctgctgatcatcgctgaggacgttgacggcgaggctctgccgaccctgattctgaacaacatccgcggcaccttcaagtcctgcgccgtcaaggctccgggcttcggcgaccgccgtaaggccatgctgcaggatatggccatcctgaccggtgcccaggtggtgtccgatgagctgggcctgaagctcgactccgtcgacatgtccgtgcttggcaccgccaagaaggtcatcgtctccaaggatgagaccaccatcgtgtccggtggcggctccaaggaggacgtggccgctcgcgtcgctcagatccgtggcgagatcgccaacaccgattccgattacgatcgcgagaagctgcaggagcgcctggccaagctggccggcggtgtcgccgtcatcaaggtcggcgctgccaccgaggttgaggccaaggaacgcaagcaccgcatcgaggatgccgtgcgcaacgccaaggccgctatcgaggaaggtctgctgccgggcggcggtgtcgccctgatccaggctgccgccaaggccaaggacgacgtcaagctcgaaggcgacgaggccaccggtgccgcgatcgtgttccgtgccgtcgaagccccgatcaagcagatcgccgaaaacgctggcctgtccggcgacgtggtgatcgacaaggtccgctccctgcctgacggccagggcctgaacgcggccaccaacgagtacgaggacctgctggccgcaggcgtcaccgacccggtcaaggtgactcgttccgctctgcagaacgcagcttccatcgctggactgttcctgaccaccgaagccgtggtggccaacaagccggaaccgccggcagccgctccggcagctggcgccgacatgggctactgattgaaagaccggaagcttccataggctcaaatagctgatatgaggcccgcttcccgatggggagcgggcctttgcttatctggaaggcgccttacgcgcgctttctactgcgcgaacaaacgcgacgcctgcatttcggtctccgaatacaacgtggaggcctgcatcaatgcgcgctggattgattcaagcgactgctccatctgctgctgcgcggcacgccactgttcggcgaccgctgtgaactgcgtcgcagccccgccgcgccaaacgctctgcagattgttgagattgccgtacatgccctgcacggcctgtcggatggattggatggaggcgttgacggcggcgctcgaggactgaatctgctcgctgtcgacttgatactgtggcatgtgccggtcctttcaatgatgattggtgtgtttctccatgcgatcgcggttggcgcaaccggacggtacagtggatgctatgtcatcagtgagcgtgtgcaacgaaaaaaacggagctgtggtcggagaacatatgcatttgggttccgtcggcgtgtcgcgaaacggcggcagaacggcaaaaggttggaatatcgcgatttgcatgttgctggcgagcgtgctgggtttgtgtttgatgctgtggataactccgccggtccatgcggatgacagtgccggattgggcattacagccacggacgacatcaccgacacgcagaatctgctcggttcgaatgtctcggagatcacggacgccatcaaccagacgaaaaaggagaccggcgtcaccgtccgtttggtgtatctggacagtttcaacgccaaaggcaagccagataaatgggtgagcgcgctgctggaatcgttgaacccgaaaccgaataccgtgatgttggcggttgcctcgaatgacggcaatctggtggtggccgtgtcttcgaactcggaggaatggctgaagaagaagtcgaccgtcgacgcgctgtccgatgccgcgcaaaaaccgttgatggaaagcgatccggactgggcgaagtccgcgaccgacatgatgaatcagatttcggtgcagaaaaagacctcgacttcgtcgcggaccatatggattggcgtgggaggattcgccggcgcgctgctgcttctggtggtgattctggtggtgttccatatcctgcgcaagaaggacgtgatcgggcatcggcgtaagggccgccatagcggccgtcatggtgcggtcgccgaacgtatccaaccggtcaaagagtggggcgccgaatcggaaaacgaggattatgtcaatccggataccgcttcaacgcaagattcagaatccgttcaggaaacatccagtgaagggagcgatgcttaagccatgagcaagcctattgaagcatccattgtcgttgtcgatgacgagccgtccatccgagagctgctggtggcatccctgcatttcgccggtttcgaagtgaacacggccgcttcgggatccgaagccatcgaggtcatcgaaaggctgcagccggatctgatcgtgcttgatgtgatgcttccggacatcgatgggttcacggtgacccgacgcatcaggcaggaaggcatcaccacgccggtgctgtacctgaccgctcgcgatgacacccaagacaaggtcatggggcttaccgtgggaggcgacgactatgtgaccaagccgttcagcctcgaagaggtcgtggcccgaatccgcgccatcctgcgtcgcacccagcagcaggtggaggacgatccgatcatccgtgtgggcgatctcgaaatcaacgaggactcgcacgacgtgtcccgagccggacagccaatcgacctgagccccaccgaatacaagcttcttcgctacctcatggacaatgaaggccgcgtgctgtccaaggcgcagattctcgatcacgtgtggcaatacgattggggcggggacgcggccatcgtcgaatcgtacatctcctatcttcgcaagaaggtcgatggcatcgtcatcgaggatgagaacggcgacaagcacaaggtaacgccgctgatcgaaaccaagcgcggcattggctatatgattcgcgctcccaagaactagattcagccatgagcaagaatcccaattcgccgtccacgggccacgcctccaatccttcggccattccggcccccatgcagcctccccggtcgctgccgaagcagaacaaggtatggagccgtttcacccgcaggattcaagcgattccgctgagcacgaaactggtcacctgcatcatcgtgctgctgaccatcggcaccatcggcatctccttttccatacgtacgttggtgggcaattatctgctgcagaagaccgatacgcagctgatcaaccaagcccagctgattttcaacagcatggactcgctcagcagcgacaccggcgatgacgggcgcagcctcatgaacacgtattacgtggaggtgcgcgacagcgaatacaaaagcacgggtgccggatcggtgcccatgctccgtgacggagtggtttcggaaccaagcctgccggccgacggcagcatcgacggcgtcactcttggacagccattcacgacacgtgcggtggtgcacatcaccacaagccgcaccccggatcattccatcatgcaggctgcgcagtcgccatggcgtgttgtcgcgttgccttggaacgagaagacacggaccgggcaagtcaaggacagtggcgtcgtgttcatcggcctgtcgctgagcgatcagatcgacacggccaacacattgacgcgattctgcgcgatggtgggcatcgcggtggtgctgatcggcgcgatactcggcaccattctggtgcaaagcacgctcgcgcccttgaagcggattgaaaaaaccgccgcgaaaatcgccgcgggagatctcagccaacgtgtgccagacctgccggaaagcacggaggtcggctctctgtccatgtcgctgaacaccatgctgacacgcatcgaggagagcttccacgcgcaggaagagaccaccgaaaaaatgaagcggttcgtctcggacgccagtcacgaattgcgtacgccgctcgccgccattcacgggtacgccgagctgtacaaaatgcagcgcgacatgcctggggctttggagagggctgacgaatccatcgaacatatcgaggcatccagcgcgcgtatgacggttctggtggaggacctgctgtctttggctcgtttggacgaaggacgtggcatcgacatcacgcagcaggtgaagctgacctccgtggtgcgcgacgcagccgatgacctgcatgcgctcgaccccgaccgcggcatttcctgcggacaggtcgtgctccaaccaggtaccgatatggaccatcccgcccaattcgccttccaaaatggccagatgccccagattgagttgaagggtgatgcttcgagactgcgtcaagtggtcaccaacatcgtgggcaatatccaccggtatacgccggcggactcgcctgtggagatctctatgggtgtgctccccgcgtcgatcagtcccgaatccctatcccgtatgccgtccaatgagcagtcgcttcgccatctggtcgaagccatcgaagtggggcagtccatgcaagtgggtatgaactacgcgattgtgcgattcagcgaccacggtcccggcgtgccgccggaggcacggtcgaagatcttcgaacgtttctacaccgccgacccgtcgcgtgcgcgtcagaagggcggtacgggactcggcatggcaatcgcgcaatccgtggtcaaggcgcatcatggattcatctgcgcatccggcagcgaaggaacgggactgatcctgacggtggtgctgccgatcgccccggtcgaacccaagccgcagccgattacggcgagcgagaatcgaaaaaacgaaaaaaagaatcgcaaatcaaagaaataacgctcttttccgtcgggaaagcagacgctatcggcgcggaaggatgggtgcggcccacctcttgcgctaaactgtatctttggtttgaaaatgggcgaatggttttacctattcgcgtgaaggtatctgatcagcaaaatgtgaggtgacaatgccgagcggacgtgttcgttggtttgatgcgaacaaaggctatggtttcattcagacgggtgagagcacggatgatgtgttcctgcccgctgccgcccttcccgagggcgtgaagacgctgcgtaagggcgccaaggtcgagtattccgtcattgatggtcgtcgtgggccgcaggcgatgggagtgacgctggttgcctcggccccgtcgctggttaaagccacccgtccgaagccggacgatatggccgccatcgtggaggatctgatcaagctgcttgactccgcgggcaatcagcttcgtcgacatcgctatccttcaccggctgaaagcaagaagctcgccacgcttctgcgcgcggtcgccgacaatttcgacgtacaggaatagagtttcatgtccgataccacaatggatcccaaggcaatcgcccaagcggtcgctgtcacagtgtccgacgaggacggtcaggtcggcgacttcgtggaagccatcgacctgggagacaacgtcaccgatttccgcttcgaatcccgagtacgcggctacgaaggctggcaatggtcggtcacgttataccatgatgtcgaactggaccattggacggtcaacgaatcatccctggtcccgaccgacaaggccctgcgtccgccaaaatggattccttggaaggaccgtctcgagccgggcgatttggcggtgaccgattcaatcggcaccgatcccgatgacccccgcatggaagagggcttccgcaagacgcaggatgccgagacatcggacgatacggacgacaaaccgtcagtcgcggatgaaaccgtacaggaaccggcgatggatggaaacgcttcggatgagtctgagaagacggacgtttcggaggattccgaacagcctgtgacgtccgaagaggatgtcgaagaggcggtcgaggaattcgacctgtcccgcaggcacgtgttgactccgcttggccggtcgcagaccgcgaaacgttggtacgaaggcccacatgggccaaaatcgctatccaccaagacggccgacggcaatccttgctccacgtgcggattcttcattccgctgaagggtgagttgaacctgctgttcggcgtgtgcgccaacaagtggagcccggatgacggcagggtcgtgtccatcgatcatggctgcggagagcattccgaaatcgatccaccggagccgtcgcatctgtgggtgcagtcgaagccggcgttcgacgacatgcatatcgatatcatcgcccaggcgccgcgtgacgagcggggctccgtggagctgatcgaacagctttcgtccgatgacgaccataatccgaatgaggatgaggaaggttcggacgcggacatcgaagccaacaccatcgacgacgacgccagccaagaggatgtgcttgagcatgtggcttccgacgatgcgcctgaagtagagaccaccgtcaccgtggtcgacgagaataagccggaaacgtcggacgataccgaatcgactgatacggctgagccgactgaatcggacgagccagtcgaacaggctgaacaggttgattccgccgattccgtcaattccgccgagtcgttcgagccggttgaacagatggatgagacggtagttgagccgactgctgaaaccaccgggcaaacggaaaacaaatcgatggaagacgaatcggcggaagctgagtcaacagaagccgaatcggcggcggctgaaacaacggaaagcgaaatgacggaagctgattcgtcggcccaagccgaatccgacgaataatcgtcatcgtatatgagagggccacgtacctgaatgtgtacgtggccctctcatatcttgttttcttttttatgcggtcagtgcacgacggtgacggtgcagtctgcgaagttgatgatttgcttggaaaccgatccaaggaaatgcgcgtccagaccggacaagccgcgcgaaccgaccactagatgacgtgcgtagcgggaagccgcgataagccccttcgaggcgggaatatggaaagcgtgcgattcgatttggaaatcgtcgggaatgttcgctgatgaaacctgaaccgaatcgagcaattcatcaagcatgcgttccgcctgcgcctggccgacggagatgggggcgacggcgttctcataccctttgaccacgcccaaatctttcagctgccagcagaacatgacctgcaggggagcgtgatgcagggccgcgaaatcgatggcgaaacgcaaagcgtgtttggaggtctccgaaccatcaacgcctacaaccaccggacgctggttccgaggcaggggagaacccggcatcgtgtaggagaccgtttcctcggtcggcgtaagcgcattggcgatggcgtcctgcacggatgcctcttcatcatcgaggatacgcaccacggtgacgggcaccttcgcctcctctgcaagagaagcggaaagcgatcccagaaaccatcgtgccacgcgtccaagcgaacgacgtccgacgacgatctgttgggcgtccttgccgatttccagaagcgctgccgttccggtggctttgacggaggtgagtttgacgcggttctcgtcaatcgtcatgccttgcgaggcctgggccacccattcgcgcagccgacgggcgatatcatgacgcatctgcgcccattgctcctcatcttccggctgggatcccatatcccatgaatgggtccatgcgtagaccgcattcacctgctgtccggtcagcgatgcttcgccaagagcccaacgcagggctgcgaaggattcatcggacccgtcgacgccgacgacgatgtcgcctcggcgggaatccatcacatcatttgattgcaggatggtgtcgctcatttggtgacctccttggtcgttgccataagtcaagcatatccgtttctttgcgtccatagcgcaatttacgcgccggcggaataaacgtcaccgcgaatcggtagagtgttgaaggactaacaagagtggaaggacaagcatgttcgaacggtttaccgaccgtgcgcgacgcgtgattgtgttggcgcaggaagaagctcggaccctccagcacaactacatcggcaccgagcatctgctgctgggcctgattcgtgagggtgaaggcgttgccgccaaggcattggcctcgaagggcgtgaccttggacgacacccgcaagcaggtcgaagagatgatcggcaagggaaatgcgtcgccgaacggccacattcccttcaccccgcatgccaggcaggtgttggagctgtcgctacgtgaggcgttgcagctggggcacagctatatcggcaccgagcatatcctgctcggtctgattcatgagggcgaaggcgtcggcacacaggtgctgatcaagatggatgtcaaccttggcgaactgcgtagcgccaccatcgatctgatccgaggcaattccagcgacggcaagaacgatagcaagggcgaactcgccaatgccggtggcgtgcaggaccgtcgcaatcagaccggttccgcgattctcgaccagttcggccgcaaccttacggctgaggctgccgctgggaagctcgatccggtaatcggacgatccaacgagatcgagcgtgtgatggtggtgttgagccgccgcaccaagaacaacccggtgctgatcggcgagcctggcgtaggcaagaccgcggtggtcgaaggactcgcgcagaagatcaacgccggtgatgtgccggaaacgctgaaaggcaagcaggtctactccttggacctcggttccatggttgctggttcccgctaccgtggcgatttcgaggaacgcctgaagaaggttttgaaggagatcaaaacccgcggcgacatcgtgctgttcatcgatgagattcacaccatcgtgggcgcaggctccgcggatggcgccttgggcgcttccgatatgttgaagccgatgctggcccgtggcgaactgcagaccatcggcgcgaccaccaccgacgagtaccgcaagtacatcgagaaggatgccgcgctggaacgtcgtttccagccgatccaggtgcacgagccgaccatcgccgagaccattgagattctgaagggcttgcgtgagcgttacgagaaccaccatcatgtgacgatcaccgatggcgcgctgcaggccgcggcggaactttccagccgctacattcaggaccgccacctgcccgacaaggccatcgatctgatcgatgaggccggcgcccgactgcgtatccgcaggctcaccgctccgccggagctcaaggaattggacgccaaggctgccaagctggccgaggagaaggaccaggccatcaaggaccaggactttgagaaggccgccgagctgcgtgacaagcaggagaagatcgagtccgagcgcaaggagaaggaatccgcttggcgtgagggcgagtccgatgtgaagatggtggtggatgaggacgtcatcgctgaggtgatttcccagaccaccggcattccggtgttcaagctcacccaggccgagtccaagaagctcatgggcatggagagtgaactgcacaagcgcatcatcggtcaggatgaggctgtgtccgcattgagccgttccatccgtcgcgcacgcgtcggattgaaggatccgaagcgtccggctggctcgttcatcttcgctggcccgaccggcgttggtaagaccgagctggccaaggctctcgccgaattcctgttcgacgatgaggatgcgctgatccgcgtggacatgtcggaattctccgaaaagtacgccgcgtcgcgcctgttcggtgcgcctccgggatacgtcggctacgaagaaggcggcgaacttaccgaaaaggtgcgtcgcaagccgttctccgtggtgttgttcgacgaaatcgaaaaagcccatccggacattttcaacacgctgttgcaggtgctggacgatggccatctgaccgatggccagggacgcaaggtggacttcaagaacaccatcatcatcctgaccaccaacctcggcactcgtgacatcgccaaggccgccaacaccggtttcaacctgggcacgaacaccgaatcgagctaccagcgcatgaaggaacaggtctccgccgaactcaagcagcagttccgtccggagttcctgaaccgtctggatgacatcatcgtgttcaagcagctcaccgaaccgcaggtgcgtcagatcgtcgacttggatgtcaagcagctcaacgaccgtctgttcgaccgtcacatgtcgctcgaactgaccgacgcggccaaggatctgctcgcacagaagggcttcgacccgctgctgggcgcccgtccgctgcgtcgcgtgattcagcgcgacatcgaggacgccatttcggagaagatcctgatgggcgacctcgaagatggccagcgcgtgagggtggacgccgaaggcgaaggcattctgggtgagttcacgttcaccggcgaggccttcgaagagccgaaccagaaggataatccggcggaggcgaccgaaacggccactgaaaccgatgccgccactgaaccgacggcatcgacggaaccggctgattccgcgcagtcacagaactgatttccaacgttgccggggtaagaaccccggcaacgcgtatgcaaaaagaccggtgggtttcatgatggaatgtcatgaaacccaccggtcttttttacatatgcctattcgtccagctattcgttcagctggacggttgtggttccgcccgcttccaagcggaaccacaaccgtatcgctctatgggagcgtcattacttgatggcgttcagccactgttccttggtggccttctccgcctcaagcttggccttcttcttcggatcggactcagcggcgatctgggcgttaagttcggcgagctgtgcgttgagctgctcctcgaaggaggacttacgggcgtcggcttccggatcagactgcttccaggcggcatcctcaacagccttgatctgcttgtcgacagcatcaagacggctttcgatgcggtgcatgtcatcgcgcggaacgtagccgatctggtcccattcctcctgaatggcggccaatgcctggcgagcctgcttggcggccttctcatccttgaccggcaccaaagcctcagccttggtcagcagttcttccttcttggcgagattttccttttcggacgagctaatctgctcgcgatcggtctgacgggcgttgaagaacgtgtccgccgcagcacggaaacgtgcccacagcgcgtcatcatcacgacggcccgcacgaccggccttcttccaacgatccatcagctcgttgaacttgcgggaggtttccacccaagcggtggaatccttgatctcctcggcttcggcgatgatggcctccttcgcggccttggcgttgctgcgctcctcatcgcggccctgggcccacttgcggcgggcgctgttgaacgtagtgcgggcggaggagaaacgggaccacagggcgtcggcgtcggccttgtcgagacggacgctattgtgctggtgatcctgccactgctggaacagcgaacggaacttgtccgcggtggaacgccagttggtgttgtcgcccagggaattggccagagcctcggccttctccacaatcgcggtacgttcggccagcgccttggcgacggcggccttgtgagcctcgctcagctcggccttcttggccgctccggcctccttcagtgcttcgaactgggacttgagcgcctcaatatctccgacgacggccggctgctcgatttcggcggaaagcgtcttgatggactcgtcgatctcacggttcttcacattgctggacttgagcctgttggcgaacaggtcgagctttgccttcagatcgagatagcgacgggcatacagtgccagggcctcttccttggaagcgtccggaaactgtccgacctcgcgttctccctcgccttccttcacgaacacggtgccgtcatcggcgacacggccgaacgcttcggtggccttgatatcggcttcggagaatccggtggaggttgcaggacgctgcggagccttcttggcgaaggccgcggggctcggcgcatgcggcttcatggccgctgggctcgggacggccggtttgctggcctgggttgcgggcgtcgctgcctgctcgttggtttcagtggtgttctcggacgcggtgacattctcgtcggccatggccagctccttacgtaagcttcatgtagtgcagaggtgacggtccgtgacgtgcgcttccacaccttgaaaaacgcgcggcattttccgtaacctcatttattatagagaaccgtggctaaaggtgcatctatttcaggatttccagagtggctcccctctgaacgtgttgtggagcagcgtgtcatcgacacgctccgtaatgtattcgagctcaatggcttcataggcattgaaacccgtgctgttgagcagggttccagcctgctcaagaaaggcgagaccagcaaggagatttacctgctgagccgtcttcaggaagtcggacacgagtccgacactccgattgaggatcgtcttggtctgcacttcgatctgaccgttccgctgagccgttatgtcgtcgaacattccggcgatctggcgttcccgttcaaacgttggcagattcagaaggtctggcgtggcgaacgcccgcaggaaggacgtttccgcgagttcgtgcaggccgacatcgacgtgatcggcaatggcgatctgcccgaccattacgaggtcgaattgccgttggtcatggtgtccgcattggaacgtctgcgcgagttcggtctgccgaaggccaccgtgcatgcgaacaaccgcaaactttccgaaggcttctaccgtggtttgggccttacggatatcgaaggcgtgctgcgtgagatcgacaagctcgacaagatcggcgccgatgaggtggccaagctgctcgtcgaaggctgcggcgccgacgaagcccaggcccgtgcctgcctcgaactggccgagctgaccgccgccgacggcaaggaactgtccgacaagttcgacgcattgtgcgccaagcatgacatcgcgtctgattccgacgcctacgtgttggcacgccagggactcgacacgctggcgatgatcgtcgacgaggccgcgcgcatccgtccgggctccgtgatcgccgatctgaaaatcgcccgtggtcttgattactacaccggttccgtgtatgagacgttcctcgacggcgccgccgctttgggctccatctgctccggcggccgttacgacaacctcgcatcgcagggcaacaagaagtacccgggcgtgggcctgtccatcggcctgtcccgcctggtctcctacatgctgcacaccgcgggcgcgcacgccaaccgtgtgtctccggcatccgtgctcgtggcggtatggaatgaagccgaccgctccgcgtccaacctgatcgccaaccagctgcgctcccgtggcatcgcggcggacgtggcgccgaccgcggccaagctcggcaagcagatcaaatatgcagacaagctcggcatcccgtacgtctggttcccggccgacgcttccgaagagggcgcccaggacgaagtcaagaacatcatcacaggagaccagcggccggctgacgcacagtcgtgggagccggatactgtgtatgcccagcaaaccgttaccgttgaagcctgaaatcgcaagacttcgcaacatacaagaggataaggaataggggaagcatgagccagacggcttacagaacacatcatgcaaccgaagtgaccgaacagctcgtcggtcagaaggtgacgctcgccggttgggtcgatcgtcgccgcgaccacggtggcgtggccttcatcgatcttcgcgacaacaccggtctggtgcaggtcgtcatctatgacgaggagatggcccgtccgctgcgctccgaattcgtgatccaggtcgtcggcgaggttcgtctgcgtccggacggcaacgagaacgagcatctggccaccggcaagatcgaagtcgtggccgaaagcatcgaagtgctggccaagtccgatgctctgccgttccaggtctccaccgctcttgagaacgagtccgagaacaagctgccgggcgaggacgtgcgtttgaagtaccgttacctcgacctgcgtcgtccgtccatgcagcgcaatctgaagctacgcgcccagatgtcgaaggccgcccgccatgcgctggaggaaatgggcttcgaggagatcgaaaccccgaccatgatcaagtccacgccggaaggcgcccgtgacttcgtcgtgccggcccgtctggtgccgggttcctggtacgctctgccgcagtccccgcagctgctcaagcagctgctcatggtctccggcgtcgagcgttactaccagctggcccgctgctatcgtgacgaggacttccgcgccgaccgccagccggaattcacccagctcgacatggagatggccttcgtggaccaggaggacgtgatggccatggccgaaaaggtcatcgccgccatctggaagtccgccggctacgacatcaagctgccgatccagcgcatcacctggcaggacgccatggacaagtacggttccgacaagccggatctgcgtttcggcaatccgctgatcgaactgaccgattacttcaagaacacgccgttccgcgtgttccaggccccatacgtcggcgcggtgctcttcaagggtggcgcggccacgcctcgccgtcagttcgacgcatggcaggattgggccaagcagcgtggcgccaagggcctcgcctatgtggtgttcgccgagaacggcgaactcaagggccccgtcgccaagaacctgtccgaagaggaacgcaacggtctgaaggaagccgtcggcgccgaagacggcgacgccgtgttcttcgcagccggtcgccgcacctcctcccaggaactgctgggcgccgtgcgtgtcgagcttgcccgccgcgcgggcctgctcaagcccgacgatttcgccttcacttgggttgtggacttcccgctgttcaagccgaccgatgacccggacgacgacgatgtggcagtcggccactccaagtggacctccatgcatcacccgttcaccatgccgtccaaggattggatcgacaagttcgacaaggatccggaacacgccatgtccgattcctacgacatcgtatgcaacggcaacgaaatgggcggcggctccgtgcgtatccaccgcgacgacattcaggaccgtgtgcttgacgtgcttggcatcacgccggaagaggccgcagacaagttcggcttcctgcttgaggcattcaagtacggcgctccgcctcacgccggcatcgctctcggctgggatcgtaccgccgcaattctggctggcgccgactccatccgcgacgtcatcgccttcccgaaggctggcggcggccgcgatccgctgaccggcgctccggctccgatctccgctgagcagcgcgccgagaccggtgtcgattacgatccggatgaggacgaggactgatacggtttcgcccatagatgaatgaaaaatgtccgaacatcaatgatgctcggacattttttattattcgcgttgtctattttccgtcgctgtcattacagtggagcgtgtttgattatccggcaaccagaaagggttgaagcgcggtatgaaatcgaaaacacaggacaagaagcgactgaacacggtcggcatgcgcatatgcgcgctgttcgccgtgctcgccgtggtctttgcggcattcatgacgaccgttccgcatgcgctcgcctccgaaactggcaatccggcctcggtcaagggcaagacatataaaatcggcaccgacaccacgttcgcaccgttcgaataccgtgagaacggcaagatgaccggcatcgacatggagctaatccgaggcatcgccaaggaagagggctttaaggtcgagatacagtcgctgggattcaacgccgcgttgcaggccctaagctccaaccaggtggacgtcgtcatagccggcatgtccatcactgacgagcgtaaagcctcctatgatttctcgaatccgtatttccaatccggcatccagatggccgtcgcggccaacaacgacgacgtcaccggctataaggacctcaaaggccggacggttgtggcgaaaaccggctcggagggcgaatcgtacgccaaacagcatgccgacaagtacggttacaaggtgacttccgtcgaccaatcctcaaccatgtacgagatggtcaaatccggcaatgccgtcgcggtgttcgacgattatccggtactggcatatggcgtatcgcagaacaacggtctgaaaatcgtgactccgaaggtgccgcacggcgaatacggcatggccgtgaacaaaggcatgaacgcagatttgctggccgccatcaacgatggattgaacaagatgatcgcttcgggagaatacgagcgaatcgtcgcacaatatcttggcaagcaaggcgcgaaagagcaggccaaatcgatttccggcatgatcaccgacaatggcgacaacagcgctgaacaacagaaggtcggtttcctcggactggtcaaacagtcgatgccggcattgctgacgggcttgaggaacacgctgctgatcacgctgctttccttcgcgatcgcattggtgctcggcgtcgcgttcggcctgatgaaggtttcggaaagcaaaatcgccgcaggattggccaatgtgtacatcgcggtgttccgcggcaccccgatcctggtgtgggcgttcttcttctacttcggcgtgccccagctcatcggacatagcgtgaacatctgggtcgccggcgcattgaccttgtcgctcaactccggcgcgtacctggcggaaatcgtgcgtggcgcagtccaatcggtcgattccggacagatggagggcgcgcgttcgctgggactcaaccacaggcaggccatgcgccgagtgattctgccgcaggccagcaaaatcgccatgccttcgatcatcaaccagctggtcatcatgatcaaggactcctctctgctgctcgccatcggcttcggtgagctgctgtaccaggcgcagcagctgtacgcggcgaacttccgcgtaaccgaaacgctgctgatcgtcggcgtcatgtacttcgtggccatcaccatcctgacgtggctggccaacatcgtggacaggaaggtgaaccgatgaacgagaacgacgtgatcatcgacgtcaaggatctgcacaaaagctacgggcagaccgaggtcatcaaaggcgtcgacatgaccgtgcgcaaaggcgaggtgatctgcatcatcggaccgtccggcgccggcaaatccaccatattgcgttgcctgaacggactcgaacaggccaccggcggcaagatcgtggtcaacggacacgatttgacggacagccatgtgaacatcgaccaggtgcgcgagcaggtgggcatggtgttccagcatttcaacctgttcaacaacatgagcgtgatcgacaacatcaccctcgcaccgaaactggtgcatcatgaaacggatgagcaggcccgcgcgcacgccatggaactgctgaaaaccgtaggattggccgaaaaagccgacgccatgccgaaatcgctgtccggcgggcagaagcagcgtgtggcgatcgcgcgctcgctggcgatgaatccgaaggtgatgctgttcgacgaggcgacatccgcgctcgacccggaaatggtgggcgatgtgctcgaagtgattcgcgaccttgccgccaaaggcatgaccatggtgctggtgacccatgagatgggcttcgcacgcgaagtggccacgagggtcatcttcaccgatgccggcgtgatcgaggaagagggaacccctgacgagatcttcaaccatccgaagagcgaacgattgaagaccttcctctccaaggtgctgtgacattgctccggcggcgatccgtttgatgaatatgttcgtcaaacggtatgaaatgtctcatattccggacgaaatgatgtgaacgggcagtataggaaacatgaatttcgcattgctttcttatactaccctttatgtctgaaatgaaagaaaccgaagcgaagcgtcccatcatgccggacgcgggagcggataacaggccgctcgtcgaactgacccatgtcgagaagcattatggcgatctgcatgtgctcaaggacatcaacctcaccgtgcgcaaaggcgaggtgctcgtcatcgtcggaccgtccggctccggcaaatccacgatgtgccgcaccatcaaccgtctggaaaccatcgattccggcgatatccgcatcgacggcaaaccgctgccgcaggaaggcaaggaactcgccaaactgcgtgcggaagtgggcatggtgttccaatcgttcaacctgttcgccaacaaaaccattctggagaatgtgacgctggctccgatcaaggttcgtcatatggacaagaaggccgccgaagatcttgccatggatctgctgggccgcgtcggcgtggcctcgcaggcttccaaaatgccgtctcagctttccggcggccagcagcagcgtgtcgccatcgcccgcgccctcgccatgcagccgaaggtcatgctgttcgacgagccaacgtccgcgctcgacccggaaatggtcaacgaagtgcttgacgtcatggtcgaactcgcccacgaaggcatgaccatgctgtgcgtgacccacgagatgggtttcgcgcgcaaggtggccgacaaggtcgtgttcatggccgacggacagattctcgaacagagcacgccggacgacttcttcgaacatccgaagaccgatcgcgccaaggacttcctgtcgaagatcctcacccactgaagtgacggaacataacgacagaagaaggaacctgatatgaaaccactttcgatcacggcgaaacgcatgttgcgcagagccgtcgcggcattctgcgcgtgcgcgtgcgtgttcgcggtatccgcatgcggcgcggacgaaaccggcaagatccgcatcggcatcaaattcgaccagcctggcctgggcttcaagaagaacggcacctacgtcggcttcgacgtggacgtggccaagtacgtggccaagaaactcggctattccgaagacgagatcgtatggaaggaatcgccgtccaagcagcgtgaggctatgctgcagaacggcgatgtcgattacatcgtcgcatcctattccatcaccgacgaacgcaagaaggtcgtcgatttcgccggcccgtatttcgtggccggacaggatctgctggtacgcaaggacgaaaccggcattgacggacctaaggatctgaacggcaagcggctgtgctccatgaccggcaccacatccgccgtcaacgtcaaggagaagttcgccaagcagacccagctgatggaacagcccggcatggcggaatgcgccaccgcgttgctttccggcattgtggacgccgccaccaccgacgacatcattctcgccggcctcgcatccgcctcacgtggacgcctgcgcgtggtgggcaagccgttcacccaggagtattacggcatcggtgtcaagaagggcaacaccgagctgaagaacaaaatcaacaacgccatcaccgatatgattcaggacggttcttggcaaagggccatttccgacaacaccaggggagtggcctacacgccgaacgccaagtacaatccgccggtgccgaatggaaaggggaataagtgatggacggattcctcgcgttgttcagccaatacaacattcccggcgcgtttctggtgaacatcgagctgaccctgtggtcggcgttgttctccacgattctgggcgtcatcctcgtgatgatgcgcatttctccgatcgcctcgctccgtaccgtttccggtgcctacgtcgaactgttcaagaacctgccgctgaccatcatcatggtgttcatggtgctgggtgcgtacgcgcagctgaagttcagcttctccgacacgttcgccaccaacttcttctggctggccgtgacgggcctgagcctgtacaccgcggctttcgtatgtgaatcgctgcgctccggcatcaacaccgtgccgcttggtcaagccgaggccgcccgcgcgttgggcctgaacttcatgcaggccgccactcagatcatcctgccgcaggcgttccgcggttccgtggcaccgttgggcaacacgctgatcgcattgctgaaaaactccaccgtcgcggcggcggcatccgtggccaccgaaacctcgacgatgatgagcgaaatgatcgaataccacgccgaccaaatcgtaccgatcttcctgatcttcgccttcggctatgtggttctgatcattccgatcggcatgctgaccacgtatctgtccaacaagctcgcggtgaggaggtgacgcgacatggcaagcaatgaaagcgcggtgctgttcgaccagcctggtccgaagggccgcaaaaccatccgtatcgtcaattggatcgcaggcatcatcttcgcggtggtggtcgtgctgatcctcatgcgtctgcacaatccgccggacggcgagaaccagctgagctgggaactgtggaaaccggcgcttgacgccgaagcatggaccgacttctatctgccgggactgtgggccacgatccgcgcgtccgtactggccgtggtcggagccgtggtgttcggcctggtctttggtgtgggccgactgctgccgagcctgctgatccgtaccatttccggcgcgatcgtggaattcgcacgagccgtccccgttctgctgctcatgatcttcttctggcgctggttcgccttcgcaggtctgcccagccccgcgtatcgggcggtggtgctcgcgcttgtgatctacaacggatccgtggtggccgagctggtgcgttccggcgtgggcaacctgccgaacggccagcgtgaggcctcgctcgccttgggattgacccgcacgcagtcgctgttgcagatcgaagtgccgcaggccatctacgccatgctgccggcggccgtgacccagctggtcgtcgtgttgaaggacaccgcgctcggctcgatcatcatgtacactgacctgctgcaggaatcacgtcgactcggctccatgtatttcaacatcctacagacgctggtggtggccgcggtcgtctatttcatcgtctgctggctgctaagcagactggccgaatggctgccgtcgcgcatgcagcagcatacggctgcaccggccgaaccggaaccggtcgcgccgatcgccatcatggatccgtcgaacgtgaaccagatcgccgtggccaaggaaggcgtgccgctgggtggcgcgcagcgtgtctaccatgtgcaccatcgcggcaccaacgcgtccatccaccagtggcgtcagaccaggtacgcccaaggcttcgatgagacgcatccggaaagccaggtcaaattcgacaagaatggacatccgatcaaggacaatccgttcaagacgaagggcgatggcaaggacaagaacaagtccgaagccgacgaatagcaccggtatcgcataacacgcgtaggggtcgtttttccgcgaaatacggggaagcggcccctttcgtgtctacgatggactgcacgcatgtggtccgtaccaagcagggaggcttgacatggcggataaaaccaaggatgcgaaaaaagacgacgccagaatgtcgtcgatcgcgaaaacgctgaacaaagtggaagatcggctggaaaaaagcgagaattgcgattccgtcgccgaaggattggcgaacgccgccaaagcgagcgaactactgagctcggtatggacgttgccgccgacccagctattgcgattccatcacgacacgaaggtatcggacatagatggcgattccactcctggttttgacggcaacaaggatgatgccgaacgattcatatccatcagctcgtcggagatcgcccgttaccagcggcttatgtacgccaatggcgtgaaaggctcgcatcggcgactgctgatcgtgctgcaaggcatggacgcgtcaggcaaaggcggcatcgtacgacatgtgttcagccaaggcgacccgatgggcatgcactatcacgggttcggcgcgccgaaaggcgaagaactggaccatgactatctgtggcgcatcaaacgcgagctgccgaacaacggatggatctccatcttcgacaggtcccattacgaggacatcgtcatgccgcgcatctacaaaacgcagccggaagaaatgtggcaggcacggtacgacgaaatcaaccgattcgaatcgcaattgacggccgacggatgcgccatcatcaaaatcttcctcgtggtcagcaaagacgagcagaaacgccacttcctgagccgtctcgatgatccgaccaaatactggaagttcgatccgagcgaccttgaggcgcgcgcccgctgggacgactacatggccgcatggcaggatgtgttcctgcgcaccagcaccgagcaggcgccgtggtatctggtgcctgccgacaaccgctggtattcgagggccgtcgtctccgagctgctgcgcaacacgctcaagaacatgaacatgatctggccgccgctcgaagtcgacgccgacgaaatgcgccgtcagttggacacgctgtagtcgaagaagacaacctcgccgctggattgcgtggcgtccaggtcgacggttccggtgatggcccaatcgtggtcgccatcggaatcgtcgatgatctgccgcaccttccaggcgtgctcgctgttctctttgctttcgtcgaggatgaacagttcgccgctgcgtgccttcgcgtcgatgttgacgtattcgtgctcgtcgtagtaatcgtcgagcgtgtcctcccactcgtgcacgccgtagccccagtccttatcgagcgcgccgagctcgtccggcttgtcgaggtccatgagctgcacacggcggaacatggcattgcgcaccaatacggtgagtccacggcgatcctccaccacggcctgttttgcgccgggcgcggcaagattggcggccgcttcggacgcgtcggtatcggttccggcatgctcccattcgtccaccagcgaggagtcgatggaacggaccaccacgcgcagccaggagatgatgtcgtcaagctgctcgtcgcgcttttcctgcggaacggtacgcgccaacgcacggtaggcgtcggacaggtaccgcagcagcgtgccttcggaacgggcgatgttgtagcgggcgatgtagccggtgaaatcggaagcggtctccaccatgtcgcgcaccacggatttcgggctcagccaatagtcgttcgcccacggaacatcatggcggtattcatcgaacgcggcctgcagcatatcctccaacggcttcggataggtgatctcctgaagcctgtccatacgctcgtcatagtcgaggccatcctctttcatgcggatcatcgcctcgtcgcgcgcctgacgttcctgcgcgcgcagcacctgcttcgggtcctccaacgtggcctcaaccatggatatcacatccaacgcatacgtgtccgactccgggtcgagcagttccaacgcggccagcaggaacgggcttagcggctggtcgagggcgaaatcgtccggcatgtccacggtcatgaaataatccttgccgccatcgtcacggtcttcggtctcgatgacgttcgtgtcgaacaaggtctggaagatctcgtccgcgcgggcgtgcaggcgctccttctgctccggagtctgcgccgaatcgtcgataagccggtcgatgcggtagcgggcgtcgccgccctgctccacctcgttcaacaccatggaatgggtgatcttcatatgcggcaccagtgtttccggagccgcgtcgataagcttgtcgaacgtgttctcgttccacgttacgaaaccttcaggagccttcttgcgcttgatcttcttcagtttcttcggatcgttgcctgccttggccagagccttggcgttctcgatttcgaattcgggggcttcggctatgaccagaccctccgtgtcgaagcccatgcgtccggcgcgtcctgcgatctgatggaactcgcgggcgcgcagcttgcgcatcttcgtgccgtcgaacttggtcaacgcggtcaataccacggaatgaatcggcacattgataccgacaccaagcgtgtcggtgccgcagatcactggcagcagtccctgctgggcgagctgctccaccagacgacgatagcgggggagcatgccggcatggtggatgccgatgccggtacgcaacagacgctgcaggatcttgccgaacgcggtggtgaacttcgtgcccttgatggcttccgcgatcgcggcgcgctgctccttgctggacacgcccgtgctggccagcgcgttggcggtctccaacgcggcatcctgagagaaatgcaccacgtaaatcggcgtctcgcccttgccgaacgccaattccaccgtcttctccaacgggtcgagtgtgtattcgtacgtcaacggtacgggacgtggcgcatcggcgatgatatccacgtcggtgtccgtcatgtcctcaagcttgtcggcgattgcgtcgacattgcccagcgtcgcgctcatcaataggaactgcgtatccggcagcgtaagcagcggcacctgccaagcccagccgcgctcgggatcgccgtaatagtggaactcgtccatcgccacgcagccgacatcggcgtggcggccctcgcgcaacgcctgattggcgaggatctccgcggtgcagcagatgatcggcgcatccgcgttgatatgcgtgtcgccggtgatcatgccgacgttctcgcggccgaaaacttcaaccaagtcgaagaacttctcagacaccagagccttgatcggagccgtgtaataggaacggcggcccgtgcacaacgcggcgaaatgcatgccgagtgccaccagcgacttgcccgaaccggtcggagtgttcaaaatgacatggtcgccggccagcagatccatgatggcctcctcctgatgtggccacggttccacgcctttgacgtcctccacccaggtgaagaaacgctcatagatctcatccgtgtcgatgttgcgctcgccctcgtcccaattcggcgccaacgcgcccagcgagccataattcgtatcgtctgccatgcttgccagtctaccggttggggcgaacgcatgcatcgaacgtgtgttcgaattgttgggtgtgttgcggtacagtggaaagcatgactgacgatttgtttgccgcgatggacgcgccggatgatgtgacgcgcccgcttgccgtacgcatgcgcccagcgagcatcgacgatgtggtggggcaatcacgggtattgggggaggggtcgccattgcgcagactcgccaaccccgcttcgaaaggctcgctcaccgcaccgagctccatcatcctgttcggacctcccggagtcggcaaaaccaccctcgcctatatcgtcgccaaacagtccggccgtgtcttcgaggaactgtccgcggtcacctccggcgtcaaggacgtgcgtgacgtgctcaaacgcgcgcacgaacgtctcgtctccgaaggcaaggaaacggtgttgttcatcgacgaggtgcaccgcttctccaaatcgcagcaggatgcgttgctgcccagtgtggaaaaccgcgacgtcaccttcatcgcggccaccacggaaaacccaagcttctccgtcatcaagccgctgctcagccgatccgtggtcgtcaaactcgaatcgctggaaccggacgatctgaaaacgctgatcaatcgcgccatcgcaagcgaacacggccttgacaacgaaatcagaatcaccgacgaggctgtggatgagatcatccgcatggccggcggcgacgcacgtaagacactgaccatcctcgaagccgcggccggcgcgctcactggtgacaaagagcgcaaaaaaggcgcgaaacggcccatcatcacgcctgatgtggtgtcgaaggtcatggacgtggccaccgtgcgttacgacaaggacggagacgaccactacgacgtcatctcggcgttcatcaaatccatgcgaggctccgatccggacgccaccatgcattatctggcccgcatgctgcgcgcgggggaagacccgcgcttcatcgcacgacgcatcatgatcgccgcatccgaggaagtcggcatggccgccccgcaggtcctgcaagtcaccgtagccgcggcgcaggcagtggccatgatcggcatgcccgaagcgcgcatcattcttgccgaagcggcgctcgccgtcgccaccgcgcccaaatccaacgccagctacaacgccatcaacgcggcgctcgccgacgtggacgcggggcttatcggccaagtgccgctgcatctgcgcaatgcgccgaccgcgctgatgaaaagctggggcaaccacgaaggctaccggtacgcgcacgattggccgggcgcggtggcgccgcagcagtacatgcctgacgaattgcaggggcgcgagtattaccatccgaacgaccgcggttacgagcatgaggtcaagccgagattggagcggattcggaagattctgcacgaagaggacgataacggtgacggccgttccggccagcgcaatgcctgatgttcgtttcctgcaggcattgggtcaggggttccgctaaaattcttcgctggggttgacgcctgcttgctttgcaaggcccatgcgtcaatcgcggcgtcgcacatggccgcaggaaaaagtgcgcggaaagtgattatgaaagaacggaatacaacgctcgaaaccaccgaccataacaatcggaacaatagcgaaaacatcaaggaaacgccggacgaacgcattcccggcaaactcatcggcgccatcgtggcggtcggctcgctcgccttcatcggcatcctcaccgaaaccgtgatgacggtgctgttcccacagctcatgcgggaattcaacgtgaacactgctactgtgcagtggatcaccaccatctacctgctgacggtcgcagccaccatgccgctgtcgtcgtatcttaaccgcaaattcaagcatcgcgtcctgttcctcgccgcggtggcgcttgcgatgcttggctcgctgaccatgatcttcggccatgcgttcccggtgattctagtagcccgcatcatccagggcatcggctccggcgtggccacaccgctgatgatgaacatcattctcgaacagtccccacgcagcaaggtcggacgactgatgggcgtcggttcgctcgtcatcaccgtggcgcccgccatcggcccgaccgtgggtggcgcggtgtcgagcattctgccatggcgtgcgattttcgtcatcgtcattcccgtgattctgctgatttcgctgcctgtcggcctcaaatgcatcgaacagcaccgtccgacggaagaggcgcatctgaatccgctgcagttcgcggcgattgtgctggcgttgtgcggtctagtgatgttcctgaaccaggcgggcgtggctgttgccgccgccgtttcgggtggtgtggctacagcgccggcgattttcgcagtgatcagcctgatcgtcggcttgggatcgcttttcttcttcggatggtcgtcccgtcgttccttctcgccgctgattcgcttgggatggctgcgtgatccgatggtgctgctgcatctgatcgcctacatgctgctgccaatcgtcggcatcggcttcggctatgtgatcaccaatcttgcccagctttccctgggaacgaacgcgttcctggcaggcgcgctggtgctgccgggcgcgttgatcggcgctttcttcgcaccgatcggcggcacgctgtacgaccgtttcggccctgtccgcccgattctgggcgcgttcttcctggcgatctgcggcccgatcctgctgctggtcttctccatgcggctgacgccggccacgcttgccggtttctacttcatcttcggacttggctatgcgcttggcttctccaacatcatgaccaatgcgttgcgcagcattgcgccgcaattcatgccggatggcaacgccgtgttcaacacctgcctgcagttcggtggcgcagccggaaccgcgctgttctccacggtgctgtccgtggcccaggccggcgctggcaaggaaggaaccgaggcattcagccatgccacggcggttggcggcagttggacgttcaccgtcatgatcgtgattgtcgccgttgcaatctgctgcctgattaccgccttccgcatcggcgcgaaacgcgaataaccgtgttttcgccgtcgacttctccactgtgggcgcaattttgttccccgtcgcttcgaagcggtaggctgtgaaactatagagaacactggaaaaggagacaaggtgagcaaccttagtgcacccctgcccgtcatggctggcgaagacatgccggcaggacccaccgatccgattttcaaccgcctgctcaaggaccgcatcatctggatgggtgaggaagtcaaggacgagatggccaaccgcatttgcgcgcagatgctgatgctggccgccgaggatccgaaaaaggatatctggctgtacatcaattccccgggcggctccatcaccgcgggcatggccatttacgataccatgcagctcatcgagccggacgtggccaccgtgggcttgggcatgtgcgcatccatgggccagttcctgctgagctccggtaccaagggcaagcgcttcctgacctcgcatgcgcgtgtgctgatgcatcagccgtccggcggcatcggcggcaccgccactgacgtgcgcatcaacgccgagctgatcatggacatgaaaaagaccatgagcgagttgaccgccgagcagactgggcacaccgtcgaggaaatctaccgcgacaacgagtacgaccactggttcaccgcccaagaagcgttggagtacggctttgtggacaagctcgtttccacccacgacacgatgagcgccaccaagggagagtgaccatggcaagcgaagaagcacagtttgtagcccgcgccgaacgtctggccggaccgaccggtgtggtcggcttccagggggctgcggcgcgtgaggccgcgttcgcaccgcagaaccgttacgttctgccgcagttcgaggaaaagaccccgtacggatacaagaggcaggatccgtacacccgcctgttcgaggatcgcatcatcttcatgggcgtgcaggtggacgacacctccgccgatgacatcatggcccagctgctggttttggaaagtcaggatccgaaccgtgacgtgatgatgtacatcaattcgccgggcggttccatgacggccatgaccgccatctacgacaccatgcagtacatcaagccggacgtgcagaccgtatgcctcggccaggccgcctcggccgcggccatcctgctggccgccggcgccaaaggcaaacgtctgatgctgccgaacgcccgcgtgctcatccaccagccggccatcgaccagggcttcggcaaggccacggagattgaaatccaggccaaggagatgctgcgtatgcgtgaatggctggagaacacgctggccaagcataccggtcgtgacatcgagaagatccgcaaggacatcgaagtggacacgttcctgacggcccaggaggccaaggaatacggcatcgttgacgaggtgctggaacatcgcagctgagcctgcggtggaatgatatcttcacaaatgcaatacccctgccgggtcgcggcaggggtattgtgttttctaaacggcagatatgtgaaacgaagaggttgcgaatgggacgcgtggtcagctacaacgatgcggtgccgagatgcacgttctgcggcaagtccgagagccaggtgcgcaaactggtcaccggttcgggcgcggccatctgcgacgaatgcatcgaattgtgcgtggacatcatttccgaggaacgggacaaggacgcccagctcaatatcctgcaactgcccaagccggcacagatcagcgcctacctcgacaatcacgtcataggccaggagtccgccaaaaagacactttcagtggcggtgtacaaccattacaagcgcgtcaacatggaaatgcgcgagtcgtcgcgaatcggcaaggaacggatgcatggacatgacgattcgttcgagggcgtgcaagtggcgaaatcgaacatcctgctactcgggccgaccggcgtgggtaaaacatatctcgcgcagacgctggcccatgtgatgaacgtgccgttcgtcatagcggacgccaccacgctcaccgaggcaggatatgtgggcgatgacgtcgaaaccgtgctgcagcgcctcatccaggctgctgacggggatgtggcgcgtgcgcagcagggcatcgtatatatcgacgaaatcgacaagatcgcccgtaaaagcggcgaaaacacctccatcacgcgtgacgtgtccggcgagggcgtgcagcaggcgctgctcaagatccttgaaggcaccgtcgcctccgtgccggtggaagggacccgcaagcatcgtgaaatggaaaccgtgcagatcgacacccgcgacatactgttcatctgcggtggcgcgttcgtgggactcgccgacatcgtggcgcaacggttgggcgccagggaaagcggtttcggtgcggtctggcatgaccatgaggttcccaagcgtgagctgcttgcgcaggtctccgccgatgatctggctgatttcggattattgccggagttcatcggacgtctgccggtagtcagcgtgcttgaggaacttaccgaagacgatttggcccgaatcctcgtcgaaccggaaaacgcgctggtcaagcagtaccagaagctattcgccgtcgatggggtgacattgacctttaccgaaggggcgatacggcagattgcggcgacgtcgattcggcggggtacgggcgcacgtggattgcgttcgattattgagaagacgctggaggacaccatgttccgtcttcccagcatggaaggcgtcgaagaggtggtcgtagacgaagccgcagtcaccggatcgggcactccgaaactactcaaggtgtcgacgcagaaaattcctcgtctacgtgaggcgtaaggccgaaaactcctgcgacacgccgagattttgcctggagttcatttgggtgtatcttattcgagttgccgaaaacaagacaacgttgcgcgagtagcccagcggattagagcagctgactacggatcagcaggtcgcaggttcgaatcctgtctcgcgcaccagccaccagtcatcaggtggcgcaaagaaataagatgacgttgcgcgagtagcccagcggattagagcagctgactacggatcagcaggtcgcaggttcgaatcctgtctcgcgcacatgaacctccttcgcgaatgcggaggaggctttctttattttccatggatttttgtgaagcctgcaattgattgcgcgcacagcggagcgcaatatgcggcatggacgaacgccaagaccctccgatacacttaatactacgttttacggatactgcggtcgaacggggaccgcaagacaaggagcatgatggccacatcgaagaggggaacctgggcaacaatccgacgcatagccgcgtccgaccgcatatccggtctgattatgctcggtttcgctcttgccggcctattgctcgccaatctgccgttcaccgcgcatgcgttcgaacagcttgagaacttccatatagccattccacacaccaatatcgacatgggattgggccattgggtgcaggatggcctgctgacggtgttcttcctgaccgtagggctggaattgaagcaggaactcaccacgggatcactgtccaatcccaaagccgcggccgtgccgatgctgtgcgcggttggcggtatgcttgcgccgccggtactgttcatcggcgtgatctcattgttcgcggcggcaggatcagggcaactcgtcatcgcttcaggaacgtcgttctccttcgcacagatgtccaatggctgggcggtgcccacagccacggatatcgcgttctcattggccgtattggccctgttcgccaaagcgttgccgggatccatccgcgcttttctgatgacattggccacagtggacgacctgctggccatcatcctgatcgcggtgttcttctcatcggtgaacgcatggtactggttccttggcatagccgtatgcgcggtcgtctggtacttccttgtccgcatgcgcaaggtaccgtggctggccgtggccatcgtgggcgtgctggcatgggtcatgatgttcgaagccggcgtgcaccccactttggccggcgtgctcgtgggactgctcacgccggcgcatgagcgtttcggtgagaagacgccgcgtgcggaacgttacgccgacaagctgcagccgttctccgcactgctggcgttgccgatcttcgcactgttcgccactggtgtgcacttcgagtcgttgaccttggcgctgttcgtctcgccggtggtcgttgccgtgatggtggcgctcgtggtcggcaaacctctgggcatcatgaccaccgcatggctgtccacgcacgtgggcggtctgaagatggccaagggactgcgcgtgcgcgacatgttccccgctgcctgcgcctgcggcattggtttcacggtgtcgtttctcatcgcgtcgctggcgtatcaggatgccgaactatcggctgaagcccgtttcggcgtcctggtggggtccatggtcgcagccgtgatctcaggtattctgctgagccgtcaatccaaacgattcgaactggaggacggtacgaagcataagcatcataccggcgacgaagacgccatgaacgaagttgagacggtgctggaagacggtaccgtggtggtcagccagataatcggcacccaccaggaacagtaaaaggaatctccatatgttgaaagggccacgcatccccatgcatggccctttcaacatatgcgtgccattgcggcacggctgattaatctgattggtctatttcttgacggcaaccagcagaccagtgccggtcggcgtcaacgcagtgacgaaccgttcatccgactccaccgtttccagcaattcgcgcatcgcgatggatttggcatcacgattggcgggattcagcacgccgccggccgatgtggccgaatcaaaggcaagcacatcggtgaagacaatcgcggcatgcggtttcagcaggcgtggagcctgagcgaaagccgcagcataattctccgaatcgccggccacgacgatcaaatcgtaattctcggcgttcaggcggggcagaaacacacctgcggacgcgttcacggcacgcaatgtggtttcggtgtcatcggacagacgattgaacagtttgcgaatcagcgcgatgccctgcgtggacgaatcgacggccgtaagctggcctgcattgtcaagaccgttgatcagctgcatcgtctccaccacggaaccggtgccgatggcgatcaccgacgaggcgtccaacatccgcaccagcatgcgcagcaattcggcctgcgccgcggatccttggggaatgccggcttcctcggccgcggttctgatcgcattgagttcggcagactggcgtgagaacgcatgatcctcgacgtattcccacgatttcgcgagattggtatatgacgtcctatccatttcagcgctccttgatttgggcgatcagctgccagatctcctcaccgacatcgatgccacgcgggcattcacgcgtgcaggcgcgcaccgactggcacgcggcgatgccatcggcggaatcgatggcatccatacgtgcatccgtctgaccgtcgcgtgaatcattgatgaaacgggaggcggcgataagagccgcagggccgatgaacgcctcgccgcctgcatataccggacagcttccctcacaggtgccgcaggctatgcagttgctcagcagctcatacttggagagctgctggggattctgcagatattcgaatgcgttgatcttgccgtccgcggtggtggcgagttcgccactggcctgcagatacggcttgagcttcctgatttggccaagcatctggtcgatatcggcgatcaaatcacgctgcacggggaaaccgggcagcggtgcgagctcgatgacacccaaatcgtcggcatcctgcgtttgcgcgggttgaacgtcttctcccgtatgacggaagccgtcctcatccacctgtgcgtcggatggctgctttgcccaagccttcaccgtggcggtgcacagaagcgtaggcgtgccgttgatggacacggcatcggaaccgcacatgccatgaccgcacgaataacggaaggcaagcgtcggatcgatggtgcgcttgactttgagcaggcagtcaagcacggtgtcctccggacgcgccggcaccacgtaatcctgcacccactgcttgcctcgcggacgcctgcgcgcggatccggaatcgccgaagggagagctcttcctagcgaacggcgagccgcctcgttcacggccgcgttcgggacgcggcgtgaacctgttcacccgcaacgtcaccgtttccatgccgttctccatgccgctcatatacctgcctttcgataaaaaaccgtcaaccagtctgccatacgccgtgcccagggtgtcagtattcacgggcctttggcggcatgtccacgatgtgcaccggctgccaggagacctggcaggaaacatccgtcatggaatgggccaggaaatgctcgtcgtcacgctccgggaaatcaagacgcttcaacgatccacgggattcgtgacgcgcatcggaggcggcgagcacggccttgccgagctccaacagatggcgcacctcccagatggcggtgatttcctgattgaacgtgggggagtcggaatgcgcatgcagcgcctcggcacgcggcgtgagcgtatcgtccagcgtagccaacgcctgttcgatgctgttccggtcgcaacgcaccgcgaccgcctgctccatgacggatcccaaatcggccatcagctggtacggattgtccgacgacgcatcgtcgtcatcggacggccgcgtcaacagttccttgacctgcgcggaacgcttgtcggcagcctgcgacaccgcgtcgatagatgcttcgtcggcaggctcggccatcggatcgttcactggattatcgacgacacgttcagccatcgccttgcccgaacgggtgccgaagagacaggcgtccaacagcgagttgccgcccagacgattcgcgccatgcaccgacacgcaggagcattcgccagcggcgaacagaccgtccacgacggcgcgttcgccatcgacccaacggtagacttcgccgtcggtggtgatggggatgccgcccatggtgtaatgcgcggtgggtttgaccggcacatagtcgcgggtcggatcgagatcggcatactgttcgatggtctccaccacctgcggcagcacctcatgcatatgatccgcatcgatgccggtcatatccagccagacacaatccttcggcccatccggatccttcggatcggcgattcctcgtccggcgtcgatttcagccatgatggaacggctcaccacatcacgcgcggcaaggtcggcatgacccggcgcgtaatgttccatgaacgcctcgccatcggagttgcgcagcatgccgccttccgcacgtgccgcctcagacagcagaatgccggtatgggcgagaccggtcggatggaactgcacgaactcgctatcctcaagctgaaggccggcggacaatgtcaacgccatgccgtcaccggtcagatcccacgaattcgacgtggtatggaacagacggccggcaccgccagtggccatcagcacattgcgtgcgtggatggcatgcgtctcgcccttgtgcgtgtcgaacgccaccacgccctcgaccttgccgtggtcttcggaaaccaccagatcggtcacataccattcctcggcgaactcaacgccctcggccacgcactgctgccacagcgagaacagaatctgatgcccgatgcggtcggccgcataagcggcgcggcggaccggttccttgccgaaatccttggtatggcctccgaaacggcgctgcgcgatatggccgtcatcggtacgcgagaacgcgacgccggcatgctccagcgcgatcacagtggcaggagcctgttcggcaagcagcttcgccgcatcctggtcgacaagccagtcgccgcctttgactgtgtcatagtaatgccaatgccaatcgtctttctccacgttgccaaggctggccgcaatgccgccttccgcggagccggtgtgcgaacgcagcggctgcagtttggatatcaccaggacgttcggttcgatgccgtccgccctcatctggcgcatccgctcgctacggagcattcccaacgctgcggacaggccggccgcgcctgcgccgacgatcactgcatcatacatatcttcaacatgcttcggactcataccaccgattctcgcacaaggtgtgacctcgcacgttcgacgcggctgaggtggaggtgccgggcctgctatcgctgctcggcgatgatccatccggaccgcatgctgatgcggccttcaagctccaaggagcccagttcgcgcatgattcgcgagacgggatattctcccggatgcgtcttgtccattagatcgagcagattgtcggcggagacgtggccgtttgcttcggcgcaagttttaatggcggcgagtatggcatcgtcggattcatctgtcgattcctgcggatgttcggtgtcatccggcaggtcgacatgttgcgggcgatgcgcgctatggcatagttcgtcgatctccgccagtgagcagacgatggtggctctgccgtcttggataaggcgattgcagccggtgttatgcggcatggtgatgtctcccggcacggcgaacagattgcggttgagttcgttcgcccagcctgcggtgttgagcgcgccggaacgcgcacgtgcctgcgccacgatcagagtggatgacaatgccgcgatcagacggttgcgcagcaggaaccgtcttgcctccggcacggttccggggcacagttcggaaatcaaagcgcccgaatggctttcgatctgctcgaacaggttctggttgcttttcggaccgatatggttcagtccgccagcgaatacggcgacggtgcgtcctgccagcgcggcgctcatttcgtccatggctttgaccgcgccccaatgtgccgcggcgtcggtgcccagcgcgccgccggataccaccagatgtccggcacgcgccatccgaagggccaactcgtgggcgctttgcctaccgtagtcgcttacgccccgtgagccgacgatacccaccggctcggggcatgacaccagcgccttcggatcgcctttgccccataggcagagcggggaggcccagtcggtgcgcagtgaaaggtcgttcagttggctgggccaacaggggtgatgcggggcgatgatccactgcgtgccgtctgctgtgaaccagtctcgcaatgcgtccggatccttgctgggcaacgatgccagacgttgctgccatgacaccagcgagccatggaacgaagccatcccgcgggcgttgatggtgcgtccccaacgagtgacgccgttgatgaacgccgcatccaatgacgtgcaggccgcggccgtcacattttcgtgattgccagggccgctgtcagcgatcagctgtagcgcgcttgccgcggagccggtgcctttgaccagcgcgtacatcatcgcgtcggcgctgtccaggcagaaggtgagcaccgcgcgggccagggtctcgtcgtcgatcgtcaccatcatgccagcctcgttctcatggatattccctgcatcatttcctcaggtcctggggaagtctttcccgccagatcggataatgtccacgcaagccgcatggcacggtcggcgccacgcaggctcagccgctcgctcgccaaggcgcggttgaccaattcgatggccttgggggaggtgttggctctcagccaggtgctggtagcctgcgcgttgcagcaccagccgaattcgcggaaccgttcctgcgccatctgccgggcaacgatgacacgcagacgtatggcatggctcgaatcgccggagggagcgttccccggacttatccgctccaccggaggcacctcgatctggatgtcgatacggtcgaggatcggtccggaaagccggctgaaatacttgacgcggtccttttctcggcaggtgcagcgctcgccgttgccgtacgcgtagccgcacgggcagggattcgccgccataatcagttggaagcgagccggatagtatgtggtgcctttcgctctggaaatcgcgacatatccggattccaaaggttcgcgcagcgtctgcagcgtacgcgccgagaattccggagcctcgtccatgaacaggatgccgcgatgcgcgcgggtgatggctccgggctgggccaatcctgcgcctccacccaccagcgcggcggtcgacgcggtatggtggggcgcctcgaacggtggaacgtcgctgattccgtatccgggaagcgtgccgcataacgaacgaatcgaggccacttcaagctgttccgtctcgttcaaaggactcatgatgccgggaatgcgcgaagcgagcatggtcttgcctgtgccgggcggaccggtcatcatcagatgatggcctccggcggcagccacctccaacgcccatttggccgcttgctggcccatcacttcgctcatgtcgccgggcggagggcacatgcccgtggcgccgacatcggcgttcacggcatgcgtggcttcgggaatccggtagtccgcatcgcctcccatcagttcgatgagctctccgacatgcctcacgccgatcgccttgacatccggaacgagacgggcctcatcaaggttggcgtaaggcacgatgattgttgcgattccctgctcccgcgcatgcagcatgatgggcagcagtccgttgatgggcaatacggtgccgtcaagattcacctcgccaagcacgatggtgccggccagacagtcatgggcgattgcgccggccgcgctgagcacgctggccgcgatggccagatcatgcgaagagcctttcttcggcatggacgctggggagagattgaccgtgacacgggtttccggccatttgaaaccacttgcctggcatgccgacttgacccgttcgcgcgcctcggacaatgaggtgtcgggcaggccgatgatggagaaatagggaagtccaggggatacgaacgcttgaatctggacgatgaaggctttcaaaccgatcagtcctacggaaagggcgctgccgatggccatcagaacgctccctcgatatgatgcagcaaaggtctgtctccctgcaccacgacggtgacgacgtcaaaacgcacgccactgttcggcatgcggtgctccggcgccgtcagccattgcacggcggcatggcgcagattgatttgcttggaagcggtcaccgcctcctgaggggtgccgtagcgcatcgtacgtctggttttgacctcgacgaaaacgatctggcccatcggattgcgcgacacgacgtcgagttcgccgtatcggcaatgccagttgcggtcgagcgtccgccacccttggctttccaaccatgcggcggcgtactgttctcccagctcgccaatctgtcgggaacgcagcgtgccgtcatgcagacgccgcgctagggaatcgagaatctgctccggcggctgcgttggggccggaacatcatgtgatgatgaatggttcatgtccctagtccaacagacagaagccacgcatgacaaggccgataggctaatgtggataacttacgtatctcgggcgtgtcgtggatagtcggtggatgagtcgacgctatccacacctatccacaacacgatccaaggcctctgtgcgaaaagagtgaccgatgaaccgtcaacgacgggtcaaagcggtcaattcgtcgagattgagttcgaagctcacgcctcgttcctcatgattcggctgatactgggtgctttccatcgcatggcggacgaactcgccggcgatgttcgcggcctcggccagaggacggccagccatcaccgcgccgcacagcgccgacgcgaacgcgtcgccggtgccgtgggtcatgaacggcagcttggcatgcgccagctcctgttttccggcgacgcccgtcgaagctgacgccacatagttgcgaatcatgccatcccctcgatcgatgcccttaagcaccacgttcttcgcgccggcggcaagcaacgccccaagaatctcatccacctgcgcgtcgtcgatatcctggcctggatagtcacggcccgtcaaaatggatgcctcggtaagattcggcatcagcgcatccgcgccatccaccagcgtgcccatcgcccgacacagctcaggagtgtacgtggcgtagatttctccgccgtcgcccatcaccggatccaccaaccgcaaggcatgcggatactccgcgtataggcgtttgatgattgcgacctggtccgcggaaccaagaaaaccggaatagacgccatccaaatcgacgttctcctgacgccatgcgtccagatagccgtccagaatctcggtcgtatcgtggaacgtgaatacctcgtagcgcgtgtgcgcggaaaacagcgccgtcggcaccggacaaacgtcgcagccggccgccgacagaatcggaatggccgccgtcagcgaacacttgccataaccgcacatgtcatgcaccgcggcgacgcgcggaatataccgcggatcacggtcgtacagaatctcatcgctcatatcggaacctctcttgcgatttgcctgcccatgactttagccgttcccctgacctgacgcgcatccgttcctcacggtgggtcaccggcatgcgggacttcggcgtgtcgaatggttccgaatggttttttcaacggttgggggagtggggaaagccaatgattccaacggtttataaggggatataggcaagtgcgataacgttcggcttgcgttgcgctcgccggccggtttattgtcgctaccaacacctggccaagcgccctacacggcagggcgggtggccaaccaagacgagaacaacgaacccttatccaaggagagcgcatcatggcaaacaagaactatcgtttcgaaaccctgcagctgcacgtcggccaggagcaggccgacccggccaccgactcccgcgcggtgccgatctaccagaccaccagctacgtcttccacaacttcgaccacgccgaggcccgcttcggactggcggacccgggcaacatctacggacgtctgaccaactccacccagggcgtgttcgaagaccgcatcgcggccctcgaaggcggcaccgcgggcctggccgtcgcgtccggcgcggccgccgtggaatacgcggtgcgcaacatcacccagtccggcgaccacatcgtcgcagccaagaacgtgtacggcggcaccttcaacctgctgcgccacaccctgccgcgcgacggcatcaccaccaccttcgtctccgccgagaacccgcaggagttcgaggacgccatccaggagaacaccaagctcgtctacttcgagaccttcggcaacccgaacgccgacctgcccgacttcgaggccatcaccgccatcgcccacaagcaccacctgccggtgatcgtggacaacaccttcgcctccccgtacctgttccgcccgctggagcacggcgccgacgtcgttgtggaatccgccaccaagttcatcggcggccacggcaccaccctcggcggcgtgatcgtggaaggcggcaagttcaactgggccgaagtgccgggcaagttcccgaccctgaccgagccggatccgtcctaccatggcctgaacttctatgaggccctcggcggcgccgccttcgtgacccgcgtgcgcgccatcctgctgcgcgacaccggcgccaccctgtccccgttcgcggccttcctgctgctgcagggcaccgaaaccctgtccctgcgcgtcgaacgccacgtccagaacgcgctgaaggtcatcgactacctgaagaccgtgccggaggtcgagtccatctcccacccgtccatcgaaggccgcaaggacaacgacctgtacaagaagtacttcccgaacggcggcggttccatcttcaccttcgacatcaagggcggcaaggacgcggcacgcgtgttcatcgacaacctgcacctgttcagcctgctggccaatgtggccgacgccaagagcctcgtgatccacccggcctccaccacgcactcccaggagacgttggaggagctcgaggaccagggcatccaccagggcaccatccgcctgtccatcggactggagaacatcgacgacatcatcgaggacctcgaaagcggcttcaaggccttgcgcgaatccggtctggccaagtgactttggtctgaaacaactgtcgggcggtccgctgcaccatgagaagggggtgttgcgggccgcccgctttgcactgcgcttgtaacgcggatgggataaaattttcgcttgttgcgatatggtatgtcgcaatttgatacatcgaaagaaattccttgcgatttctttacaaatcgtaggaaaagcaagatgattttgctattttggtaaaaaagagagaagaagactgtattatggcgcaggacgtcaagaacgatatcaagaaagctattcaggtcaacaccatcccgttgatcgccatcatgaccgcggtcaccaccgtgctgaccatgttcgtgaagattccgaccccgacccgtggatacctcaacctgtccgacacgatgattttcttcagctcctatgcgttcggcccgtgggtcggcggcatcgtcggcggtcttggaccggcgttgtccgacctcatctcgggatacccgcagtgggcaatcttcaccttcatcatcgacggtctgcaggcggtgctcgtgggtctgctggtccgtgaattcaaaccggccaacgtcgtcatcggctctctggtggccggcgtgtggaaggtgttcggctacttcatcgccggcggcatcctgtccggcttcggtccggccctaggcgaaatcatcggcaactcattccagatggttgtcggcctgatcgttggcttcgcactgttctccgcagtgcgcaaggcttatccgccgctggtgcgactcggcaacctcagcgtcaaggccggcgagtgatacattattgtcttgcataaataaagcccgtgggttcaccgatgaacggcgattccacgggctttatttatacatattcgttcatatagtatccgtagtggctgtgttcgcggccggtgcaatgggctgatgtgctgaaagatatggagaagagcgcatgatcacggtacgtgatttgagttggcagtatgagccattggtggatggcggcaagccggtggatagcctcaagcatgtcagcttcgatatcaaatcaggctcgttcgtgggcgtcatcggaccgaccggcgccggcaaatccaccctgtgcatggctttggccggaatcatcccgaatctggcggacggcaccatgaccggactggtggaagtcaacggcatgaacaccagccgtcattccgtatcggcgttgtccgaacgtatcggctacgtgcagcaggatcccgaagcgcagctgttctgcgcgagcgttgaggatgagatcgcctttcctttggaaaaccgcggcatcgcaccggacatcatcgacaagcagatcgacgtcatgctcgatctggtcggcatgaccggctaccgcaagcgcgtgccggccagcctgtcgggcgggcagatgcagcgtgtggccatcgcggcggcattggcggcggaacccgacgtgctcatccttgacgaaccgactgcggcgctcgatccggaaggcaagcaggaagtcttcgatgtgcttgaacgcatccggcagacccgttccatgacggtgatcatggcggaacaggacacggagcatatcgcctattgggccgaccaagtattgttcatggtcaatggggaattggtgcgcaacggcgacgccagcctgttcgtccgtgaaaaaggactgctggaatcctccggcgtgcaggtcgcggacgatccgctgccgcaggtcaaggccgtacagcagggcaaaaagcataagaaggacaaaaagaatcagccggaacggtccaaggacgtggtcatcagcctggaccatgtctcctaccaatatgagcgcggcggcaatgcatcgaaagctctggacgacgtgacgttcgacatcgaacgtggctcattcatcggactcatcggacgtaacggctccggcaagaccacactcgccaaacatctgaacggactgatccgacccacgcagggcacggtgacggtggatgggctcgacgcctccaaacacagcgtcggcgaaatggcggcccacgtcggattcgtcttccagaatcccgaccatcagatcttctgctccaccaccaaggaggaaatcgcattcggtcctaccgcgcttggactggacggagccaccgtgttcaaacgcgtcgacgagatgctgacgctgttcgacctgcaccgttatgaagacgtctcgccggccacgctcggctacggcgaacgccgtgcggtggcgctgtcatccgtgcttgcaatgcgcacgccgatcctcgtgctcgacgagcctacggccggtctcgaccaccgtctcgcagcacgcttcctcggcaccatcgagaaactcaaccagcgcggcgtcaccatcgtcatgatcagccacgacatgcgcgcggtataccggtactgcacgcatgtgctggaattggaggacggaaaagtcgtgcagtatgggccgatcgacaggtccgaagcggcgcagaagcaatctcggaccatccgcaaaccgcgtaaatccaatgggcccgtttcggcgacgcatgtgctgctgaaagtcaccaagcatgaggaaggacgacactgatggacgccgatttgtatgtaccgggcgacggctggctgcatcgcgccgacccccgtgtgaaattcctcatcaccgtggtcatgttggtgttgtgcctggtatggcgcaactgggcgttcatacttgacgttctgatcatcgaacatctcatgctcatcaccgacggcgtgccgctgaaacgcatcggctgggtgtggaagatcctcgccgtgatcatcgtgttcatcgtggtgctctggccgattttcgacccatccggcacgcacgtgctgtggcagtggggatggctgaaactcacgcgagagaacctcgtcatggccgcggtgatgggattgcgcattccggcgctcggattcgcgtgcttcctcacgttgttcaccaccagccagaccaagctgatccgagggctcacctccctgggcatgccgtacaaggccggactcacgctcgccaccgcgctgcgctacattccggtgttcttctccatcttccaatccgtatcggccgcgcaacgggcccgcggactcgacttgaacggcaagaaagacgccaccggcaagaaacgcaacgtattcgtacgcttggtggaccggttcaaatcgtatctgcccatcatcatcgcggtgctgatccgcgcctacaaaatgagccaaagcgtcggctgggctatggaatcgcgcgggctcaacctccaaggcgtgagacgcacctaccgcatacagctgaagatgagactctccgattggatcatccttgcggtcactgccgccgcgacgacaggcagcatctggctgatgctgtggcagttctgaggtaggccaatgttccagaacgaacaacgcatcaccatcaccgcacgcgacctgaaagtggtctcggccctgcaatgcgacggccgcatgaccatgcaggcgcttgccgacaaggtcggcatttccgtatacgcggctacggaaagctaccgcaggcttacggaatccaacatcatgagcatcgtgccggtatgcaatccgttgaacctaggcaactacagccaggtgctggtgggcctgcgcatcaacggcaacctcgacaaggcgcttgccatgctcaaatccatgccgcaggtcacgtatgtggtctgcgcgttgggcgatgccgacatcatcgccgaagccgtcgtgtattccgccgaaggcatggaccatttccttaagcatgatctgcgcgcattgccgggattgacacgtctgcaggtgttctcctgcggacggctggtacttgacgaccacaacgtcagcgtggtcaaccggctcctggccgcgcatggcgagaccggtttcctgaccaaacgtgaggcgagcgttggcactggcattcccgcacaccgtctggatatgcgcttcgtgcgtacgttcaacgagttgcagcatgacggcagagccagctatgcgacgttgggggagcggcttggcgtgacgcataccgcgattcgtgggcgcatcaagaagctggaggaatccggcgtgatgcgcatcatggccaccgtcagccccatgcgtttgggtggattccgtcaagcgttcctcggcctcggtgtgaaaccgccttatcggctcgacaccgaacagctgctggcgatcgatgaggtgacgtatgcgatgagcggcgtcggattgaacggcgccgattacctgatcgaggtcatcgccgacaccgacgaggacctatggcgcgtggtggacgagtctattcgaccattgccaggcgtggagcaggcctggtgggcttccaccgtcagcgtggaaaaagagtcgtactggctcgaacctccgcaggatggtgtgctcctcgacgattgatgaatcaatggcatggggcgtctcatttttgctcattctcaaggatgagatgataattcagaccaacgcatgatattcgaatcagctgtttttccgtaattttggaggtaatccaaagaaaggaatgacagcatggatatcagggacaccatcaaagctaccaatacggccattgcagcagtggatcttgtgaaggactacggttccggaaataacacggtgcatgcgttgcgtggcgtcaacgtcgctttcgaaaaaggaaaattcacggcgattatgggaccgtccggttctggcaaatccacgctgatgcacactctggccggccttgactcggccaccagcggccacatcatgttcgatggcaaggacctgacccgtatgaacgatgaccagctgacattgctgcgccgtcaccagatcggcttcatcttccaaagcttcaacctgctgccgatgttcaccgccgaacagaacatcgtcatgccgcttacccttgccggcgagaagccggaccgccagtggctcaacctgctggtcgaaacgcttggactgaaggagcgtctgaaccatcgtccgaacgaactgtccggtggccagcagcagcgcgtcgccatcgcacgcgcgctcatcaccaagccgcagctcgtgttcgccgacgaaccgaccggcaacctcgactccgtgtccagcgcggaagtattgagcttcctcaaacgctccgtgaacgaactcggccagaccatcatcatggtcacccacgatgccgtcgcagcctcctacgcggaccgcgccatcgtgttcgccgacgggcagattgtggccgacgtcgaccagccaagcgccgagcagatgaacgatctgctgatgaaggagcgcgaatcggccacgcagaccatataccccgcccgccacgccggctgacgcatttcgtaaaacccgctttcgcaaaatgtacttgaagaaggaaaccgaactcccatgtggtccatcactttgaaactcatgcgtaaaaccaagcgcatgctcatccccgccggcatcgccatcctgatcggcacggcgttcatcgccagcaccttcctgttcggcaacgccatgggcgattcgctcgcccgacagatgaccgccatgttcggtggcgccaactatgccgccaccgcgaacgtcgatggcctcagcgataaggaaatcgacaaagcgtattccgtcaccgtcggcgatttccacgtcgaccagctgaaagccgtggaaggtgtgaaagccgtgcgcgtcgcgtcggaaagcgccgtcaccgtctccagcgacgacgacaacgtcagcggcgaactgatcaccggcgcatccgacgcgtcgatgctgccggtgcgcatatcgcaaggcagccagcccaaggatgccaacgaaatcgcgttgcctgagcagacggcgaaaacgttgggcgtgaacgtcggcgacacggtgacgctgacgtcccgatacgccacgaccgaaaccggcggtaaaaccaaagcgaacgacgtgcgcgtggtgggcctgaccgccgatccggaaggcgcgtactcgttctacggcggcgcgatcgtcggctcggacaatctcatcgcactgatgcaaggcgcggacgatttcaacgcggtcaacgccaccgccgtctacttcgatttcgccatggacggcaacaccgtcgccgcgaaaaccctcaacgacgcacagaaactgctgcccgcgcactacgaattgagctcgcgccagaatgtcagcgacgaggccgtcaaatcgttgggcggcaacggcaccaacgtcgtcaccatatttcttatgtgcttcggcatcctcgccatgttcgtcgccgcgctcgtgatcgccaacaccttccaggtgcttgtcgcgcaacgccgacgcacgctcgccctgctgcgcaccatcggcgcgaagaagggacaactgtaccgttccgtcctgttcgaagcctgtgcgctcggcctgatctcgtccgtgcttggcgtggcgttcggcagcctcatcatgtggggcatgtgcgccggcaacgtcatacggcagggcatgcggctcatcttctcctggcaggtgttcgtcgtgccgatcatcttcggcatcatcatgaccatgctcgcagccctcggctccgcacgttccgccacctcggtgaccccgctggaggccctgcgcccgatcgaactgactgacaccaagcgcgccggcatcgtacgcgccgttctcggcattctgatggtcgtcgcaggcattgcgatggcggtgttctcagtctggcgcattcaatccaccaacggcggacagacggctcaagccaacgaattcacaatggcggtgctgatcgccattgccggcgccgcgctcatattcctcggcatggtgctcaccgccgtcttctggctgcccgcactgatgaaaggcgccggaacgttggtgtcgcttgccgggccgtccgcgaaaatcgcgcacggcaacatacagaagaatccgcgacgcatcgcagctacaggcgcggccctgctcatcggcgtgaccttggtctccaccatcgccaccggagcggccagcgtcaaacaaaccatgaacaacacgctcgccacccgctacagcgtcgacgtcgtcgcctccggcgaagacctgacccaaggaatggcggacaaggtcgccggcatcaaaggtgtgaccgacactgtgtacgcgccggccgcatccgtgacattgaatggtacggacgctgccaaaccgaccaccgtgctgctcatcggtgtgaagaacatcgaccaggtcaagcatgtgatgcgcgtcgacctcggcgacaccagcctcagcgcggacgacgtgctcatgccctcatacaatgcgcagaccggcaagaaactcgccttcgccaacggcaaagccgagttcgacaccaccaggaataagaacggcgacatgacgcgtccgctgaccttgcatgtcacgcaacgcgactatcggcgcattttcgacagttacggcgccgtcggattcgtcgacgaacggcacttcgccaacggcgacctcgacaccacaacgcacatgctgctggtgaaagccgacaccgaccaatccggaacgtccgtgaacgacctgtacgacggcatccagtcggcattgtcgaagagcgcggacgcggcggtgtccggtccgatcgccgaacgtgtcacctgggcgcagatgatcgactccatgatgatgctcatggtggggctgatcgccgtggcggtgctggtcgccttgatcggcgtggcgaacacgctgtccctgtcggtgatcgaacgcacccgcgaatcggccaccctgcgcgccatcggcatgacccgcggccagctcagggcatcgctcgccatcgaagcgctgctcatctcgctcgtctccggcatcgccggcatcctgctcggcacattgttcggctggctgggcgcatacgtggtgttcagcctgtacggcaccgtggtgttccccttcgaatggggcgtcaacggcatcgtgctcgccgtggccgccgtggctgcgttgctcgccagcatcgcacctgcccgcagagcggtcaaagtaccgcctgttgaggcgctcgcagaagcttaggcgataaacggaatgctccttcgaaagaaggagcatttttgttgccgaatacgttttatgaagattttatacgagatggttttcgtaggcgaacacgacggcttggacgcggtcgcgcgcattgattttcgacaggatatgcgcgacatgcgttttcacggtaggcaggctgatgaacagcttgtccgcgatctcctgattcgacaggccatgcgcgatttcgatgagcacctcgcgctcgcggtcggtcagttcgtccaattccggatcggtgtacatagttgccgtcgaagcggaagcggacgttgcggaaacgggcgctgcggcggccgttcctgcgaaatcgccatccatcatcttctctataagccgtttcgtggcggatggcgcgatgatcgcgttgccttggtacacggtgcgaatcgaattgagcagcgtctccggttccgtgtccttcagcaggaagccggacgcgccggcgttgatcgcggccatcacgtattcgtccaaatcgaatgtcgtcagaatgatcacacgggtatgcgcatcgtcaagcgcgctgccatcgggtgcgaaacgatgctgcaacgcgctgatccgacgtgtcgcctcaatgccgtccataccgggcatacgcacatccatcagcaccacgtcgggatgcagcgtctccgccaaagccaccgcttccgcgccatcgcgcgcctggccgacaaccgccatatccggttgcgagccgatcaccatcgcgaaaccggcacgtaccaattcctgatcatcggcgatgaccacacgaatcttctgttcttcactcatactctccaccttatcggcatcgttccgctcacagcgcgaaacaaccccttaaatctccctgaaaaacttgaaccggctatcgagacgcgcgctgcagctgctcctccagcggtgctgcgggcctcaactgcagttcgctcgcgctaccggcatgagcgtcatcgctgaaaccagtctcacgaagcactccgagcagttcgcgcatacgcttaagcgcggcgcgcccctgttctccgatggctttgaacgctgcggaaatctcgtcggcagtaggctctttgccttgtgcttcggcagcgtccaacatgcggataccatcgacggcttgactaatcacgctgttcagcgtggcggtgacttcagcctgaatgctggcactgatacggtcgcgttccatattcgccgcgagaatacgctgcttctcctgctcggccaccagcgcttcctctcgcgcctgcaacaccagtgcgtttgaatcactggagcgagtccaacgcgcccatgccataatgccggcgcacagtatcaacaccgcaaccgtatacataacgccggtaaaaaacgccgcagtactgcttgacgtggctgaaaccggttttgtcaagcccacggaagcggcgatagcgtcgaacaaggtagcatatccatgttggtcggctgcgattttcaagcccatcagagctgaacaggtgacagcggcaagaccggtccaacgccatgcgtgttcacgcccatacaatacggctgaatacagtgcgcacagcgacgctacgatgtgcccgacctcaatcgatcccaaaaacaccaattgcacaaccgacaatacgaacacaataagcgcgcaagtctcggggaacctgcgtcgaagagccagcgccagcaagcagcatgcggcgatcgcatttgagagctgcgcatgaggtgaactatcaaaaaagaacgtaaccgacatgcgattcagcagcatgaccaatgccacggcaccaacggaatccatgagcgcataatggtgctgcgtccacgcggaaacgcgttccacccaattcagccctcgcgaattggatgtatttgcaagttctacggatttcagtttcaacgatttgagcaaatcatgcagattgggtgcggtgatgcgcaaatgttgcagggcattcgaacgatgatcgcgaccggtcggttggttggtttcctgcgtctgctccgatggctgatctgggattcgcgccgatatgttgacgactgtgtgaggtgcgattgcttcgtcggatagtttcgctttgctggatatggcagttgtgttgcaagattcggactgttccgaggcatactgttcgccggtttcttctgtcacctgttctttaccgccgtaaggcagggtggccatgacttcgaagcctccgccgagttgagggccagcctgcaacgagcctccggccgattcgatgcgttctttcatgcccagcaggccgtaacctggcgtatgcccgtcgatattggccgccgcgccatgaccattgtcggtgatggtcaaagtgagcaaaccgttgttccatgactctttaatatgtacatcgacgtgcggccccgcatacttgcggatattcgtcagcgcctcctgcactacatggtaggaagctatcgaggcttgttcgccgagttgttctgggctggcggtgccggtgatattccgtcggattcgaatgtcgggggagacgttttgcgcttgttccacaagattgccgatatcgttataatcggcgtgcggtgaacccccgaatactcccagaagacgttgcatgtcatgcagtgcgcgttccgattcgtgtcgaatcgtctccatggtgtttctggccaccgcgggatcatgcgtgcctgcatagcgaccgccatcagactgcacgatgatgattgacagggtgtgcgccaccacatcgtgcatgtcacgtgcgatgcgtgcgcgttccgctaacgcggcgatatcgcgttcattctggtctcgcgcggcgattgcctcattgcgttcccgcatcatgcaaacggttgccagacgggcacgctgccagaacgctacaatgacggtggaaataatgcatacttcgaaaatcggcgtcagtaccagcatgtattgcgccatcatgtcggcgacttccgacatggatgttcctgtgtagatggaaccgagagtgtctttcgtgaccataacgccatttggatttgggtcattccagctgctccatgtatgcactttgcctccggtgagcaatggtccattggtcatggtccatgccaccagcgccgaagccagaagaccgatgatcaacgccagaataatgaaggctttcgtgtttttgggattgccgtagatgatcaccgaatacagcatgaacaatgccagaatatcggcgcccaacaggcaagggccgaatatgagatgcgccaaggtcaatgccacgcagagcaacgctccggtctgcggccgccatcgacggatcagcagtggaataagcattgccgcttcccatgccatctgcgtggaaggcttaaggtcaaacagcaatcccggattataggtgatgccgccggtcacgccgaacagcagaacacctataacaagcgtgatgatgagatcgccggcgaaaacatggccatgcatccatgacaagagacgctgtttgaaattcgacatacgttccaccctagcgccagatatgctgtgacgccatcatgcgcaggaatgaaatagcggtaagataaagccgcttttgtgaggtaaggttgtctccgcatgtgggtgagatggaagccatcaaaaagtcactacccgaattgaacatgccgatgatgccaaagggaaggtgaatgcatgacgttgctgagcgaatactacgtgcccggattgcatattgaggatcgttccatcaaggtgccgttggattggacgggccacgagcctggtcatgggttcgatggcgaatcgatcagcctgttctaccgtgtggtcaccgctcccgaacatgtgcatgatgatcttccgctgctcgtgttcctgcagggtggtcccggtggttccggtccgcgtccgctcggtccaagttccgatggttggattgaggaggccatcaagcatttccgcgtggtgttgccggatcaacgtggtacggggcgttcgtcccgcgtcgatacgcatgtgattgagggcatggacggcgacggcaaggccggtgccgcgtttttgaagcgcttcctcgccgattcgatcgttcgtgacttcgagcatctgcgtcgtaccgaattcgggagcgcacgttgggtcacgcttggtcaaagctatggcggattcctgacgctgacgtatctttcgctgttcccgcaaggagtcatcgccagtttcaccacgggcggcattccgcatgttcccgccgatgcgaccgacgtgtaccgtcatacgttcccgcgcatggcggcaaagacgaagcagttctacgagcgttacccgatcgatatcgaacgcgccgcggccgtcgccgacattctgcagtcgcgcaaggtcgcattgccgaacggcgatccgctcacggtggaacgcttccaatgcttgggatccgatttcggcatgaagccaagtttcgaacgcgtgcattggattcttgaccaggcattcctcgacggcgacggttcggcctcaacctcggcggaactgtctgacgaattcctgtcttccgtgatgaatgcgacctcgtctcgcccgctgtattggccgttgcaggagttcatctacgccaacggtgagctggaaacgccgatttgctgggccgcccagcgcgtgcgctgcgagcatccggaattcgcgggtgacattcgtccgcttaatttcaccggcgaggccatgttcccgtggatgttcgagcaggaacgtgcgttgcgtccgttcaaaccagccatggacgtgcttatggaagacacgcatttcggcacgatctacgatgccgaccagttggcgcgcaatgaggttccgctgcaggctgccgtctatttcgacgacatgtacgtagattctggattgcagctcgacacgctgtcccgcgtcggtcgttcacattattggaccaccaacgaattcgagcatgacggcgtgcatggttccgtggtcttcaaacgcctgttcaacgaagcactgaacaggggagatctggaagaactgttctgacacagacaatccatccatatatcgatatcaaataggaaccgggaacaacaaggagaaaccatgtccaacccaaccatcggattcatcggatacggcaacatggcacaggccattgccgaaggacttgtcgcggcaggtgcaatcgacggtactgacatcgtggcgtgcgccgcgcattacgacaaactggagaaaaccacggcgaaggttggtgccacaccgctgcgcaccgctgccgaagtcgcagacgcggccgacgttgtcatcatcgccatcaaaccgtaccagatcgaaagcgtcatcaaaccaatcgccggcgcgctcgccaacgaaagcacattcgtcgtatccattgcggcaggctgggatctcgccaaataccgtgaactgttcggcgccgatttcggcgcgatgcacatccagtgcaccattccgaacacgccgatggccgtcggcaaaggcgtgctcgtcacggaaaccgacaacacgctgaccgacgcgcaaaacgagacgttcgaaaagctgttctcatcgatcagcctcatcgaacgcgtcgactccgcgcatatgggcatcggcatgtgcatcgccggctgcgcgcccgcattcaccgacatgtacatcgaggcgctcggcgacgcgggcgtgaaatacggtctgcaacgcgccaccgcctaccgtctggccgcaaagatggtggaaggcgtcggcgcactgtacctggccaacgaaacgcatccgggtgccatgaaggacgccgtctgctcgccgggaggcaccaccatcaagggcgtggcctcgttggaggaaagcgcgttccgtggtgccgtgatcaaagccgtcgacgccatcgaagcctaatactaaactaaggaaccatgtctcttactatcggaatcgtcggactgccgaacgtcggcaagtccaccatgttcaacgcattgacccgtaacaacgtactggcggaaaactatccgttcgccaccatcgaaccgaacaccggcatcgtgccattgccggatgaccgtctgccggtgcttgccaagctcgtgcacacggagaagatcgtgccggccaccgtcaccttcgtcgacatcgcaggcatcgtcaagggcgcttcggaaggcgaaggcttgggcaacaagttcctcgccaacattcgcgaagccgacgcgatctgcgaggttgtgcgtgccttcgaagacgatgatatcgtgcacgtcaacggcaaggtcgatccgtccgacgacattgaaaccatcaacaccgagctgatcctcgccgatctgcagaccatcgagaacgcgctgccgaagctggagaaggatctgcgcggcaagaagatcgagccggcctacatggacgccgtcaagcaggccaaggagatcctcgaagccggtgagaccatcgacaaggccgcccgcgaaggccgcttcgacaaggactccgtctacgacctgcacctgatgagcgccaagccgttcatctacgtgttcaacgtggacgattccgaactgcagaaccaggatctcaagaccaagctcgccgcctccgtggctccggctccggccatcttcctcaacgcgcaattcgaagccgacctgaccgaactcgacgaggacgacgcgcgcgaaatgctcgccgacgccggccttgaggaatccggcctcgaccagctggcacgcgtcggctacgacacgctcggcctgtccaccttcctcaccgcaggcgagaaggaagtgcgcgcatggcagatccacaagggctacaccgccccgcaggccgccggcgtgatccacaccgacttcgaaaagggcttcatcaaggccgatatcgtctcctatgacgatttcgttgccgccgaaggctccatgacgaagatcaaggaggaaggcaagctccgtcaggaaggccgcgactacgtcatgcaggacggcgacatcgtcgaattcaagttcaatgtatccaagggcaagtaaggttttcgtacttgtcgtatagtgcgtcaggcgctcggaccggtcggttcgggcgcttttcgcgtaaaagacttgtatatcgccgtttttcctgctaagggtggaaccatgagtacttcacgcgcggttcgtgacgcggccaacccgactatgacattgcatgactgtccgctgaacgcgcgcgttgtcgtggacggcatcgatttggacgatcggcatcggttccgcctgtgcgagatcggactggcgccgggcaccggtctgcgggtcgtgcagcggggcgcgttcggcggaagggtcatcgccttcggcaacgaacgcgtagcggtggatggtggtaccgcgcgcgccgtccgcgtacggtttgcgcaggactgggcagtacaggatagtgccgcgcaagacaagaccgcacggcatgaagagaacggaaacacgcacgaatgctgagtctacgaagcctaagaggtggtgattgctgccgtccacaggacgattgttgccggcattgcgattgccgtatgggaatgtccgcgaatgacggcacgcacggcaacgcccgcaatgatggaatcggcaacgacgaaatgaccagacgcgtcgtattcgtcggcaatccgaacgtcggcaaatcctccatgttcaacgcactgctcggcgcgagaacccgcacgatgaacgcgcccggcaccacggtgtccatcacctgcgggcaataccattacgaaaaaccgaaaacagcgggaaacgcgcaaaactggcagtttgtggacacccccggcacatattctctggcgccgatgagtcccgatgagcaggtcgccgtcaacgcgctgaccggcatgtcaggcatgcccgttcccgaccttgccgtcgtggtgctggacgccaccgcgctgtcccgatcgctgtacctgctgtcgatggtggtggagctcgggctgcccaccgtcgtggcactcaccatgaacgacctcgccgtccgcaacggctgcggcgtcgatgcggaacgactgtcccatttgctggacggcatgccggtcgtcgcgattgacggacgtaccggagacggcggcaaggctttggccgacgcgatcgccgcaagtttcgagggaacgcccgttccgcacgggctgaccgcactgccaaccgtgacagccgacgccgacatgaaaaccgccgacggcctgagcgtctgggccgaattgcgggccgacgcacgactcgattggaccgccggcatattgcgcggtctcgacatgcatgcggtcgaccacgtcaccttgtccgaccgcatcgaccgcgtgctgctgcaccccgtgattggcgtcctcgtcttccttgcggtgctgttcgtcgtgttccaggccaccaccacgctcgccagccccatgcaggattggatcgacgtgaccttccgcggatggtgcacagatggactcgacctgctgctcggcctgttcggaccatccgtgagcggcggctggctgcgttcgctgctggtggacggactgcttgacggcgtggtcaccgtgctgacgttcattccggtgatgggcatcatgttcctgctgctgtcaatcttggaggattccggctacatggcccgcgccgcgttcgtgatggaccgtgccatgcgcgccttgggattggacggtcgcgcgttcctgccgatcatcgtcggcttcggctgcaatctgccggctttggccgccacacgaaccctatccgattcccggcaacgggtgcttaccggcatgctggtgccgttcgcggcatgttccgcacgactatcggtgtttttggtgctcgcccacgcgttcttcccgaaatacgccggtctcgtggtcttcctcatgtacgtggcttcggtcatggtcatcctgctggtcggcgtgctgctgcgccacaccatgttccgcggcctcgaacccgaaccgttgatgctggcgcttcccgcataccaatgcccgcgcgcgttgcagctggcgcgttcggtactgctgcgtctatggggcttcatccgtggagccagcgtgatcatcatttcaatgatcacggcgctgtggctgctgcagggcattccggtaaccgccaacgcaggcggtttcgctcatgtcgacgacgtgcatgattccgcgtatggcgtgctcgccgacgcggtcgctcccgtgttcgcgccggccggtttcgacgactggcatgcctcggccgcgctgatcacgggattcgtggccaaagaggtcgtggtcggttcgatgtcgcagtcctaccatgcggacgaaccggatgatgcggcttcccaacaagccggggagggaacgctgggacagaagctgcgcgcctcgttcgaccagtcatcgcacggccacggcaaggcggcggccatcgccttcctgctgttcacgctcgcctacacgccatgtcttgcgacggtcgccgaaatgcgacggcagttcggcacgaaagtcgcggcgcgatccgtcctgctgagcttggccgtggcatacgtcatcgccatcatcgccttccaaacattgcggttgatatggtgagcggtatggaacggtccggcgcttccgcgcacggatggcggcgcacgccacgtacggctgatacatacggcgacggccggaacggtatcgtcgcacgcatcgccggcgacatcgccgcaggattgacggtgcggcaaatcgccgacaaacggcatctgccggtcgatttcgtggacatggctgtcgaacgcgcggacaaacgggggctgctggccgtgatggacatgcggcacgcctgcggagagacgatatgccagcccgatcctgcgtcattggtgtgcgcaggatgcccattcaggatattcccatcttcaagcccgtacaataggcaaggttaacaagacgaagaacgatgacagttatcggttcgcaaggggtgacacgtatggattatcagtaccagaccactgaacagccttccagcccccgcaaggcatggccgatcgtccttgccgtggtcgtggccctcatcgtggcatgcggtgccggcgtgtgcgtttaccgcaacaagcagcaggaagcattggccacatgccggcaatcgctcgcggaattcagctcggcccgcaaagccgtgctcgacacttccgaaaacggcagcgaactgcagaagctgattcgaggcgcgctcggcgtgaacgacatcatcgacgcgttcgcggacgcggccaccagcgccgagaacacagtcgatacggaaggctgcaaggcggaagccaccatcacgcagctcaatctcgtagccaaaacgttggacggcgccaccgattccctgaacgccagtctgaaaagcatccaagagaaaaacgccgaaaccgcgttgcaggatccgaaggccgattcggatggcgcggcagccggacaatcgtccaataacccatccgggcaatcgaacggagcctcttcgaacagcacttcttcgaacggcacctccgacacgaaatcgtcggatgaatccaaaaaggaactgcaacagtcgatcgacaaggcagacaaactggtcgacaaactcagcaaggacgattccctgaccctgaccggacgcaaactgctgtccgcgctgtccaaggccgcggactccggacagaagctcgtcgaaagcggcaacatcaaggattccaagtattacaaggcggccaaggtcacgcttgacgaagccattgacatggctgacaactgggtgaacagccaggcggccaaagcgcagtggcatgctcccgcgtgttgcttccgcagccacgtctaaagtttccttcggaaagcatgacgtgaatacgacgtcggatgtgtggaagcgtgtaaggggggggcggatggcagacgcggggcaggaatcatcggaaggcattagcgtatcgaagccggtcgcccgcgtgatgatgctggtcaacgcggcggtatggggatccggctacaccatgctcaagcatgtgcaggagaacatgccgacacagtggatgatgttcttccgcatggcttcggcggtactgcttatggccatcgtgtttttcccacgtcttcgcaggattcgcctgcgccgctatatcgttcccggtctgatactcgcgttgacttactggctgggattcatcttccagctcaaaggacttgaaaccacgtctcccggacgcaacagcttcttcaccgacacctattgcgtgatggtgccgttcgtggtgtgggcgttcacgcgcaaacgccccagctggcagcatctggtggccgcgttcgtctgcgcgttcggcattggtctggtgtcgctgagcggcggcggtggcgcggaactcatgcatatgagcttcggtgacgccatgactatcatcggcgcgtttttcttcgcgttgaatctggttttggttggtttcatcggcaaggatttcgacgcgatcgcgctgatgcttgccgaattcgtgtggtgcgccctgctgttcggcgctggcgcggtgcttaccgaaggcggaccgtccatggcttgggcgcggtgggacatcgtgctgtgcatcgcctacctggtggtcggctccacggtgatcgcccaagtgtttcaaaccatcgccatacagaatctgcccacttccgaggcgtccgtgatcttaagcacggaatgcatcttcgccatgctggtatccgtgattttcaccggcgaaacgctgaccgtgccgtcgttatgcggtttcgcgctgattttcggtgcgattctgctgtccgaaatccaactgccctccgcaaaacgacagcgtggcacaacggaaggcgattagaagaacagcgccgcgattcccgccgcgaagcacatgagcagcacggacgtgaggaagctcgccaggaacgccttctgtcccttcttcgcgatggcgctgaaattcacattgatgccgagcgccgccatggccatgccgagcacgatgtaggcgaagtccaccagattcggtgcgatggcgtcgatgaacggcacgaacgtgccgatgatggaagcgccgatgaaaccgagcatgaaccacgggaacgacactttgcgtttgccgtcggccggcatttcggaatggtttctgtcccaccagatggcgatgatgatggccgcgaacaccagcatcagcacgcgggaaagcttcatgatggtggcgatgcccaccgcgccgaacgcgtcgccggcggccacggcatgggcgatttcgtgcagggacgcgccagcggtgatgcccaactgcgtcttgctcaggcccgtcaacggcccaagggcgatttccagcaatgcgaagatggtgcccatgatggcgatgatggccacggccatcacctcattgttggccttctcatcctctttttccggcggcaccttgatggagccggacaatcccatgacggctgccgcgccacagatgccggtaccgcccgccacgagaatggcgagctgcggatcgacgccaagcttgcgtgcgatgttgtagcacaccacgatggtgagcgtcaccaccactgccgcgatcggcagacacttgataccctgcgtgaacagcaccgtcagattgagcttgaagccaagcaggatgatgcccaggcgaagcagcttgttcgaaatgagcccggccgcatccttcacaccggccttatgttcggcggaacggctcgaataccatttgcggatcgggaactgcgcgaccatgccgatgagcagagcgatgatcaacgcgccgaacaggctgaatcccggaaactgcttgagccacgaagccaccagagaggccgccaacgtgacgatgccaatgaacgccatttccttggtggctatgcgagtccaccatttcttgcaaaaatcaatcacgagcgtcaagtgttccggttcatgcggacaagccggccggatggggagacgcgcgcgggaatccatattttgcaacatatctcgaacgggtttgaggtctgtttgcttcaagtcgggtttaagttggtacgctggagatgcaagccaaaaacacaggcagaatcaaggagggtcaagatgcaattcgaagcctcgcgactggaaggactggaacaccgcaccgacgcgcagtccgcaccggaagtgttcttcacgccgatcatcacaccggaaagcctcgtcgccgcctaccatgcgctcggacgcaagccggaaggcaaaacggccatcaaagtccattccggcgaatcggaaaaatccaataatctcaatccttcgctcgtcaaggacctcgtgcaggagatcggcggcacgctcgtggaatgctctaccgcatacgacggcaatcgtgaaacccccgaaaaaagccttgccacgttcaaaaagcacggatacgccgatcttgcgccaatccagatcatggacatgggcggtgaaatcgagatcccggtggccaagcaccgccacatcgcctacgacatcgtcggcaagcatatcgacgactacgattccattttcgtgctgtcgcatttcaaaggccatccgatgggaggcttcggcggcgcgctcaaaaacgtgtccatcggcatagcctcgtcgaacggcaaacgctggatccattccgccggcgtcaccaaggacaagtgggtggaaactcctcaggatgcattcctcgaatcgatggccgaagccgatgaggccgtgatcagccacatgcatggcaagatgatgtatctgaacgtcatgaaccgcctgtcggtggattgcgactgcctgccctccccgacggaaccggacatgcatgacatcggcgtgctgtcctcgctcgacccggtggcactcgaccaggtatgcgtcgacctcatccacaccgaccccgacggagcgtccgtcaccgaacgcatcgcctcgctccacggcgaacacatcctcgaatacgccgaggaacttggcatcggttcgcgcgcgtaccgtctgaccgtactcgactgacggcgaacgcaatggtcacgaaacccgcgaagcctacggaagccagcatcgcaatcgcacgtatcgaaacgttgcttgccgaacgcgattgtgtgttcgtcgcaatcgacgggccatgcgcatccggcaaaaccacgtttgccgcgatgctcaacaggcgtttcggcggcaacgtgctgcacatggacgatttcttcctccgtcccgaacagcgcacgccggaacgtttcgccgaacccggcggcaacgtggaccgtgaacggttcgaaacggaagtgttggcaccgctcgccgccggacaagccgcgcaataccggccatgggattgccatacaggcgatttcgccgtcgcgtacgccgtcgaaccggcccagctgaccattgtggaaggcagctacagcatgcaccccgccttgcgggggtattacgattgcatgatctgtcttgcggtcgatcctgccgaacagttgcgtcggctcgaacgacgcaatccacgcatgttgcaacgattcgtcgacgagtggattccgttggaaaaccgctatttcgaagcgaccaatatccaagccgtcgccgatttgctggtcgacaccgcgctgtcggacggtgggtcggtcgtcgagccggccaatacgtgacatatccgcatatccggaagaaaagaacaaaaatcaaggagaatacaaaatgtctgattccgcaaccatgcccgcggccgccctgcgccgcaccgacctgccgaaactgagtctcggcaccaagacagcagccaccctgctcgccatcgtcgcagcggtcgtgctgccgcaactgttccacgtcatcggcgccgtctccggacagggaaccatgttgggcgtcgcgttcctgccgatgcatctgccgatcatcttcgtcggcctgatcgcgggccccgccgtcggcgcgatcgccggcgccgccgctccgctcgtgagcttcctgctgtccggcatgccgatgctggcgatgctgccgctcatgatggtcgaactgtgcgcatacggcctggtggccggtctgctgcgcggcatcaagctgccgagcctggcgaaggtggtcatcgcacagctcgccggacgtgtggtgctgaccgcagccaccgcgatcgccgtgttcgcgttcggttccagcaaggccatcgccgccacatggacgagcgacctggccgccggcctgcccggtctcgcgctgcagtgggccctgattccgctcgccgcctactggaccgagtcgctgatcgccaagcgcaaccactgatatgacgtttgcccggccacgttctgggcaaacgcgtgatatgcgggagccgagccgttaagcttggctcccgttacttataggaggactacgtaggagttttacgaaggggaagcagtcatgatcgcaggagtgtccatcaccactttgctgctggtgctcgcagccggcatcggggcgggattcgtcggatacgcggtaggcgcgtcctcgctgatctcctatcctgcgctgctggcgttcggcattccgcccgtgctgtccaacaccacgaacacggtgggcgtatgtggcaccggcattggcggcctgctctccgcccgcaaggagctcaaaggccaaggcagacgcgtggccgtctacgcctgcatcggcctggtcggcggcatcatcggcggcctgctgctgctcgaactgccggcgaaggtcttcgaattcgccgtgccgccgctcatcctgttcagcgcgcttatcatcgcgctcaacccacgtaagaaagccgccgcgcgcgacgccgtggcgcaggcgctgccgcaatcgcatcaaggtgagcgggccgcacgaatcgccagcaaaacggcggacggcacattgcgcaacgatccatggtggctgtgggcgggcgtgagtttcgtcggcgtgtattccggctatttcggcgccgccgccggcacgctcgccctggccatcctcgacttgggcaaaatcggcccgttccaccagatcaacgcgttgaaaaccgtggtcggtttcggcgcgaacatctccgccgcgatcatgttcatcatccgcggttccgtcgattggccgttcgccatcatgatgtgcctcggctgcaccatcggcagcgcgatcgcaccgcccgtcacccggcatattccggagaacatcatgcgtgccgccgccgtgctgaccggcatcatcctcgccgcgaaactcggctggagcacctacttctaaattttctaaaataagatgtgcggattgccggaatctaagcgacagggggagaaacatggcggttgttgacgaggcgaaactgcggtatctcgactttctttcgcgtgaggaccgagtacgccaccaccggtacgtcgaggaaatgaagcaatacgacatgatgcgttccggcgacatcaacgccatcgccgaaagcacacgtctgtggaactccggactgtacggctacctgtcggacgatccgctcaaaaacgcgaaataccggttcgtcaccaccatcacgctcgccacacgtttcgccatcgaaggcggtatggacgaggaggacgcctacaacgcctccgacctgtacatccagaacctggaaaactgcaaaacgcccgacgacgtgcgccgcctgcacaccgacatgatgacattcttcacatgggccatggccgacatgcagaaggcggaaacacattccaaagccgtcaacgaatgcctggactacatccactaccatctgcatgagaaaatcaccgtgcccatcctcgccgagcatgtgcatctgaatcccacgtatctgtcggagctgttcaaacgcgaaacgggcacggccatatcgcaatacatcaccgacaagcgtatggaagcggccgagaacatgctcaaatactcggaatacagcttcgacgagatcgcccagatcctcgcataccggtcgcaaagccacttctcgaaggtgttcaaaaaacattccggcatgacgccgggggagtaccgcaccaagtacgcgcagaacggcatctggccggagtgattgcgatcacggcgtctaccacgccggttgcggtgaaccgccggtgacggcaccgcgaaattcgggtgtgccaatcgtgaaatcgacgtgtccgcgcgtgcgaaacacgcgcgaatcagctacggtggaagcattcaatgatgatgcgcgccaccggccgaatgaacggcggaacaaggaacgtgcgcgcaggatgtggatgaaagcgaaggaataaacggatatgggaatgccccttgatttgtatgtgattcgacatggcgaatccgaagcgaacgtgattatcagtgccggtgaacagggtgacaactcgctgtatacgcaggacaacgtcaccgtgcccgaccgttcgtggaggcttacggccaccggccgcaagcaggcggactgcatcggccgctggctggtctcacagcagccgttgttcgaccgctacctcgtttcgccgtacgtgcgcacgcgtgagacggctgccacgatggccctgcctaaggcgaaatgggaggagacacgcgtgctgcgcgaacgctcctggggtgagatcaataccatcacgaaagacgatttcaaaaccaattacgcgcgcaactggatgttcaagaacactgatccactgtattggcgtccgccggcgggcgaatcgatcgccgatgtggccgaaaaccgcgtgcataatctgctcacatccctgaaccgcaagtcggacgcagaatccgtggtgatggtcagtcacggcgacctcatgctggcgcttatgctcactttggaggacttgtccgacgaggaattcatgcaccgtgcggcgtccgacgaatggaagatcactaattgtacgtgcttccattattcgcgccgtgatccggcgaccgggcgtacgcataagcggttctgttgggagcagaccgcccgcccggtgttcgacgatgcggaaggtcgttgggcggtgaaagtggacgattggcgtgaattcaagcgtccagtgctgtcgaatggcgatttggtggacgttgttcatgcggttgaccgtcacttgtgatgtgtgttggtctgttgattgcatgatcggattggctgatatcgacgattgatgcccccatctcgcgtgcgcaacgcgcccgtgtccacgccccactacaatggctgtgacacgcggcgcgtttttgcttgccgcgcaagagagttaaggagacaatcgtatgtccaatctgttcacgtggaagctccacggcgacggcaaaacgctgaagcccggcgaggtcgtcgaacctgacgagaggctgacctggccgcgcaccgcggaaatcggcgcgcagcacgtcatcgccatgttcggcgccacgttcctggtgccgattctgaccggtttcgacccatccaccaccctgttcttcacggccatgtcgaccgcgctgttcctgctgatcaacaagaacatgctgccgagctacctgggctcgtccttcggcttcatcgccccgatcgcggccgtcgccagcgcccacaagggcctcgccgtcgcatccttcggcatcatggtcaccggcatcctgctggccctgatcggtgtgctcgtccattacgcgggcgccaagtggatcgacatcatcatgccgccggtcgtcaacggcgccatcgtggccatcatcggcttcaacctggctccgagcgtgtggaacaacttcaaagtcgctcccgacaccgccatcgtcaccctcgtcgcggtgctgctcgtcgcagtgctgttcaagggtctgctcggccgactcaacatcctcatcggcgtgatcatcggctacgcgtacgcctgcttccgtggccaggtcgacttctcagccatcggcaaggccgcatgggtcggtctgccggaattccgtctgccgcaggtcgacttcaccatcctgccgatgttcatcccggtcgtgctcgtactcgttgccgaaaacgtcggccacgtcaagtccgtctcccagatgaccggccgcgactatgacgaccagatcggcaccgcgctgttcgccgacggtctcggcaccaccatcgccggtttcggcggcggctccggcaccaccacctacggcgagaacatcggcgtgatggccgccaccaaggtctactcgaccgccgcatactggtgcgccgccgcgttcgcgctgatcctgagcctgtgcccgaagttcggcgccatcatcaacaccatccccgccggcgtgctcggcggcgtgaccaccctgctgtacggcatgatcggcatggtcggcatccgcatctgggttgagaacaaggtcaacttcgacaagccggtcaacgtcatggtggccgccatcaccatgatcatcgccgtcggccagttcgagttcgccttcaacggcatctccttcaacggcatcgccatcggcaccgtcgtcatcctcgtcgcctaccacggcctgaaggccatcggcaaggcgaccggcaccatcgccaaggacgatccggacatcctgtaacggatcgcatctcacgctggctagttcaacgcccgtcggccaaaaaggtcggcgggcgtttttcattgccgttttcgtcaatcgattgacgtgttgcgtcgcatacgttttatgatggtatctgtaagcgattgcgcaatgtggcaaaggaggcaacatgagcactgcggcaggaaagaaaatcgcgattgtgaccggttccgcgcttggcttgggatatgagctggcacgtcagctgatcggcaaaggctggttcgtggccggcatcgatttcaacacggcccgtcaggaggaactgtcccgcacgttcggcgcggacgaataccgcgccttcgtcggcgacatcagcgacgaggcgttcgtgaaggactccgtcgcggccatcaaggagatcggccacatcgacctgctcatcaacaacgcgggacagccgtcgttcaaaaagccggtcgactacgaggccgccgacgtggacaagtgccttaaggggctcaaaggcatgattctgtggagcgtcgaaacattgaaggccgacggcgagcaggacctcaaaatcgccaatgtcatgtccaccgccgccacacgcggcaacgccaacgaatccgtctactgcgccaccaagtggggtgagaaggggtatacgacaagcctcaaggcggcctacaagggaaccagtgtgaaggttgtgggcgtgtatccgggaggcatcgacaccgacttctaccatgacagccacgattacgtgtcgttggacaagcagcattccttcatgagcgccgcggaactggccgaagtagtgctattcaacctcgtcaacgacgcgaatctgacggtttccgacatcctcatcgaacgcaactaccggtagcgtcggccaccagtcacagccaaggcaaaagtatcgggcatgggctactgttaacaggtttgcgcaacgtgcgcaatgtttgacatgaaaggccattgtgcccgataccgctgtgattgaaaatgaagatgccctcgccgccgatttcgatgaggcgggcgaggaggaggaacgcccccagacgttcgccgaactcggcgttcccggcccgttggtacgcgtgctcgcggccgatggcaagaaaaccgctttcccgatccaggccgacacccttcccgattccctggccggtcgtgacattctcggccgaggccgtaccggctccggcaagaccctggcgttctcgattccgctggtcgcgcgactgggtgaggtcgacgccgacgagtacgagaacatgagccagttccgccatgaggtggaacaggtgcgcaaggggcatgccgaggagcggcgcgccgacgatttcctgccgcacccgcgcggcctggtgctcgctccgacccgtgagctggccaaccagatcaacgacgtgctgatgccgctcgcgcagatgtacggcatgaccaccaccaccgtgtatggcggtgtgcgctacgcccgccagattcgcgatctaagggctggcgccgatatcgtcgtcgcatgcccgggccgtcttgaggacctgctcgaacagcatgcgctgaccttggagaaggtcgaagtggccgtgatcgacgaagccgacgaaatggccgacatgggcttcctgccgccggtcaagcgcctgctcggccaagtgtcgttcgacgcgcaggtcatgctgttctccgccaccctcgaccatggcgtcgacgaggtggtgaacacgttcctcaccgatccgaagatccacagcgtcgactccgccaccgcggccgtcgacgaaatgacacaccacgtgttcgaaaccacgcagggcgaccgtcatgagctggtccgcaccctcgcttccggcaagggacgccgcatcctgttcacccgcaccaaattccagacccagaagctcgccaaggacctgacgaagaacggcattccggcggccgagctgcacggcaacctgagccagaaccagcgtgaccgcaatctcgcagccttcgaatccggcgacgtgaacgtcatggtcgccaccgatgtggccgcccgcggcatcgacgtgtccggcgtggagctcgtggtgcaggtggagcctccggaggacccgaaatcgttccttcaccgctccggacgtaccgcgcgagccggccattccggtgatgtggtgaccatcgttctgccgaaccagcgccgccgcacccgccgcatgctgcatgaggccggactgaaggtcaagccgatcgaagtgacccacgattccccggaagtgttggaattggtgggcgagtcggccgaaccgcgtttcggttggacgcttgagcagtcccagccggcgggcaatccgcgtcgcaggcatggcaagggcggcgacggtttcgcggaaaacggtggacgctccggacgcaaccgttccggtggacgcaacaaggaccggggcaaggacaagggcggcaagccgttcaagtccgaacgcaaggaccgcgcgaatcgcaagggacgtgaagagcgcgccgaagtcgccgaacgcgagcagcgtttcgaaccgaaacagaatcgcgccgaacgtcgcgccgccaagttcgaaggccgcgacaaccgcgaatacgaggcacgcgagcatcgttgggaacatcctgaaatccaagaggagaagcgcgagaagcacgaggagaagcgcaacaacaagcgtcgcgaaaagtacgcgcggctgcatgagcagcagcgtgccgaagccggcgaacagcgtggaaccgacaatcgcaagcggcgctccgtcgagcgttccgatcagcgtggccaatccgataggaagcccggcaaaaagcagtatgcgaaaaagcagggcgcgccgaccaagaagcagcgcaaggccgaagcccgtgccgaacgccgttacgaggacgatcgccaataccgcaggaaccgcgacgaacgcgacgaccgccgtcagggcggcaaacgcatccatcgcaaggaaatccgcgtgattcatgacgagcgtggcgaggacgcgaagcgttatgaccgtcgcatggaagccaagtatggcgattccggtcgtcgtggcggtcacggagaacgccacgacaagcatgcgggcgaaaggcagggcaagccgtaccgcaagcatgcgaagatccgcaaggcgccgttccgctcccgctgacgtacgtcaacggtcaagcaaaaagccgttcattccagcaatcgcaaggaatgaacggctttttctatacgggatatcgcagtatcagccgttgaccggctgatactggtcgagcgcggtgaagcaacgtttatagaccatcagcatgatgatgctgtccgccagcagcgtaagcgccgcgatggtggcgagaatcatgaactggtatttcgccgcgtcgatggggttgccgccggcgatgatctgaccggccatcatgcccggcaccgccacaatgccggcggaggcgagcgacgcggtggtgggcagcaatcccagacggatcgacgagacgatacttggacgtgccgcctcccacgtggtggcacccaacgccagcagcgtgtccacttcgtcacgacgttccttcatgctttcaaagaaccggctcaaccccaccgccaacgccgaaacggtgttgcccagcagcatgccggtcaacggcaccaccaattgcggcgcataccacggttgcggacggatgatgagttcggtgaccaacgagatcatgatgagcatggtcacgaccagactcaggaacaccggtccagccaagcccttcggcacacctttcgcacgcgaaagagtgatctgcacggccgcgatgagcatgaacgccacaagcagcagcaccagccacggattgttcgaacggatgacgtactccatgatgaagcccatcgcgcacaattgcagcagcgcacggcaagccgaccacagaagcgtgcgccccacgcccatacgcatggtttcggagatgccggcggcgatggccaccatcaccagcgcggcgatgagaccccagatgtcgatcgcatagtagttgccgttcatgcgacgctcccttctaccgtgttacccgtcgaagtactacccgtcgcagtaccgtccgcttcggcgttgccggactgcgtgagcgtgccatcggcaagacgcatgacacgtgtggcacggccatccggcggccggtgccggatacgaacgatcgccatgccgtccgccgccgctttggcgaggatgcgcgccactttctcggcgttgtcgtcatccaatccggcgtccacttcgtcggcgagcagcaccttcggacaggtcagcaacgtacgcgcaaggctcacgcgcgccgcctgaccgccggacaagtcgtgcggcggacggttcagatcgatgtcggcacagcccatattgtccaaggtttcacggattctgccgtccggcaacgcatcggtgggggagattctgcgcggcccctgcttcgttctcgccgactggcgtatggcaagcgtgaacggcagacgaatcgcctgcgccaccgtctcgcccaacagcaccggcttctgcggcaggtacgcgacctgcgcgcgccactgctgcggggtgaaatcgtcggcggaacggccatccaaccgtaaatcgcctgacgcgcgcggattgagccgtgcgaaagcggtcagcagcgagctcttgcctgcgccggacggtccgaccaagtccacgatttcgccaggctcgatggcgaaggacaatccggagaatatggtgcggcgttcgccgtcgaccataatcgaacagcgcacgttcgatgcttcgaatacgtatgtcatagccaaaaccatacgccaatagcgaacggttcacggcggtttcagggttttccctgagttttgaggcgaaatcagccataaggatgacgcgtgcccgttattttgcgtactacaactgtcaagttgaaggaaaacctatatgttggggatgggaaagatgcgtcagtggcttatgaacataagcctggtcggaggctggtttccggcggcggcgttcgccgtcgtcgcagtgctgtccgtaaccctgctggttagcgcggccgtttcgaaacgggacggacgcatactggctaccgtgctgccgatcggcgttgcggccgtgtccggaatgatcggctatgtggtagcttggctgctgtccgacgtgttcgtggtgttcggcgtcggattgggatcccgtgtgatggcttgggtggcggctggtttcgccatcgctggtttcgccatcgcgcatatcgtgttgagcaggggcatgatgcgcgtggccgcggccatcttgaccgtattcgcgatactggccgcggcgatcggtatcgaccaatcgtacggcgaatacgccaccatcggctcgctgttcggcgaggattcctacagccaagccgatctgaccggactggccaaacgcaaggacctcatcaccgtcgcacagtggcgcaaacaggccgccaacggcacaatccgcaatattccggcgaacggaaccgtcaacaaaatcgacattccggccacgaaatcgcagtttgaagcacgcaaagccctcgtctacctgcctccggcggcattggccgactcgaaacgcaagccggccctgccggtcgtcctcatgctgagcgggcagccgggcagtccgggacgcgtcttccaagccggcggcatccaaaccatgatggacggatatgcgaaaacccacgacggactcgccccaatcgtcatcgcagccgatcagcttggcgccgattcgcacaacacgctatgcgtggattcgaaggtgtacggcaatgcgctgacctacctgacgcaggacgtggtcgactgggtgaaaaccaacctgcccgccgcacaggatgccaaggattgggccatcgccggattctcgcaaggcgccacatgttcgctgcagatcggcgtgaaccatcccgacctgtttggcaccatgattcccaccgacagcgaaatcaaaccgaccaacggcagccgacaggaaatgatcgaccggttcttcgacggcgacaccacagcctatgagaaccaagtgccggtcaacgccatccgcaaccacgcgcccacccatcagatgctcatcataggcgcgggggagaaggacaccacctcaatacgcaacgtcaaaacaatcgcgccggtcgcggcgaaagccggcatgcgcgtcgccgccgtcgaatcgtccggcaacgcacacgactggcacgccgtgcaggacgtgctgcgttacgggctcgccgtattcggccacgacaccggactggatggtgcgaacccgaacctatccgactatccgaatctcaaacgcatcacgatatgacgattctgaacacaaacccgcaagcctgagaatcccagaaaaggaaagaaatgactcaaacgcaaaccgcacctgctaaaccagccgaggcatcacccgcgaaaccactgttcggcttccgcgcgctgctcgccgatctggccggatggatcagacgacacctgctcaccgtctgcctcgtgctgttcgtcatcctcatcaacgtgggcacgcagatcgtgtgcgcgctcatacgtcagccgttcccgccgagcctggccaaagtaagtttcgaagcgctcgcacgcggccgctggtacaccgcgccgatatccatgctgtacgtgccgaatctgggccgtctgctcatcgacgttccgctcatgctggttgcgttcggcctggccgaatcggtgatcggcaaaatcaaaaccgcatgggtgtccgtcatcaccacactgggtggcgtggccttgggcatgggactgtgctccctatccgacgggcgcagcccccaatggcatgcgatctcgcatgatggcgccatccttggtccgctgattctcgtcgccggcacccttatgtgcgccagcgcgttcacaaccatgctgtggcgccgccgtatccgcgtgatcggctatgcggtcgtgctcatcatgttcctctaccgaggcgaggtgagcgactactgcctgcttgccgcttcggtgattggccacgtgctcggctatctgatggcctcccgcacacatggcgacgaataccggcatggcgccatctacgaaacgcgtcggcttatcggcatcgtcgcgggcgtgcaggccatcggctcgctcgtcgccgtctcgtcacgccaatcgttcggcctgctgtccatgttcggactgttgaccggctccaccgacttcgacaccggacgtgtggtcgactgcctcagcggcgcctcgcatacggactgcttcacgcaataccgcatgatgcgtttcaccatgcccggcaactggctggtatccatcacgccgacgctgatgctgctgctcatcgcctggggtctgtatcgaggccgtcatctcgcagccacgctcagcatcgtgttcaacgcatgcaccattgccctatcgacggtgttctatgtggctattccgctgtcctacgtggacggctccgacgccggtgcatacatggatgcgatatccgcattgcaacggcacggcgcattccacgcgatgctggccacgatggcgttgccgctgctgtgcatcgtcatcatcatcctgttccgcgcatgtttcaccattcgcacgaaaagcgagaccgtgctgcgcggtatcgccatcacgttcgccgcattcgtattactgggattgctgtacgtcggctacggcctgtccatgccgtccggcttcaacgaaacgccgctgctggtcgatctgatcgcagactacgtgcagcgtttgctgccgattggcctgctaagtggcgtggaaccggcgttcgtgccggtcggactgctttccgaaatcgtctaccagtgcgtcggaccgatgttttggctggtcgcgctgtgctgcacatgggatggcctgcgtgaccgttccatgatcaacgacgcgtaccgccaccgcgtggacgagatcatcggactcggcggcgaatccatgtcgttcatggccacttggaaaggcaacgattactggttctccgccaccggccgttccgccatcgcctaccgcgtgtcgtatggcatcgcattgaccgtcaccggacctttcggcgaccccgacgaatatgaggacgatctgcgtgcgttcgccggcttctgtacccaacgttccctgacgccggtgttctacagcgtgcacgccgaacaacgtgacgagttggtctccgccggttggaacgcgctcgacgtcggcaccgaaatggtgatcgacccggccgcatggcagacgcgcggcaagaaatggcaggacgtgcgcaccgccatcaacaaagccaagcgcgacggcatcaccgacgtgctcgccacattcaaggaatcgccgttctccgtgcagacgcagatccgtgagatctccacgcaatgggccggtgagaaggccctgcctgaaatgggcttcaccctgggtggcgtggacgagctggtcgatccacgcgtcaaactgctgtacgcggtggacacggacggtaaggtgctgggcgtcaccagctggctgccgacctatgagaacggcaaagtggtcggatggacgctcgacttcatgcgtcaccgtaccgacagcgtcaacggcatcatggaattcctcatcgcccgcatggccgaacggctgcgcgacgaaggcgaagtgcgattcatgagcctgtccgcggcgccacttgccggcatgagcggcgaaggccacgaacagggggagagcgccgtactcgaccacgtgctgcagatggtggccgacatcatggaaccggcttacggattccactccctgttccgcttcaaactcaagttccatccggatgaagccaaagtgtacatctgctatccggatccggcgaaactgccgcagatctcgcttgccgtcgcgcaggcctacgtgccgtcgctcaccccagccgaagccatgcgattcgtacgcaccatcgtgcctacgaaaacgaactgaaaccatgtgattggttgacggcccgtcatccctgagatgggccgtcgctttgggtgcgctcggggctacactggggaaggttcataaaaagtactacgtttctccatgaaagggaacagtatgtcagctgaagcaaacgtcggcgtcgtcggtctggctgccatgggcggcagcctcgcacgcaatctcgctcaccacggcaacaaggtggccgtgttcaaccgcacctacgcccgtaccgaaaagctcatgaacgagcatggcggcgaaggcgagttctatccggcgaagacgcttgaggaattcgtggacagcctcgtcaagccgcgcaccgccatcatcatggtcaaggccggtgagccgaccgacgccatgatcaacgcgctcgccgacctgatggagccgggtgacatcatcgtcgacgccggcaacgcctacttcccggacatcatccgccgcgagaaggaaatcagcgcccgcggcctgcacttcgtcggctgcggcgtgtccggtggcgaggaaggcgccctgcttggtccgtccatgatgccgggtggttccgaggaatcctggaagaccctgaagccgattttcgaatccatcgcggccaaggccgaaggcgaaccgtgcgtcacccacatcggactcaacggtgccggccacttcgtcaagatggtgcacaacggcatcgaatactccgacatgcagctcatcgccgaaagctacgacctcatgcgccgcggcctgggcatgaccccggccgagatcggcgacgtgttcgaggagtggaacaagaccgaactcgactcctacctcattgaaatcaccgccgaagtgctgcaccaggtcgacaagaagaccggcaagccgctcgtcgacctcatcgtcgaccacgccggcatgaagggcaccggcacctggaccgtgcagaccgcactgtccctcgccgtgccggtcaccggcatcgccgaagccgtgttcgcccgcggcctgtcctccgaagccgacctgcgtgaggaagcccagaagcagggcttcgccggccccgacggcaagctcaacctgaacgacgacgagaagaaggccttcatcgaagacatccgccaggccctctacgcttccaagatcgtcgcctacgcacagggcttcaacgagatcaccaccgccgccaaggaatacggctgggacatcgacctcgccgccgtggcacgcatctggcgtggcggctgcatcatccgcgcgaagttcctcaaccgcatttccgaagcgttcgaatccggcgaggccaacgtgtcactgctgttcgccccgtacttcaagaacgccatcgaaaacgccgagaagtcctggcgcaacgtggtcgcccaggccgccatcaacggtctgccgaccccggcgttcgcctcgtcgctgtcctacttcgacggcctgcgttccaagcgtctgccggccgccctcatccagggccagcgcgactacttcggcgcccacacctaccagcgcgtggaccagccgggcgcgttccacaccctgtgggccgagccgggccgcgaagagatcgaagcctgatcttttccttgcctccgtgtcagggcggatatgccagaggtcttgcgatgtgttccattgcaagacctctggcatatgcatattactgagctgcgatattgccgtaccgttgcattgacggagcatagtgtcgctccgtaagcagaacgaatggtacttgtggttgtgatgcatcccatttgcgtttctaggggagtctaatgccatcgtctaacctcctttcgagaggttttcggaagctatggggcgaaataggcggcggattgggattccgtaggtggtttttgcgttccataggtggttggtcttgggagcctgctgcggaaaaggccggaaaccggccttttccatgaccccgatacttggggcaaccgcctacggaaacgcgaaaccgcctacgaagctgcagtccagcgggaacctgcgtcaaaacgacactcaacaatcaatcaacactcaaaaaaaaggggtgtctcacggcatgagtcgcgggacacccctgttacctgtttcggatgaacctcacaacttggaagcggcaccctcgtcaatgagccagagcagttcctcgccatcggcgtaggagcttggggcatgcgggttgttgcgctgggcgaaggcggccttgaccgcgctggccttacgctcttcggaggtgaacacccacgtatgcttcgaccgggcgatcatcggcacggtcaatgtcaggcgcagcggcggcggtttcggcgaatcgcgcacgcctgcgaccagcacgtgcgggtcgtcgatctcggcctcgccgtggtcggggaacagggacgcgaaatgcgcgtccggccccatgccgaacatcgcgatatccaatgccggattctcgcccaactgctcgatgagctcgcgctggtactccgcggcggcctcggccagcaccgcatcggtctgttcgggggaggcggcggcgatctcctcggcgccgcgggtatcggccggcatcgcatggatattcgccgccggcatgcgcccgctttccacaagcgcaccgtaccaggcctcgcgagcctgcttcgcgttgcggtcgtcgtcatcggccgccacgaagcgctcgtcgccccaccacatgtgcacacggctccagtccacggcatcgttcagcgggctggcgttcatcgcggcgaacacacggttgccgtcggtgccgccggtcacggcgatatccacacgtttacgattcggctcggccagcagatcgatgatggtcagcagcgtgcgcgcggccacagcctccgccagtacctgcggattggggtatacgacggttttacgttctgtcacgttcactccttgtattatggttcgacgcttggtggctactgcctgggcttgacgagatccagtccttgcgagacgacctcgctgtagatctcatcggggtagaggcggccaagctcctcgctcaggcattcctcaagcgtgcgcgcgggcacgctgatggtctgcggcgactggccgggcacactgatcacggcgaacccgtcgtcggtggaggggcgctccaggctcagcacgccgtcgccgcgcgtcaggtacacgccggtgacggccgtggcgttcggatcctcctcgatcatcaccggcacgttcaggcgcagtcgcagccatgcggccagcagatccaacggcagataatccttctgcccggtcacgcgcacattgctcaccggcaggtgcggcggctggtcgagcatcgaggcgatcatcgcacgccatacggtcaggcgtgtccacgacatgtccacgtccttggcggagcggttgcggcgcagatcgtccatcgtgcgccgcgggttcgaggagtgcatcgcgtcggtgatgcggctgctggccatggagccgagcaggtccttcgacagattcgcgggcgcctcgttcggccaccatgccaccacgggggcgtcgggcacgagcagcgggatcaccagggtgtcggcgtgacggaccagaccgccgcgcggacgaagcacgatgatctcgcccgcaccggcgtcggagccgaagcggatctcggcgtcaaggaaggtgggatgctcctcttccgggctgatcttgcggctgctcggggcgaccgcgatcacacggcagggatgctcgcggctcgcattgttggcgacttcgagatcatgctcgagctcggcctcgttggtggagatgagcagggtgagcacacggcccagggccgcctcgccgcgctcctcgtgcagttcgtcgattttcgccgagatctcgcgggtctcggtgtcttgcagggtaatgatcacggcatcctccaacggtgtccatcgcgggcgagcatttcaacggcctcctccggcccccacgtgccggaacgatacggctgcggctggccgagcgtcgaccagaactcctcgatcgggtcgaggatcttccacgaaaggttgacctcctcggtggtggggaacagcggcgggtcgcccagcagcacgtcgaggatcaggcgttcgtatgcctcaggggaggattcggtgaacgagcgaccgtagccgaagtccatcgacacgtcgcgcacctccatcgacgtgccgcccggcaccttcgcgccgaagcgcatggtcacgccctcgtcgggctgcacgcggatcacgacggcgttcttgccgagctccttggtggcggtcgattcgaacggcagatgcggggcgcgtttgaacaccacggcgatctccgtgacacgcttgcccaggcgcttgccggtacgcagatagaacggcacgccggcccaacggcgggtgtcgacgtccaggcggatcgcggcataggtctcggtggtggattcgggatcgatgcccttctcgtccaagtagccgaccacctcgtgcgatccctgccatccggcggcgtactggcctcgcgcggtgtgcgcggccagatccttgggcaggcgcacggcggagagcaccttggtcttctcggcggtcagatcggcggcggagaaggagaccggctcttccatggcggtcaatgccataagctgcagaagatggttctggatgatgtcgcgtgcggcgccgataccgtcgtaatagccggcacgaccagccacgccgatgtcctcggccatggtgatctgcacatggtcgacgtaattgttgttccagatcggctcgtacatggcgttcgcgaaacgcaacgccagcatgttctgcacggtctccttgccaagataatggtcgatgcggaacacgctcgacgggtcgaacacttcggagaccacgcgatcgagctccttggcgctggccagatcatgaccgaacggcttttcgatgatcacacgacgccaagcgcccttgtcgcttttcgccagaccacagtcggccagctgacgggacacctgcgggaacgcgcgcggcggcaccgacatgtagaacgcgtgattgccgcgcgtgccacggtcgcggtcaagctcggcgaccgtgtcggacagacgctcgaacgctttcggatcatcgaacgtgccttgtacgaaacggataccggccgcaagctgcttccaagtcgattccttgaacggcgtacggcaatgcgcctgcacgttctccttgacgaagtccttgaaatggtcctcggtccagtcgcggcgtgcgaagcctgtcagaccgaagcttggcggcaacaagccacggttggccagatcgtagatggcggggagcagcttcttacgggacagatcgccggtcacgccgaaaatcacgatgctgcatgggcctgcgatgcggggaagtctcagatcgcgcgggtcgcgcagcggattcgtccatgcgtcggccgcgttggatgcggttgaaacggtttcactcatgcctttcatactaacgcgcgggctccactcgccaccaaagggaattcgaaaacgtcatggcccttttttagagcatcctacaaaacggcatggcgattccctcgtttggtgccgccactacaatgcctccggaagagaacgacgagccggctgcggctggcggagacaaaaacatggtgcacaacaagcagggcatagacatgctgcacgggcgcatatggacgaaagtcctgcgattcgcgctccccgtggcggcgaccggcattctggaacaactcttcaacgcatccggcatcatgatcgtcggcaacttctcccaatccgacggcaccgccgcggtcgcggccgtcggctccaacgcgcccgtcaccggactcatcctcaacctgttcatcggcatcgctctcggcgcgaacgtcgtcatcgccaacgccatcggacgaggcagccgcgaagcggtgcgcaacgccgtgcacacgtccatcgtcaccgccctgatcggcggcgtgatcgtcgccatcatcggagaattgctcgccggcccgcttctcggcatgctcaacgtgaccgccgacgtgttccccctggcgctcgcatacctgcgcatctacctcatcggcatgcccgtcatcctgctatacaatttcgaaacagccatcttccgcagcatcggcgacacccaggctccgctcgccgtactcgccatttccggcgtgctcaacgtgaccatgggactgattttcgtcgtattgttccattggggtgtttcgggcgtcgcgacggccaccgtcatcgcgaacgtcgtcagctccatgattctgctgtatcgactggttcatactgacgcagccatccatgttgatttgcgcgagttcggcatcgactggttcaccctgcgtcagattctgcgcatcggactgcccgccggcgtgcaaagcgcggtgttcgccgtggccaacatcatcatccaagccgccatcaacagtctcggcaccgttgtcatggccgcctccagcgccgcgttcaacatcgaaatcatcgcctactacgtgctcaactcgtttagccaggcctgcgccaccttcaccgggcaaaactatggagccaaacggattggacgctgcaagcgcgtgcttggcatctgcattctggaggatttcatcgtcaccgcggccaccatcgccgtcgtgctgttcttcggccatagtctgctggcgttgttcgatgcgacaccggaggtcatttccgtcggctacaccagactcgtcatggtgttctccgcctacacgttcagcatgctatacgaggtcatgtccggatatctgcgcggcttcggcatctcactggtgccggcgctgctcaccgtaatcggcgtggtcggcgtgcgcatcacttggatcgcgttcgcgttccccgcgcatcgcacgttcgaggccattatgatcgtctacccgattagcctcgccgcaaccgccgtactcatcggcattgctctgctctgctaccgtccgtccaagcgattcgccgttaaaccttgagcgtgtgcggcttgccgccgtccatgaacgcggcgattcgccgggtcaaagcgcggggaagaacccgttccgcgagcgcgcccgccttggtgagcggaccatggtaggcgagggttgagccgcgcatcatcctgcggtaggcgtacgtggcaagctgacgtgcggtggccggtttggtcatggtgaagaagttgcggccactcatattcgcagccttctgaaagccggtcgtggtcggaccgggacatacgcaggtcaccgtcacgcccgtgccgcgcaattcgtgggccactgcctcggatagcgaacgcacgaatgccttcgacgcgaaatacatcgccatgtatgggcctgccatcatcgaggcgacggacgaaatattcaaaatcctgccatgcccgttggcgcgcatgtctcggccataccgatacgtcaactcagcgagcgcatgcatgttgagctgcatcatctcattttgccggttccagtcggcgtcgagaaaatccgtccagtcagcgaagcctgcgttattaacgagatggtcgaccgcaataccttgtgatgtggtgaaatcatggagtttcttcggcgcatttgcttcgctcagatctatggcgaacgtcaccacatgcacgccaaaacgctgctcgagcttggtttttaccatgtcaagccgttcctggctgcgggcggtgatcaccaggtcatgtccgtccgctgcgaacagcgccgccagttcgcgtccgatgccgccggacgctcccgtgatgagtgcgtatcccatgccaactccttcgttttggtcctatctcgcctatgaatggcggattcgcgggtctgcctgatgctatctccactatagatggcggatgtttttcgacttataccccctgagatagtgtatgggggtaaaaagcgcggcttttcactttgccgtccgccatctataagcgagataacatgtgtcgaaagacgaaatccgccatccataggcgagataggtgttttgtggaggggtggaggacagtggtgaaaacaaagtcgcattacgattcgccgcttggcggcatcacgctgatcgccgacgaaacggcattgctcggcctgtggttcgattggcagccaggctatgcggacgatgattccgcggttttgggtgattcgccgacgattggcgccgcgaaacgatggctggacgaatactttgcaggttgcatacctcggaccgaagtgccgttgctgctggaaggcacgccattccgcaaggaagcatgggcattgctgcggaaagtgccatacggcgaaacggtttcatacggcggactcgcacgtcgattggagttgaaacgtgcggacgggcgtagggtatccgcacgcgccatcggaggagcggtgcaccgcaatccgatcgcgcttatcgtgccctgccatcgggtcgtcggcgctgacggcagtctcaccggttatgcgggaggcattgaaaccaaaatccgtctgctccaactcgaaggcgtgctgaagcagacggaacggatggatgtggattgcgaatctatagaccggatttggcgatccacccgctgacggcttcggcggttttacttgcgttgttctgtgcgtcggtccccatgaccgcaagccccggcttcaccgtcgtcttggtgattgcggcgatacgttccggagtccgtccaagcccgctgccgccgtgcgtgcagaacggataaatggtctttccggaccagtcgcggctttccagaaaagcgtacacgagcatcggcatatcgccgcaccaaatcggatagccgaggaacacggtatcggacgagtcgagcgcatcggtatcgccgctgagcgtgaacggcagacgcacgttgacacgctgctcctcctgcaccatttctgaggtcgcggcgtaccgttccggataaggctcggtacgtgcgatttcaatcatcggcgaatcggtccgccgggccacctcttgggcaagcttcgcggtattgccgaccgtcacctcgcccacttcgtagttttcgccggcgcgggagaaaaacaccaccaccatgttgcgtcctttcatggtccttgaagaggccgttgccgcatccgtcatgcgtcagtccaagggtttatcagtccatctttggaaacgattgtgctcgatacgcgagcagaccgtcgatgaaccgtgcaagaccctcgatcatgcgtgcacgcggacaggccacgttgatacgcacgaaatcatgaccgttgccaccatattcggaaccctcggagaacatcaccttatgctcgcgtttgagataatcgcacaacgcatccgtgtcatgcgtgatggccgaacagtcgacccacaacaggtaggtggcatgtccttcgaccatgatgatgcgccggtcggccggcaccgaagcgttgtatttgtcgaacatcgcacgcgcggtcgccttgttgccggccagataagcgcgcagttcgttcagccacggttcgccctcgttgaacgcggccagggtggcgtccatggcgaaggcgttcggctccgccacctcatcggtgttcaaagctcgccacaccttatgacgcagcaccggattcggaatcatcacggccgcggaattcagtcctgcgatgttgaacgttttggtcggagccatgcaggtcaccgaattcatcgcgcaatgctcgcccaccgaggcgaacggcacgtaatcgaaacccggatcggtcagatcgcagtggatctcatcgctgaccaccgtcacatgatgcttccagcacagttcgccgatacgttccaaagtctcacaatcccaaatacggtcgatcggattatgcgggttgcacagaatcatcagcgtggtctgcgggtcggcgagtttcgtttcgaaatcagcccaatcgatctcgtaatgtccttcgccgtcataggcgagcggcgattcaagcacacggcagccattgttgagaatcgaattgaagaagatgttgtagaccggcgtcatgatcacgacgttctcgttcggcgtggtgagtttcctgaccatgctggagatcgccggcaccacaccggtgcagaacaccagcgagtccgggtcgatggcaagcccatgacggcgtccccaccaatccacgtacgcctgattccattctggcggcacgatcgaatagccgaaaacgccatgctcgacgcgccgacgcaacgcctcgcggattacgggcgcggtctggaaatccatatccgccacccacatgggcagcgcgtcgccagcctcctcccatttgagcgagtacgtgccggaacggtcgatcggagtatcgaaatcgtaagtcataccgccaatcctacctactgttatgcggcgtcggctgtcacgatcgtcgtggccgtcggatcgattttcgccggatcgagcgtcagctcgttgatatggtcggcgcgaatcgtgccggacgaaggattgaacacgctgtcgatcgtgccgcgcacgtcggcatcgacggaggaatattcgaacgcgagcgtcgtattgacgagccggcagtcacgcaacaccagatggtccacgtagcacaggccctgcaggctttcgatcgtgcaatgctcgaacgtcacgttacgcgagttccacgccagatactcgccggaaatgaacgaatcgcgcaccgtcacgttctcacagttccagaaacaatccttcgaaatcagacgggaattggaaatctccacgttccttgcgccatcgaacggataattgcccaccaaacgtaggttgtcggctttcacatccgcgcaattcatcgccagatagtcgccatgcgcgctcacattgtccaacgtcacgccggaacaggcccacaatgtctcctcggcgttgacaaaatccacgttgcgtaacgtcacgtcatggcagcggcggaaattcttcggcgcctcgatcgttgaatcctccaccgtgatatggtccgtgtaccatacgcccgcacgtgccatctcaaaccacgtgcagtccttcgcatcgatatccgagcaataccacagcggatacttccatttgaacgagctcgacctcagttcgatgtcatgggcatgcttcaacggcgattcgccatcgtcgaaaatcgtatcgacgtaccggcggtcatgcgcgaagaactccgcgcgctcgccggtgaggaacgcctggcgggtttcggacatgtcctgctccgcagcggatgtaaatgtatctggagtgttattcaccgtatgctccttcatgctctgttggaagagaataggaacttcaagtacttgaagtcaaacagggagccacgttcgtctggagcgaacacggctccctgcggaaaatcgggaaatgcgcgccgaaacaggcagaggaatcagccgatcagcgctgccggatacttcgccgcggcggcgtcgatctgctcatcggtggacgtggcgacgccttggatgaggaacggcttcagatatgtggcatgcgtatgacggaacgtggtctcgaacggggaaagcagctcctccatggtgcgcacatggctgccttcacgcgtgtaggagtccgccggagagccggtggacacggccaacatgaactccttgccttcgagcgcccgcccgccgccgtaggcccagccggccttgatcacgtcatcctcccactgcttgagcagcgcgggggagctgtaccagtagaacgggaactgcagcacgatgcggtcatgcgtttcgatgagctcctgctcatgttcgacgttgattttgaagtcgggatatgcggcgtactcgtccatcacggtcacgtcgccggtctcgttggccgcgtccatgagcttgcggttgacctgcgacttctccagatgcgggtggaacaccagaaccagtgtcttcattcatgctccttgtccaaaggttttttgttacgttccagtatgcagcatgataatctcgccgcgcttgctttgtacgtaatccgtcgatgtccacgcgccgatacggttgcgcatgttttgtcggggtcggcgatagtatgttggccgtcgttgtggcgcgtcggggtatatcagggcgcggcaagagaaggcatgagaagagaagcatgggaacggacggaagaagggctgatatttaatggtgcggacgcagaacaggaatgctgtcatgggcaaggcgttcagaacggcgttgccgcggacgtcgccggtctgcatcagcttcttccttctggcgttgtcgtacggcgtgctgatgggcacgcgcggcttttcgttcctgtggcccatgtgcatgagcgcgttcatcttcaccggttccatggaattcgtcaccgtgaatctgctggtgtccgcgttcaacccgttcgtcacgttcatgctggccgtcatgctcggcacccgtcatctgttctacggcatctccatgctcggccggttcaagaacatgggcgccaagaagccgtatctcattttctcgttgtgcgacgagaccttcgccatcgacaacggcaccatcattgcggccgacgtcgatcgcggatggttctacttcttcgtcggcctgctcaaccagtcatcatgggtggccggcgccacgcttggcggccttctcggagaacgcatcaccttcaacacctccggtctcgacttcatcatgaccgccatgttcgccgtcattttcgtggatcaatggctgaccacgaaacgcaaaagccacatggccgcgcttaccggcatagcggtgcccgcgatctgtctgggggtgttcggcgccgacaatttcatgatcccatccctggtcgccatgctcgtcatgttcattctgctgcggccatacctggacgacctgaagatcgacaagacggacggggagaacgaaacgaacaacgcggacaaggagacgaacgcatgatgatcatgaccacgtggcaaggcgtcatcaccatcatcatggcgatgctcggcaccatgctgacacgtttcctgccgttcctgctgttccccgaatcgaaggaaccgccgcgtttcatcacctacctgggcaccgtcctgccgtatgccatgacaggcctgctcgtcgtgtactcgctcaaaggagtgcacctgacgtcaggcagccacggcattcccgaattgttggcgattatcgcaatcgccctgctgcacatatggaaaaggaacatgctgctgtcgatcgccggcggcaccgccgtctatatgctgctggtacagctggttttctcgtaagacggcttccgcctgtgcttggcattgcgattacctggcgagccccatctcgtatttgagcgtcatcacacgaatggcggattgctgcaccttccgcgcgaacgtcgcatcgccggccgctttggcgttcaatccgtccaacaccggctgcacgtaggaagaggcgccgatacatgccaaatcgccgccggcttcgaccagccgcacacccaaatcactcggctgcacgccactcaaagccgttgcggacagggaatcggaagtgacgacgccttggaagccgattttcccgcgcagatagccggtgaccagcgttgatgagaacacggccggattattcggatcgatcgcctgatatgtggccaaagacatcatcaccatcgaagggcttgcctccaacgtgccgttgaacgcgctgatttccggaccatccaacgtggtggtggtgtcgaggatgccgttcgcggtgaaatcggtattgccggtcaccgatcccaaacccggataatgtttgatggcgctgcctacccccgaatcggacatgccctgtatgaacgccttcgcatggtccgcattgccggccggatcaagaccgaaatcacggtacagcgcgccaatcggggcgttcgacgaacggtccacggtcaccgtgccgacgacgggcgccagatcgacattgatgcccgcagccttgagctgcgtgccccatgcggatgccgattgcctcaactggctgacatccattgcgccctgctgggtggccgaaggcatggtatcaaacccggcccccttgagatgctggaccagaccaccctcctgatcggtggacatcaacagctggttgtcgcccggagcatacgattgcagcgtggatgtggcggccgcgaccccggcgatccccgaagtccagttgccgatgatcaaaaccgaaccaacatgcctgttcgcaatgaggtcatacaacgatgacggatcggaaccagcgaacaatggtgccataaccagctgcccgacccgttcctcgacactcatggactccacggcccgcaccgccttggcatgcggcgaatcgtcgcggacggacggcacttgcgccttgtcgagggaatcatgcgtgaccgtcggccggcgagtggaaaaagctgcggtggcggcgtccgatggggaagcgtcgccggaacatgcggccaacgtgaccggcagcatcgccacgcagcaggcagccaccaatcgtgtgaaaaacccatgagccttcttcataccgccattatggcatgccggcattccccatatgttcccttcatacgaacatgccacggaacagccgattcagcccacggccagatccgttcggctggcggcttaacggcgttcctcgcctgtcgctaggctattagcatgtctttctttgatatgtttggtcccatgttcgatcccgaaggcggctcgaaccgtgccggcaggcagaatccgcgcaaacccagcaacgacgatccgatcatcctcaacgtcgaaaccgacggaggggacggtccgcaaccatcgtcgaacgttcccccgaaacgaccttcgggcccccgcatcaccagcaagccgaaccgtccgcgcaaaccgtcgaacggcagcaagatcttcatcggcgtggtgctggcgctcgccatcgtcatcggactgttcttcgcgctcgcgcagttcgtcaccgatgtcatgtggtacagccagctcggcttccaaagcgtgatttggacgcagctgggcaccagggtcggcctctggctggcgtacgcggtgcttatcgccgcagtcggcttcatctccgccacgctggcgatatgggcgcgtcccgacgctgcggacggctccaccatccgcgtgaacggcgacaccatcgaaatcggcaagagcgtgagctccaagagcgctcgacgcatcgccgtggtcatctccctgattgtcggactggtgttcggctcccagttcaacgcgaactggtccgaaatcctgctcatgttcaactcgcaaagcttcggcaccaaggatccgcagttcggcatcgacaacggcttctacgtgttcgtgctgcccggactgaaactcatcatgtccgctgtctcgctgttgctgctcgctggcatcatcttctccatcgtcacccacgtgcttatgggcggcatccgcatcaccatgccggtgaacggccatggcctgttccgcatcaccaaacgcgcccgccgccagatcggcatctggctgatgctcaacatgttcgcctgggccgccaatcaggttctgggagtgttctcgcacctgaccgaggaaggcagcagaatcaccggtgccacctacaccacggtgaacgccaccatccccgtcacgttcatcatggccgccatcaccgccatccttggcgtgatactgggcctgtggattatgaaatcccatacgttggaaggttccgcacccatcgcggcacgtgcttccgaagcgctcaaggcgtggaaggtgccgaccgtggccatcgcctccgccatcgtggtgagcctggtgcttaccgtggcctggccggtgctgctgcagcgcttccgcgtcaatccgaacgcgcaggaaatggaatccacctatatccagcgcaacatcgacgccacccgcgccgcgtacggcttggacaaggtgaaggccgaacagtacaaggccaccaccgaaggcgaggaaggcgcattggctgattccgcggaatccaccgctcagatccgcctgctcgacccgcagattatctccccgacgttcaaacagctgcagcagtccaagcagtactacacgttcgccgacaccgtcgcggtcgacaaatacgacgtcgacggcgtcagccaggacacggtgatcgccgcgcgcgaactcgatctggacggtctcgacaaccgcaactgggtcaacgaccacaccgtgtacacgcacggctatggcgttgtggccgcctacggcaacaaggtgaccgccgacggccagccgaagttcttcgaagcgggcatccccacccaaggcaagctcaccgattccgaaaagtacgagccgcgcatctacttctctccgaacgccaccgaatattcgatcgtaggcgctccggaaggcaccaaatcctgggaattcgactatccgaccggttcggaaggcgccaccaacaccttcaagggcgatggcggtccgaagatcggcaacatcttctccagactgctgtacgccatccgcttcggctccgaccagatcctgttctccaaccgtgtgaactccaattcgcagattctctacgaccgttccccgaaggaacgtgtggccaaagtcgcgccgtatctgacgcttgacggccgcgtatacccggccgtggtggacggacgggtcaagtggatcgtggacggctacaccacttcggacgcctacccatactctcagatgaccgacttgggcgaggccaccaaggactccaccacggaatcctccgacacggtaagcagcctgaactcgaagaacgccaactacatccgcaattccgtgaaagccaccgtggacgcatacgacggttccgtggacctgtatgtatgggaccagtccgacccggtcgtcaaagcctgggagaagatcttccccggccagtaccaccagctgtcggaaatctccggcgacctgatgagccacatgcgttatccggaaagcctgttcaaggtgcagcgcgaactgctggccaaataccacgtgtccagcgccaaccagttcttctccggagaggatttctggcagacccccgtcgacccgaccgaatcgcagcaggcgcaacagcgagacatcctgcagccgccgtactatctgacgctgcagaccggcggctccagcgaaccggtgttctcgctgacctcgtcgtacattcccgcaggctcgtccaccagggaaatcctgaccggcttcctgtcggtcgattccgacgcgggccacgagaaaggcaaaatcggctcgagctacggcaccatacgattgcaggaactgccgaaggattccaacgtgccgggccccggccaggcgcagaacaacttcaacgcgtccgccgacgtgtcgaaggaactcaacctgctcgaatccggctcgaccaatgtgcagcgcggcaacctgctcaccctgcctctcggcggaggcctggtctacgtgcagccggtgtacgtcaaatcgtccggctccaccagcttcccgctgctgaagaaggtgctcgtcgcattcggcgaccaggtcggcttcgccgacacgctggacgaggctctcgaccaggtgttcggcggcgattccggcgcgtccgcaggcgacgccgaaaacgtgggcgacaccaccgatgacaagcaggatgctaagaacgacgattccgccgatggcaagaccaacactgacggcaagcaggacacgccatccaataccgacggtaagaccggcggcaataatggcgattcgtccggcacgatgagcgccgacctgaagaaggcactcgacgatgccgcacaggccatgaaggattccgatgccgccatgaagaagggcgattggtccgcctacggcgacgctcagaagcagcttcaggaagcactgaacaaggccatcgaactcgaacagtgattcccgtccgattcccttcatgaaatacgcaggggccggctccttccaaaggaaccggcccctgttgtcgttcgccgccgggtatgctgggcgcatggccgactattctttccgcatcgcgacgcaagacgatatccaagcgatcaccgacatctacaacgcggcagtcatccgcggcggctcgtccgccgacaccacgccacgtacctacgcgcaacgcaaggcatgggtggaatcgcaccacgatccatatgcggtgttcgtcaccaccgtgcctgccacggatgcagccacggaaggcggcgaacggatcatcggcttctccgcgctgtccgtgttctacgaccgcgccggctacgacggcgtcaccgacctcgcctactacatcgcccccgaatggcagggcaggggagcgggcaccttcacactggccagactgcttgacgaatgccgaaaccgccacatgcgcaaagcctgcggcatcatcttcgccgacaaccgcggatccatcgcactgatgaaacatttcggattcacccaattcggactcatgccccaagccgccaccgactccaccggaaccatgcgcgacatgagctactggcatctcgacctgtaagcacctgacagtagaatctgtgcggttaaacaagacgagagcacgcaagaacacagaggaatggacgattattatggcatctgatttctggctgatcgcaggactgggcaaccccggctccaaatatgagggcacccgccacaacatgggcttcatgaccgccgacgtgctggccgaacgctggtccgtcaacttctccgaccacaagggactcgccatgctcggcaaaggcgtgatgaacctatccggccgcaacgtcaaattcttcctcgccaagccactcacctacatgaacgaatccggcaacgcggtcgcctccatcagcgcctactaccagatcgaaccggaccatatcgtggttatccacgacgacatggacctcgacttcggcagaatcaaagtcaaagccggcggctccgcaggcgggcacaacggcatcaaatccatcgaccgttcgctcggcaccccgaaatacgcgcgcgtgcgcatgggcgtcggccacgcccaacgcggagcccacgcgcacgacaacaccgtgaactgggtgctgggcggcttcggaccggaccaacgcaagcagctccccgaattcctcgccgacggtgccgacgcggccgaaaccatcatcttcgacggtctcgccaaagcccaggagcgattcaatggccgctgaaccgacgtctccggcgcaaccaccgcaactgccgaccgcaggctcgcttgccggcatcctcgacgtgctggaaaccgatgacgatttccgcgcgctcatcgccggggaaatcgaagaaccggaatcagacatcgaccccagcatcaccgtcggtgtgccggacggcctacgcccggcgctcgcagccggcgctgcgggcaaacagccggtcgtgctcgtcgtcgcctccagccgcgaagctgaggaaaccgtggagtccatccgttcctggtatgacggagacccaaacgatgtggcgcagcttgaagcatgggagacccttccccatgaacggctttcaccacgcgcggacactgtggcaagccgcatggcggtgttccgcaggctgaagcatcccgaagagggcagcacgctgttcggccccatccgcattctggtcatgccggtgcgctccctcatccaaccggtggtcgcaggcttgggggacgtcgaaccactcgtgttctcccaaggcgaggaactgcttcttgacgaagcatcccgcaaactggtggaaaacgcgtacacgcgcgtcgacttggtgatggaccgtggcgaattcgccgtccgcggtggcatcatcgacgtttttccgcccactctgccgcatccggtgcgtatcgaattcttcggcgacgagatcgacaccatacgtgaattccacgcatccgaccagcgcacctacggtaaggatatttccaccgtatgggccacgccatgccgtgaactgcagttgaccgaccagattcgccaacgtgcgaaatcgctgatcggctccattcccaacgccgaggacatgctcggatccatcgccaacgccatcccggtggaaggcatggaatcgctgctgcccgcgctggtcgacgatatggaaccggtgcagggcatgctgcccaagcatgcgctggtcatgctgtccgacccggaaaaacttcgtcgcgccgccgacgatctggcgaaaaccgccaacgaattccttgccgcaagctggcacgtcgccgcatccggacatggcgccggagcgccgatcaccttcgaccaggcgaatttctacgatttcgaggaaaccatctccgcactcgtcttctccaaacatgacgtgtggaaactcaccagcttcggcgtcgacgccacccgggaaggccacatccaacttgatgccaccaaacccggtgaataccgcggtgacgaaaacaaagcggcctccggcatcgaaggactgctcgacgccggctatgcggtgacgatcacggccgcggcccaaggcacactcacccgactgaagcgtgcgatcaacgaaaccggcatcgcgaatttcgattgcgtccgatcgcacgccatcgacggtttcgtggacgacgccgcgaaaatcgccctgctcaccgaacgcgacctgaccggccgcacatccgccgcaggacaggcgaaaacgccgaaacgccgacgcaaggccatcgacctgatggaactcaaaacgggcgattacgtcgtgcacgaacagcatggcatcggccggttcgtcgagatgcgccaacgtaccatcggcaaaggcgagaaccagaccacccgagaatacctggtcatcgaatacgctcccagcaaacgaggcgcgccggcggacaaactgttcatccccaccgaccagctcgaccaggtcagcaaatacatcggcgccgaaacgccgaaactcaacaagctgggcggttccgactgggccgccaccaaagccaaggcgcgcaagcatgtgcatgagatcgccgaggatctggtcaagctctactcggcacgccagcgtacgaaaggctatgccttcagcaaggacacgccgtggcagaaggagctggaggacgctttcccctatcaggagacggccgaccagctcaccaccatcgacgaggtcaagtcggatatggagaaacccattccgatggaccgtctgatctgcggcgatgtgggctttggcaaaaccgaaatcgcggtgcgcgccgcgttcaaggcggtgcaggattccaagcaggtggccgtgctcgtgccgaccacactgctcgtgcaacagcatttcgagactttcaccgaacgtttcgaaggcttccccgtgaacgtggctgccatgagccgattccagaccgccaaggagatcaacgagaccatcaaggggcttgaagacggttccgtggatgtggtcatcggcacgcacaagctgctcaatccgaagatcaagttcaaggatctgggactcgtcatcatcgacgaggaacagcgtttcggcgtcgagcacaaggagacgctcaaggcgttgcgcaccaatgtggacgtgctgagcctgtcggcaacgcctatcccgcgcacgttggaaatggctgtcaccggtatccgcgaaatgtccacgctggccacgccgccggaggatcgcctgccggtgctcacctacgtcggcgcttacgaggacgcgcaggtcaccgccgccatccggcgcgagctgttgcgtggtgggcaggtgttctacgtgcacaatcgtgtgcaggacatctcctccgtcgcggcgaaaatccacgagctcgtgcccgaatcgcatgtcggcatagcccacggcaagatgggggagaaacagcttgacggtgtgatccgcgacttctggcatcgcgacatcgacgtgctggtatgcaccaccatcatcgaaaccggccttgatatctccaacgccaacacgctgatcgtcgaccatgccgaccgcttcggcttgagccaattgcatcagctgcgtggccgcgtcggtcgtggacgtgagcgcgcgtatgcgtacttcctgtacgatccgaccaagccgatgacccagcaatcgcatgacaggctcgccaccatcgcgcagaacaccgcgctcggctctggcttcgacgtagccatgaaggatctcgaattgcgcggcaccggcaatttgctgggcgatgagcagagcggccatatcgaaggcgtcggcttcgacctgtacgtgcgtatggtgtccgaagcggtcgaacagtacaaggagccggaacgcaaggaatcggttgccgtcaccatcgacctgccgatcgaggcgtccattcccgtcgactacatcgattcggacaaactgcgattggaagcgtaccagaaactcgcctccgcacgcaccgaagacgatctcgacgagctgcgcgacgaactcaccgaccgttacggcaagccgcccgtcgatttcgaggcgctgttcgacgtggcgcggttgcggttcaaggctcgcaagctcggcatttccgagatcatcgcgcaaggacgcaacgtgcgcgtgtcgaagttcgagccgcgtgaatccgtgcagatgcgcatggccagaatctacaaaggcatccagtaccggccgttgaccaagacgtatctggtaccggctccattcgcaggctcgcttggttccaagccgatgagctcggacgaagtggtcggatggaccagtcaattgcttgacgatttggactggaaaccgacaccgcgtcaatgacagtgggatgcaaaaaagagtgtgagcgttcacatggaacatgcgggcaaagtttggcatacgtccataaatcgcactattcttggcattgtcatcacaacctaacgtttataaggagtagttgtggcagtaattgaaagcgtttacgcgcgtcagattctcgattcccgcggcaacccgaccgtcgaggtcgttcttgacaccgatgacggtgctcagggcctgggcctcgttccgtccggtgcttccaccggcgaagccgaggcttgggagcgtcgcgatggcgacaagtctgtttaccagggcaagggtgtgctcaacgccgtcaaggccgtgaacgaggagatcgctccgaaggtcatcggcatggacgcttccgatcagcgcgctctcgatgagaccatgatcgagctcgacggcaccccgaacaagggccgtctgggcgccaacgccatcctcggcgtgtccctggccgctctgtacgcttccgccgagtccgcggatcagccgctgtaccgctacatcggcggcaccaacggccacatcctgccggtcccgaacatgaacatcatgaacggtggcgcccacgctgacttcgccaccgacatccaggagtacatgatctccccgtacggcttcaacacctacagcgaggctctgcaggctggcgtcgaggtctaccacaccctgaagaacgtcctgaagaagcagggcctgaacaccggcctcggcgacgagggcggcttcgctccgaagatgaagtccaacaaggactccctgaactacatcatggacgccatctccgccgccggctacgagccgggcaagcagatcggcatctccctcgatgtggcttcctccgagttctacaacaaggagaccggcaagtaccacttcgaaggcgacgaccgtgaggccggctacatgctcgacttctacgagaacctcatcaacgagtacccgatcgtctccatcgaggatccgttccaggaagaaggctgggacgactgggcggccatcaccgccaagctcggcgatcgcctgcagttcgtcggcgacgacctgctggtcaccaacccggcacgtctggccaagggcatcaagctcggcgccgccaactccctgctggtcaagctcaaccagatcggcaccgtcaccgagaccctcgacgccatcgagctggccaccaagaacggcttcacctccatggtttcccaccgttccggcgagaccccggacaccaccatctccgacctggctgtggcaaagaacaccggccagatcaagaccggtgccccggctcgtggcgagcgtatcgccaagtacaaccgcctgctcgagattgaggaggagctcggctccaccgctcagtacgccggctacagcgctttcaaggcctgcaagaagtacatcgccgagtgagcgtagccagcgcatcatgaatgcgttgacatagaaatacccgtcgtgttccaagtcgaacgcgacgggtattttcgttgctatgagttcgaaggcacgaaaaaaaccatcacaacgcggcggcgccggcccggtcgcgttcttcgtggcattgttcatcgtggctttgggaaccatccagttggcatcgacattccatacctatgcgttgaatctggcagagcttaacggactgaaaaaacaggaagcggcgttggtcgcgcagaaacgcgagctggagaacgatatcgcaagatgggatgacaaggcgtatgtcaccgcccaggccagggatcgtttgggattcgtcttccccggcgaacaggcgattcgtgtcgagcatcccgaagcggtgaccggcaagagcgagccgaaaaaagggatgacatacgacgaatcaccgaaaaccgccctgccgtggtataaggagcttgcatattccttcaagcaggcggatcggtcggatcccgtgaaggccgactcgacgaaacagtcgcagcatgccggcgaagaagacaaacaggacagtcaacaacagactggccaatcgcaacaggacggtcagcagccgtcagaagacggacaggagtgacatggacatgacgattatcgaacaggccaagggtttggcggacaaagtgcttgcccaacccgccaccgaacatgatatcgccgtggtggagcgtcagcttggacgttacccgcgcggcatggtcgccgtcggagcccgttgcgtatgcggccggcctttggctgtggtcacccggccgttgcttccaggcggtgtcccgttcccgacgacctgctatctgaccgggcccgaagcggtgaaggccatctcccacatcgaagccgaaggcaagatgaaggaatacaacgatatgctggccgaaaacgaggatctgcgtgccggatacgaacgtgcccacgaactgtacctcgcgttccgccatgaaatcgctttggccttggaagacagcgaggaacacatcgaaggcaccagtgccggcggcatgccggtgcgtgtcaaatgcctgcatgcgttgttggcccagacgctggtgatgggtgagggcgccaaccccatcggtgatatggccctgtccgccatcaaacatgagttcgatccggccgtatgccgttgcgcagtggaaaacgaagagtagaaggtgggagtaatgaagtcggtaaccgttgccggtattgattgcggcacgaattcgattcgtctgaaagtctcgcgtgtgagcgaggacggtgtggaagacatcgttccgcgcatcctgcgggtgattcgtctcggtcaggatgtggacaaaacccatcgcttcgccgacgaggcgttggcgcgcgcctatgaggccgcccgagaattcgccggcgtgcttgccgaacatcccgtggacggcatccgcttcgtggccacatcggccacccgtgatgccgagaaccgtgaggaattcgaagacaacatcgagaagatcttgggcgtgcgtcccgaagtcattccaggcacggaggaagcggatttaagcttccttggtgccaccagcatcgtccatcgcgaggtcgaggccccctatctggtggtcgatttgggcggaggttccaccgaactggtgctgggaggcgacggcgtcacccatccgagcacgcaggtgcaggccgcgttctccatgaatatcgggtctgtccgtatgacggagcgtcatctgaaaaacgacccgccgaccgaggggcagatcgccgaggcggtcgcggatatcgacgcgcatatcgacgaggcgttcaagaccgttcccgccggcaagacccacaccatcatcggcgtgtccggaacggtcaccaccatgaccgcattggctatgggattgacggaatacgaccacaccgccgtggacggcgcacgctgcacgctggaagatgcctatgccgttgacaaccggttcctgcacatgcctcgtgaggagcgtctgacctacaagaccattcatcccggacgcgtcgatgtggtcggcggcggcgcattggtgtggaaccgtgtgcttgccaaggtgtctgaagccgcatatgaggatcatggccagcgcatcgactccttcatggccagcgagcatggtctgttggacggcatcgtgctggattacggcaagagattgcttgctgcgcgctgacgtggcataatagcttggcgtcggctttttcttctggccggcgcaaagcctccatggcgaaatcggtatacgcagtcgacttaaaatcgacctcttcggattgtgggttcgagtcccgctggaggcacttttggaaaccgccagagatggcggttttcctttattctccaacggttttggcatcatcgcgattcactgcgattcaacccttttccacggtgggttatggaaaaatgtgggcaatgtgtaggcaaaatgtggcatatcgttcccgaaacattccgtaggtacactgtcggacattacaaaccgtatgacaccgactgaaacggatgacgcatgacttcgaaagacatcaagcctgtaatcgaacagcccgccactgaaatccccctgatgcttgcgcaggcgattatcgttgccggcgtgctcgctatcggcgaaatcgcatgttctccgctgtactttaccttgatggaccattcgttggcactcgttccgtgggcattggaagccgcattccttgccgtggcgttcaccttcgtcgtgggcttcgcattgttgtggtgcgccgaatcgttcactttcaaactcaaggaacgattccgcccgttcggctatgcggcggtaggattgattggatacggcgtatggagcctgctggtgttcaccgccaccatcaattcgatactcgccaaagtcggggaaagcgttcttaccaacggccagatcggcgcgatcgcgctgaacggagcagccttgggcttcgtcgctttccttttcgcaaaactgctcgacgtcaaactcggcaatcgcaaaaccgttgcgataattctgcttatcgcggaaatcgtcattgccatcatcggcctactcatcatgattcgcatgttcagcgtgctttacgcggcgtgacggcgaagacgcggaaaagagagcgcaatatacatgttcagcattctggagatgttcaccatcggcgtcggccccagctcgtcgcacaccgtaggaccgatggtcgcggccagcagattcgctgcctcccttgaacgtgacggcatactgaaccgggtcggccgcgtgcgaacggtactgtatggttcgctcgccctgaccggtcttgggcacggtaccgatcgcgccacggtggcgggcttggaaggcaacgtaccgaaaaccgtcgataccgatcacatgagcaatatccgtatggaatgcgaggcaggcggcgagctgatgctcaacggcacgcatcgcatcgatttcgattacggacgcgatgtggtgatggatgtatggcaccgcatggcggcccatcccaacggcatgcgattccaagccttcgaccggcagaacaatctcatcgacgaacaggtctggtattccattggcggtggattcgtcagacaaggcgacgccgacgacctgatgatcggcatccatgagaaaccccctgcgggaacggccttcgccgatcagaccgacgattcctcaaccgatatcgatatggatatgccctatccgttcaccacatgcgacgaactgatctcgctgtgcgatgaacatcacatgagtgtggccgatgtggtgtgggccaatgagacggccatgcggtccgccgtgcaggtgcgcagcgatttggacactgtatggcatgtgatgcgccgctgcgtgcagcacggttgcaataccaaccaaaccgttctgcctggcggccttgacgtgccccgcagggcgccaaaaatgtatgcaaggctcgcatccaacagcgacgtgctcaaacgggacggcaggcgctccgacgctgtactcgaatcatcggacgccgcatgggtcgacctgttcgcattggcggtttccgaggagaacgcggcaggcggacgcatcgtcaccgcgcctaccaacggtgcggctggcgtcattccggcggtgctccactattattggcatttcgtggatcatgcggatgaggatggtgtggtgacgttcctgctgaccgcaggggcgattggatacttgttcaaacgcaacgcgtccatttccggtgccgaagtcggatgtcaaggcgaggtcggcacagcctgttccatggccgcggcggggctgtgcgccgtgatgggcggcacgcctcaccaagtggagaatgccgcggaaatcggtatcgagcacaatctgggactgacctgcgatccggtcggtggtctggtgcagattccctgcatcgaacgcaacgccatggcggccaataccgccatcaacgcggtccgtatggccatgctgggcgacggcacgcatatcgtgagtcttgaccaagccatcaaaaccatgaaggacaccggcgaggacatgatggccaagtacaaggagacgtcgaaaggcggtcttgcggtcaatgttgttgaatgctagcgatggatggtgctaatcttggtgacactgtgttttttcaaggaggttcaccatggcatctgaaatgcctgttgtcaatgccgaattcggcgatcgcccgaccatcgaattcccgactgagatcgctcccgccggcctgaaggtcgtggagctctttgaaggcaatggcccgatggtccgccgtggagacaccgtcaccgtcaactaccatggtgtggtctggggcaaggacaccccgttcgactccagcttcgaccgtcaccagccggccacgttcggcatcggtgtgggacaggtcatcaagggctgggatcagaccgttccgggacacaacgtcggttcccgcctggtggtgtccattccgccggagtacggttatggctcccgtggcgttccgcaggccggcatcggcggcgaggacacgctggtgttcgtgatcgacatcatctccacccgctgattgacgggtatcattcttccaaggtcaaggaggataacatggccgaagaaaagacgatcctgctgacgcaggaggcgtacgacaagatgaaagaagaactcgcctggcgtgagggcgagtaccgtgacgagattctgtccaaggtctccgcggcgcgtgccgaaggcgatttgagcgagaacggcggctatcaggctgcccgtgaggcgcagcgcgtgaatcagggacgtatcgacgaactgaccgtcaaactgcgcaatgcgaagattctgactgcgcccaaggccggtgaggtcggtgacggatccttagtgacccttgaagtcaacggacgtgaaatggtgtacgtgcttggcacgcgagacctgtccatcgccacggattacagcatcatcagtcctgaatcgccgattggcgccgccatcaatggcgctcatgccggagatacggtgacctataccgctccgaacggccgtgagatttccgtgaccatcaaggaagccaagccgctcgcctgacatacgtgtgacgaaaacaacagcccgttcctccatcgcattcgtacgatgaggggacgggcttattttgttttgtccatgtggggttgattacgccttagggccacaattgcacgatcaccatgtagatggccaccatgtggcaggcgtatcccgccacggttccggtatggaagatctcatggaagccgaacaccttcggccaggggtcgggcttgcgcagcgcatacacgatggctccggcgatatagcaggcgccgccggcacacagcagtatcaccacggtaggtccggcatagggggacatccagaacaatcccatgaacgcgacgccggacacaccgaaaataatatagacaagaacataaagccagcgaggcgcgctgatccagatgacatggatgatgagcgccaccgtggtgcagatccacatgcccgcgatgatggaatcacgccagaatggcgtgagcgcgaaggaaacgggcgtataagtgccggcgatcagcaaaaagatgttcatatggtcgatgcgacggagcacatcggtaacccgtggtgaccaatctcccagatgataacaggcggaattgccgaacagtaccagcgagcaggtcatgaacacggcgcacgcccatttgagcccggtgccatgagcgaggcagatcagcacgatgcccgcggcaagagccaggggagtggcgatggcgtggatccagccacgcaggagcggctttggcctgccatgcacgtcgagtctgattttgcgttcgatttcggcggggacgatgccttcgatttttgcggcatgggcttcgcctttggcgatggcacgtttggcttttgcatccgccttgcgtcgaatgttctcggccttattgtgcgccttcacgcgaatggtctcagctttcgcctgcagggcctgctcgcgtgcttcggcgatgaccgcgcgtttcgcctcgatttctgcgtttgtaggtttcgccatcggatgcctccactataagttacggaaccgtaacctacgttagcgtaaccgtcggatatgtcaatcggcgtttccgcattatacgtgggcatatggtatgcaacctcgccattgatgcgtattatggttgcatggctgatttctcacatatcctgatgacccgtccggatttcggtgacgacgatcgtgaatggttgcaccagttggtggccgattggcaggtgattgccgatttgagtttcgccgacttgctgctaatcctgcagaacggcgagggcaagtacatcattgccgagcaatgccgtccgtccacggtgatgagtctgagagccgaggatgtggtcggcaacgtcgtcccggaatccctgtgcgccgagcttgacgcggccatggactccgaatcggtgttccgctcctcgaaactgcgtacggtcggcaaggccaaggtctgcaacgtgtacgccccggtgcgtcataatggcaagacgcttggcttggtggtccgcgagaccaacatggccacacgcgaatcgaacggccgttatgagtccgaaagcatcagcgccggcaaacagctgtatgagatgattccgcgcggccagttcccgtaccgtaacccggttatgaaccagcgccataacgcacgtgtggcggatggcttcatcgtgctcaccgtcgacggcatcgtccgatacgcgtctccgaacgccatcagctgtttccgtcgtttgggatcggtcagcaccatgcagggggagtatctgagcgagatcggcaccaaactgctgcatgagaacgatccggtgctggaaacgctgccattggtactgagcggcaaagccgcggtagattccgaattggacgccaacaaagccgcggtgtccatgcgctctctgccgttgatggacgccaatggtcgcgtgggtggtatcgtgctgtgccgtgacgtcagcgaattgcgccgccgcgagaaggaattgcagaccaaggacgccaccatttccgagattcaccatcgtgtgaagaacaatcttcaggcggtatccgcgttgctgcgcttgcaggcgcgcaagaccaagtccgaagaggtcaaaaaggagctcaaggaagcacagcgccgcgtgcagaccatcgccatggtgcatgagggattgagccagaccgccgatgagatcgtcgactatgacaaggtcatttccaacctgcttaagatggccgtcgatttggctacgatgcgcgaccagcacatcgatgtcgatttcgtaggcaaattcggcatgatgccggcacaggatgccacgccgctatcgttggtgcttaccgaactgatcaccaattcggtggaacacggtttcgaaggacgtaaggaaggacatatcacgatttccgtgggccgcggtggcaataacctcaacgtggtggtggaggatgatggcaccggcttggcggatgaggagcatgatggcatggctcgctcttccggatcagggcttggaacacagatcatcaacacgttcgtcaccaatgattttggcggaacggtgcattgggagccacgtcgcggtggtggtacccgtgtggtgctcgacatgaaactgcgtgccgcgcaagataactgacctctagaactggaatggcatatggaagggccggtcggattccatcgaatccgaccggcccttccatatgccctgaaaagaatcagacctgcatctgcatggcctgcgagcgacgtgcacgcatcgcgcgccgcttgagcgcgcgccgctcgtcttcgctcagaccgccccaaacgccgtagtcctgattggtgtcgagcgcgcatttcaggcacgcgtcaatcaccttgcaggtacggcaaacggccttggcttcttcgatttgctgataggcggcaccggtgttgccgaccgggaaaaacagttccggatccttatcccggcacgcggccttggctcgccaatcgaaagcactgctcatgtaatcgccttcctcttgccataagtggcgttctatccgttatttagataaccacgaatcggatgatttttcaagactttttcgcaaaagaaaccaagtttttttagaatccttggaattccgcgcattgcacgggacatgcccgtgcttgttggatgaagaccccacgcccggcaatggcatagtcatcgacgccgaaaccgtcgagaaccgcgctgggaatccccatcatcacatcggtggctctctctccgcaaggaaacgcaacacgtgtgaggcaacgttcaagtagggtgctttgcggcttttccacagctgcgattaccgtgacggacggatcggcgagtgcggtcttgagcttatcggcttcgggcatggctgcgaaaggggagagcaattcgtcggcgtcatccacgaaccatatggtgcgttcgtgctgcggcgatgttctgccgtcgtcggtggtccattcgctgttcgtcttgcgtgtgaaccggatggtgcagcgaccggattcatagagacggctggcgcagcagagcagcagattggttttgccgcttccgcatgcgccaatcacggcgatgttgccgtgtcctacgtcaaggaatgcggtggagatgagtacaccgtcgtcgctcaaagcaaaaggcacatggtgccatgcctctcgctgtggcgccgtcaaatcgtctttgcctgcatgtggtgcgagcggcgcggagaacaaaggggagggattggtggtgccgctgaatgccgatgcggtgttgatggcatgcaccaaggaatcaatgtcatggaccgcgctgcagcggaaaggaacagtgcgttgaccgtcatgacagtaagcggcaccggggaaggccggtggaatcaaagctgcatccttggtgccgatcagttcattcgattgcatttggtcggtgacgcgtaggcagatgctcagcgatatgttggccttcatatcggcatggacctgacccatgggattttgcgtgcatacgatgagatgcatacccaaagagcgtccgagcgacgccaatcgattgagtcgctgcatatagtcgggtagacggtcgcgcaatgcatggaattcgtcaatgaccaccacgagccgtgcagggggatgggaaagctggtcgaatctggaaacgcgttcggcacttaccaaggcctccctgcgtgccaattcttgttctatggcgttcagcgcacggacggcatgggcgaggtcaagatcgcagacgttgcccacggtatgcggcagacgctccaaagcgttgaaggtcgatcctcctttgaaatccagaaagacgaaatggagggtttgaggactatgccgaatcgccaatgccatgcaccaactgatcagcagttcggatttccccgagcctgtggtccccgcgaccatggcatgtggtccggatgatgccagatctatatggaatatgccatgttctgacatgccgatgccgttcgttggggaacggacaagccaattacgcacgatggtgcgccatatgagcgggtcgttgtccaggccatgcagatgctcaaaacttatggacggcatgtcggcgaaaagctgagcatggtcgatttcgtttccgttatgatgcgttggaaccggcgaatcgcttccagtaatggtgttgctgttcgtttcttcatgcctgacgcgcatgatcatggtgatgagcatcaatgcgctgccgagcagactcggagcgagcatcgccgcatagagccaatgacgttgcatgcacatgacaatcagcatgatgagctgcgccagcaaaggcgcgctccaactcaatacagtgagatgttgttcgcttatacggtgaggggcctttttgttcatacggccagcatgggcaagagcggcggcatgccgcaagccaatatgagggttgtggtcggagaatgtgggttatccacatcctccggcgtgtcgtcagttttgctgttcggccagcgtgcccacggttcctgcggaatgcgtgccgtgtgagagttcggagaaaagctggatgttcttcgcgtcatccagcagaacgcacgatccgaccccatcgacgtaatagtccggatcggtccaatacacgcttcccgaaatgccatccttgcctgaggcgcttttgaaagccaacgccatccgaagcagagaggaagtcgatgctttctcatccacggttacggagctcaacgccgctgcggcgacctttttggtcttgttgaaattcgtgagcgtctgtttggaagcgcccttcttgacgatggcgttgatcacctggcgctgacgtgcggcacggccgaaatcgccttgcacatcggcatatcgcatacgggagaacgccaaagcggtgttgccgtccacggtgtggcatccggcggtccagttcatacccgaataagggtcattcacattctggtcgtagcataggtccacgcctcccaaggcatcgaccactttgacgagtccgccgaagcggaccattgccacatggttgattttctggccggtgatgtcctccacctcattgaccaactgtttgcggctgtacagctgcgccacggcgttgatcttcatatagctcccatcgatttccaccagggaatcgcgaggaatggaaatcagcgaggacgatcctgttttcggcttggtgagtacaagaatggtgtcggttctgaaaccttcgacgtcaccggcatctccgatggtgccctcacgttcgtcggagccaagaataagccagctttcgccggcggtgtccgctttggatgtcagccaggtctgtttgttgagctggtcatcgacccagttccaagcggagaatacccctattcccagtgcgagaatcagtacaaggaaaatggaaaggacgatacgtccgacgcgaggtcttctttttggcacggaagccgtcgctggagaggatggaacagatcggagcgccgtggagacggaggatgacccccggaactgctgcgttggattggccgtgcgggtatgttctggagcgaaggacaccggagatgatgaagggtttcttcttgtctcgctcgttgcccgtgccgcaggctggaagctttgcggaaccgaggaagaaggacgcgccgtgcgtttggccggttttacggatgatgcatggtcggaacgtttcgccggtgcgaaactcgctggctggctcggtgcgctttgcgagcgggaggaatccgtggacggcatggtttttttgcgtcctgatgacggaatgaaacttggtggcacgctcgtaggctcttttgctcctttgccttcactcatggttcctccaaaaagattcgtccctgtgtcatacgttgaaaggggacgtgattgcgtggtctacgtcagttctttgccggaacggcacatacggtcgcattaaggtatcgatccgcaagcccgatgtactggcccgtggtcgcgtcatgaatggagccgtcatccgggtcgacggtgccgccagtgctcggatcgaccaacgtgccgtcggatttggtgatcagtcccgtgacgggatcgggagtctcggcagtggtgtccgactggttgctgtcggtcgtgccggaatcgtcggagctggctgaattatctgaactggtgtcggaggagccgcccgagtttgaatcggcggtatcgaaaatcggcttgcccgctcgcatcttctcccagagattgtcggcttcgtcggtccagacggaacggttggggtcggacggtgctgggaccacggggacggtctgggtctgcaggttggtcatggtgaaattcttcaggctcatggcaagtcccgccaaagccgcggtatcagccatgccttgggatatgttgagcgatttcagcgcggatttcgccagctggtacagctgcgcggtatcagtgaacagattcttgctgagcgcctcgctcatcagctgcttgatgagatactgctgacgtgtggtacgcgaggtgtcggatccgtctcctatgccgtgacggatccgggcgtactgcgtcgccgcaacgccgtcaagatggtgcatgcccttgtcgagattgagtccggtgtacgggtcgttgacgttctgcggaatgcacaggtccacgccgccgactgaatcaatcatcttgaccaggccggcgaagtccacgacgatgaagttctgaatattcaacccggtgagactgttcacggcgttcagcgtgcagctggccgccgaggagagatctccgccggttttgtaggcacctgcgaagatggaattgaacatgacgttatactgtgcgggaatcgtgcccttcgacgtttcgcactgaggcacgtccaccagggaatctcgtggaatggagaccaggttgatttccttgcggtcggcggagatctgcacaatcatggcggtgtcggcctgatggttgccgatgacgtcatcgaaactgcctccgatggcttggttctccgcgccgtcacgggaatcctgtccgatcagcacgaactcgatcggcttgccggagttcggatcgatgatggatgcgtccgtattcagggaaccctggccgatcacgccgaccgaattgttcttgatgatgccattgacgtccatccaagtagcggcagctgcagtgccgacgaacaccagagtcgcggcgattgccgcggcgactgcggtcctgacgtgatgctgcacgcgatatcccaggctgtgacgtggtttcgcatcctgaagaccattgatgttaggaagcttattgccggttgatgacgttgccacggtgttgccttcctgattgagatgcgcgtttgacgcaatgcttttagaacctaccactatccaaatgggcaattatagggttaatggccgattttcaccgattctgcgactgtagaccccagattgggctgaactttagcatggattttctgaaatataggcattgacacggggaaacttgacaaaattacattgcgtgtgtgtaatttgaagcggtgtgaaagtatgcgcataaaaggtgcgcacacaattatgggaggactcatgtggggcgtgactgatgagtcttctgagaatccgcttgctgaactgtggggtttgttcaagcgggatgatgacgtgtcttggcagcacaaagcgctgtgctcgcagaccgatcccgaagcattcttcccggaaaaaggcggttccaccagggatgcgaagagggtttgcgcccagtgtgaagtccgtgaacagtgcctggaatgggccatcgaccatgatgagcgtttcggtatctggggcggtatgagcgagcgtgagcgtcgtcgctacaaaaaagagcacaaggaacgggcttgaaggcatggtgcgtcccgtgcgtacacttaaattatgaattctaacgccagcagcgatatccagacaatcgtgaccgatgtgctgaacagcagaccgtatacgcatcggcaggacgtcgatatgtccgtggctgcggtgatcaccgcgcagcatgaccttcgattcctcgcttctaccgttggagcggtgcttgcgcagcgcatgcttccaggaatgatcgttatcgccgattgcacggggcagatcgagcagcccatgcagatgaccttcgatgtcattcactcatcacaggatgtgcttacggaagtgccggaagccaaaacggtgagggtcattctggtgggagtgaagcaggcggcgtccttcatggacgctgtaacgcgtgcgatggatcagatcggcattgatgccggcatccgcgcgttgtggaccttgcatgacgattcgcggccggcggatgaccggtgcttcgagacgttgctggatgcgtggagaaacacgccgacagccgcgctgctcggtgccaagcagttggattggcaggcgaagaacctgcacaatgtgggtttgtatgccgggcaccatgatgtcgtttccttggtggtcgacggcgagcctgaccaggagcaatatgacgggcgtcaggatgtgctgtcggtctccctatcgggcgcgttggtgccgttggctacgttgcgtgcgttcgaaggggctgacccctggttcggcaccttcgcggaatccacggacctgtgccgccgcatatgtcttggcggtgggcgtgtcgtagtggttccccaggctcgcatcgcccacagaagagcccgattcgaaggaatccgttccaagaacgggcgccctgtggaagacgaggacggtcgcatcgatccgtatcttgccgtacgcgaggcgaatgccaaatacgcgtacactgacatgcaccgttcatggtggccgttgctttggctgtggtccatcatccagtcgttgggattggccgtgctttgcttggcgcgcaaacagccgtatcatgcatgctgcgagctggcgatgccgtggcgtgcgctgctgcgtctgcggggtgcttggcgcgcccgtgcgcggttacgcaggcaaagcaaggtcacgcttaaatcgctatccacgctgtctgcgaatcatcggcaggtcagggaatggctcgaccgtcgccgtgcgttgcgcgaccagagggatgtcgtgctgctcagtcctcttgagaaggaccatctgcgtaaacggttgctgcgtagatggggattggccttcggcgcggcgctgattgccggcatatggatagtcgtgctgtattgggacgtgcttcgttccgtatgttcgggtgcgtcgatgtattccgcacagctgttgcccacgggcgcgagcttcacccagttgcttcataccgcgaccacgtcatggtcgtatgcctcaggcacgggcatcagtgcgcctaacgcgccatggctgttggtgcttgcgctggcgtcggtgctcactggtggacatgttgccggagctgtcggactgatgttcttccttgcagccccgctcatggtgttttccttctgggcgctggccggcatcttcacccgctcggatgcggtgcgctgcgtggtcgcgttggcgtggttcgcgttggcgttgtccatgggactttatgatgacgcggatgtcacgatgctgacggtcatggtgtttcttccggccgctttcgccttctcgttccgtgcggtcggcatgtatcggacggaggatctggtcaatccccacgcgtcggtccaggcggcggcggttgcggcgctgtgtttcattccggtcgtcgccgcgcagccgcagttgttgctgccgctgatgctcaccttcctgggattcctgctgttcgtccgctcccataagcccgcgttgcttctgattccgcttccggcggcgttcgtatgcgcgccgacgttggtcaatgccgttcgtttcacttccgacggtacatggcgtcagctgttcggcagcgtcatgctgccctcctccgcgtatgatggcaaaccggtcgtcgcgaatctgtccgatctgttgctgcgggtgttcggcatcggcgccgacggtggtgcatggcggtatgtggcggtttccatactggcgttgatcgtattgctggccgcggtgtcattggtgttgcctttcgtgctgcgcgtgtcccgtatgatgtgggtcgccgtgttcgcgggattggcgacggccttgctgtccgcggcgattgcggtggccgtcgatgtggatggtccggtctccggttccatgcttccgggaaccacatatgcgatgatgggcttgctcgcctgcatctgcatgatgtcgggcggcgcggttcgacgtttcgtcatgctgagacagcatgagaagaccggcgccgtcgaaatcgaaggacgcggctcgaaggcagtgtcgattgcctcgcatgtgggtcgtgccgtattggtttgcctgctggccgtctccgtcgtggcctgtgcgggattcaactatgtcgaatgcgatcacagccaggtaaagaccagcgatgctggactgccgatggtggcgaccgatttccttgggcaggatgatgcacgtcgcgtgcttgccttgcgtgccgatagcgccgagtcggtcagctacagtgtgatgcgtaccggtcgtggcgacttgattgacagctctcccgcgcaacgcgtcgaagtggtttcgggacgttccgacgggtccagcagaaccattgcgcaggattgcgcccagttgctggccaatgccgattccgatgccatcaacgagcttggcaagttgggtttcggcggcatttacgttatcaagcagaacggcgacaaagcgcagcgagaggcctcgaaccagctcaattcgaacattggagcctccgacgggacacagaatgtcgtcagtctggataatggcacgtattatcgtttgacggttcaggatctatccaagcagcatatcgatcgaagcgggcttgataaggccggctcaagtgtgtggcgtcgttcatggctgtggtgcatgggcgtcgttcttgtagcgtattgcctggtggcgcttccgcgcattcgtcgtcagggtctggaggaagcatgagcagacattctcgtcccaatacgcctttgcgtattgcgcttgccgtaatctcagtgttgctcatcgtggtcctgatggccgtgacgctcatataccggccatcatggctgcatgcggacacgcccacggtggaacgctcctcggtgggtcgtaccgtcagcccccggcagcggcagacgtactgcccgtctcgcatgaccattgccgataccgatgcctatggagatagcgaataccaggcatccaacggcaatatcgcgtcttccgcgagatacgccgccttcggttcggtgttccattcatccgtcgcctcgatgggagccgacatgacggcatccgtgtcgatgctggacaaaaaagacgactcgtccgatgacatctttgtggcttccggcaatgtcgatgacggctctcgattgcaagacacgcgtctgctgacggcttcgaacggtaccggcgcggtttcctcagtgatgtcatgggccacggacggtgatttgaagggcgtatcagcagcctcctgcgtcgtgccggcgctgaaacaggcgttcctgctttccggtacgaagaccggcttgacgcaacagcttgttgtggccaatccctccgccaaggacacatcggtgaccatcagaatctggggctccgacaaatccggcgcgctggcgctctccaccggatcgacgctgaccgtggcctcaggcaaggaaacggtactgaatctttccgcagctgcttccggccaagacgcgctgtatgccacggtgactggaactgacactcctgtggccgcaatcgtccgcaccgtctccatggacggattgaccccaaagggatcggattatgcgcttccgaataacgctttcgcgaaatctctggccctctacggcttgaatggcggagaccatgcgacactgtacctgtatacgtcccgcaaaacggatgtcaccgtatcctggattgactccaagggggcgcagcagaccaatcagcaggagctgaaggcgaaccgcgcgtccgccatcgatcttggagacgttccaaaatccgctaccggcatcgccatagccgcttccgaaccggtgtctgccacggcgaagatttcagacgatggccccgatggacaatccgatttcgccctagtcaatgcgtccgctccggcgaagatctccgccatcgcggttcctgaccaatccaccgcgacggtaggcttcgtcaacaccgcggatgaggatcggacagcgatcatgacggcttacgacacggacggcaaacaagtggacaggcgtgaaatcgccatccgtccctcggcttcgacgtcggtgcgcatcgccgatattaatgatggcgatgtcgccgccatccgtttgaaggatcccgcccaagccgtggtctggaatcttcgtgtcggacagaaagatgtgtccggtgcgaaactcgccggacttgccatcatcggcgccgtcgatttgaaggaggccagagagcagatctgggcgaatcaggatatgactgttgtccgttgaaagtcacatgccccaatcaggatctatttcttccggacggcgtccgtagatttccgccagacgtgagaccacctcgtccctgattgcgaattgcaggtccatacggttacgggcatgcgattgcagcggcatgcggtacagcacgatacggggtggaatgccgtgtccggcggggaatgactgcgatccaagatgcggaacgtcctcccaaggcgcgggatcggatggcggaacatcctccacagcgaattggaccggagctatgagttcaggccatgccccgttgagtctgcggatttgcgccaccagcatatcgtcgaacataccgcttctggtacggtaccggggcagtctggtaccaaacatgggcgtacgcgtgccacgtccatggcggttgcggtatatcggggtctcccaaggcatctgttgcatggtttctaccttatcagggcttattcgaaacatgcgataccatggtatgggctgctcgacaaggggagaaatgatcatggcggatatttccgtaccttattggaacatcgttgatgtcaacatgttgtgcgaaggcgcgcggctgattgggtttgacctcgacaacacgttggcgcggtccaagaaacctatgaaagcggacatggccgaatgcttctctgcattgacatcattgattgacgtcgcggtgatcaccggcggcaaatactcgttgctgcaaagtcaggtggtggacaggctgtccgaccatgccgacaagtcgaaacttcacctcatgccgaccagcggaacccgctactaccggtgggacgggcaacggtgggggaaagtgttctcccacgatctaagcgacgaggaccgtgccaaggcgaaggaatcgctggaacggaatgctcgtgagcagggcatttgggccactcatgtctggggcgagcgcatcgaggacagaggcagtcagatcaccttttccgcattggggcagcttgcccccgtcgaggccaaggaggcatgggaccccaccaacgagaagaagaaccgattggcctgtgcggttgctgccgaactaccgaatcttgaagtaagacctggaggctccagcagtgttgatatctcacagcgtggcgtcgataagtcgttcgccgtccgtgaactcgcggatattctcgatatcgaggtcggtcagatcgtgttcatcggagaccggatggaacccaacggcaatgattatcccgcggcgaaggccggcacaagggctgtcaaagtgaacggtcccgcggataccgtgaaattatgcggcgagattatcgccagattgtcccgatggcggagccggtgtgaatctgatggcgggctcattcgcgcatatggcgaatctgttgttcccacgaggctgtgcgggatgcgacaagcctgatgacgtgttgtgcgatgcctgtcttgcgtcattcgactgcgaactgtcccagccattggaaacggctgagatgggtcgatggttcgcgtgcggatggtatcggggtgccgccagacagtcgattctggcatggaaagaccacggagacgaggaatgcgaccgtccgttctcggatgcgttgtgcaggcttgcggaacgcgccggtgtgattgatgccatggatggcgttcgtgagatctgcgataccatactggtcgttcccgcgccgtcgtcgattgcttccatgcgtcagcgcggacgacggcacatgatgccgctggcaaaacggttgtcggcgtttctacggtgccggacaggtttccgcgtacaggtatgcgatgcgttgacgaacaaaggaatcaaaggcaaatccgtcgagaccaagggcacggaacagagggcgcaacgccttaaggggcatgtcatggttcgtccgggcgtcacccttcaaaacaaggcggtgattctggtggatgacatcgtcacctctggagccaccatgcgtcgttgtgttgacgctctaacttcacagggagctttggtcattaccgtgctggcgttggcacacactccggccggcagacctttggcggcgtaaatcgtcactcgtcatcggaaatgtgatatttcggcaaagtgatttcgaaatcggcgccgcgcggatcatccaccactcgtaccgtgccgccatgcaattgcgccgcccatcgggcgattgacagtccaagaccggttcctcccgattcggtacccggtcccgtcttgcctttgacgaatcgacggaagatatcggaccgcgcttcttggggaatctgcgagccgaagttgacgacattcgtcacaatcgtgccgaaatccttgttttcatgcgcttcgatgagcaccgcggtattgtctgcggagtgtttgagcgcattggcgatgatattggtgaacaactggcgcagacgatcctgatcgccttccatttcgatgtcgtcgggcacgtggatttcgatattgtgggcatgcccggcatcggcgatttccaacggttccacggtttcgtcgatgaaatccgcgaaattgaatttatcgatctgcaggctcgccgcaccggcttccatgcgggacaaatcaagcagaaacgcgatcagatccgacaaacggtgcgtttggttgagaatgctttccagattcgatggggtcggttccacaacgccgtcggccatgttctcgaccatggcctgcaacgcggatacaggcgtacgtagctcgtggctcacattggccaccatgtcccgtctcatctggtcggcatgctgcagttcctccgccatctcattgaaagacaaagccagctgtccgacctcgtcgcggctgttggcatcgacatgcacccggacggtgtagtcgccgtccgccatagcctccgcggcatcccgcatctcgcgcaggggagaggtgagtcccctagagaagaaataggtgatgcccaaagccacggcaagggtgatcggcatggctatccacaggctcaatccgactttgagcaggaaccaagccatgatgaacgcgatgatggtggaaatggtgatcagcacgctcaattccattttgagcgaagagaacaaaccaatagggcgttcggtatccaacggattgaccgaacgccctggttttgaatcagtggtacgcataccaccaaatcttagcgcatcatactattcttccggatcttagcgcatcatactattcttccggcggttcgaacgcgtagcctacgccatgcacggttcgaatggtcttcgaacccagcttgtgacgtagcgccttgacatgcgaatccacagtacgggtgccggacgcatccacccaatcccacacttcctcgagcagcttctcgcgagtgagcacggacttcggtttgcgggccaaagtggccagcaaatcaaattccgttggggtcaaatgcacctgctccccattgacggtgacgatacgctgggccggatcgatgaccagagagccgaaatcaagcagtttctcgttttcggagttcttggcgatgaccttcgccctgtccacacgacgaagcagcgccttgcaccgggcgatgagctcgcgcatggagaacggcttggtcatgtaatcgtcggctccggcaccaagaccgatgaccttgtcggcctcgtcgtctcgcgccgtcagaatcagcacaggcacaggacgttcagccacgatgcgcttggtggcctcaagaccatccatcacgggcagcatgatatccatgatgaccagatccggacggagcgtggaagcggcctggacggcgctggcgccgtcggaagccacgcgcgcggtccaaccctccgcagtgatgcgctgcgcgatggcggtggccaaggtcggttcatcctcgaccaccagaacggtacgtggaattactgtggattgtgctgatgaattgagcatagcgttccgcctttctcagagttccggcttcaagaatactgctcccagtgccggaacggtgattttcgcggaccaatcacgggaatgatactcacccttgaccgccttgaaggtgccgttgtgaatatcggaaccgccgtacttcttatcgtccgtggtcagcacttcggtccacttgccacccttggtgagcggaacctggtaatcctcccatgcctcgcccgagaagttcacgacaacgaccatctgctcgccatccttgccgatacgcacgaagctgagcgtgttatggtcggcgtcatcgctggtcagccattggaatccggcaggatcgaagtcctggctccacaatgcgggagacgccttgtacagggtgttcaggtcggcgacgagcttctgcacgccacggtggtcaggccaattgagcacatcccaatccaccgaaccgtcatgatcccattcgccgtactgcgccacctcattgcccatgaaggagagcttcttgcccggatgggcccactgataggcgaacagcgcgcgcacgccggcatagcgctgccagtcatcgcccggcatcttgccgaacagcgagcccttgccgtacacgacctcgtcgtggctgatcggcagcacataatgctccgagtatgcgtacaccatggagaaggtgatctcgttgtggtgccacttacggttgatcggctcctcgtgcagatactgcagggtgtcgtgcatccaacccatgttccacttgaggccgaagcccaaaccgccggcatcggtcggtgcggtgatgccgggatacgcggtggattcctcggcgatcatcatgatgcccggattgttcttgtacgcggtcgccgtggcttccttgaggaagtcgatggcctcgaggttttctcgtccaccgtagatgttcggatgccactggcccggcttgcggctgtaatccaagtacagcatcgaggagaccgcgtccacgcgcagcgcgtcgatatggtactcgtccagccagaagcaggcgttggccaccaggaagttgcgcacttcgcggcgtccgaaattgaacacgtaggtgccccaatccggatgctcgccacgggtcgggtccggatcctcgtacagaggcgtgccatcgaatctgccaagggcgaacgcgtccttcgggaaatgcgccggaacccagtccatgatcacgccgatgccggcctcgtgcatcttctcgacgagatacttgaagtcgtcagggccgccaaggcgcgaatcaatcgcgtaatagccggttacctgataaccccacgagccggagaagggatgctcggccagcggcatgaattccacatgggtgaaaccttccttctggacgtaggggaccagcttgtcggccagttcgcgatagttcttcacatccttgcgccagctagaggcatggacctcgtagatgctgaccggaccgttgtgcgggtcggtcttggctcgctggtccatccagttctcgtcatgccacgcatggacggagtcgacgacgatggaaccggtgcgcggcggaatctcatgcgaacgctccatcggatcggccttcatgacccattcgttgttggcgttgaggatctcgtacttgtaaatcgttcccgttccgacaccaggaatgaacagctcccagactccagaggagcccagttcacgcatggcgtgggtgcgtccgttccagccgttgaaatctcccaccacacgtaccgcatgggcattcggagcccacacggtgaatgcggtgcccgccagctgttcgcccttgacgccgtcattggagcccaacggatcgtcatagcgcagcacgcgcgctcccaaagcctcccaaaggcgctcatggcgtccctcgccaaacaggtacatgtccaaatcgccgatggtgggcagataacggtacgggtcgtcggacaccacggtggaaccgtcttcatattcggtgctgatgcgataatcgggcacgccgaagccgtcatcggtcttgatggccggaatgagtgccatgaaaacgccattgtgttcatgcaccgcctgggttcgggcattttcggtgatgatcgtcacggatttcgccaacggacgaagcacgcggatcgtgacgacatcctcatgctcgtcgggaccgagatgcccgccgagcacctcgtgtggattgtagaacgtaccgttgcttactgcatccaggtcgccctgtgcaacaggaacggcaacgctatcttctttgatcttggattctgtagccatgggaaaagtgtaagcatgaaatgcttgaaaattggcccgtgtcgcgtctttttttggttttttggcggatttttaggcaagtccaaccctgatggcacaataattcgggttttgtgtaagcttttcacggaggattcatgggttacaaggtcggcgacatggtcgtctatccgcgtcacggcgcagcgaaggtggaggccatcaccgagcgaacggtcaagggtgtgacccgagaatatctgcagctgtcggtgctgtcgtccgacgggctggtcatcaatgttccggtggagaacgccaagaaagtgggtgtccgagacatcgtcggcgccaaggaggtcgcgaaggtcttcgagattctgcgtactccgatcatcgaaaaggaaatgaactggtcccgccggtacaagctgaacgtcgagaagatcgccaccggcgatgtgaataaaatcgccgaagtcgtgcgagacctcgcccagcgtgatgtcgacgagcatgggctgtccgccggtgagaagcgcatgctcaccaaggctcgcagcatcctgacttccgagatcgcgttgtcggagcatcttgatgagaatgaggcccagcgtctgcttgacgtgaaccttggttatgaaccgccgcgccctggcgacgaggatcatcacaccgaagctcctgaagaggcggccatggacactttggcgcgcgtcgaggcggagaacaagaagtccaagaagaagtaagggaatttccatgcgtatcggtcagggatttgacgcccatcgattcgcgtcccatgatgcaggcaagccgttatggcttgcctgtttgcgttgggatggtgacggcatcgaaggcgattcggacggtgatgtcgcagcccatgcgttgattgacgcgttgctttccgcagccggattgggtgatataggcatgcttttcggagtcggttccgattccgccggtgccggcaaacacggcgacgagatgctccgcgcgacggttgcgtatttgcgtgcgcatggcatgaggccggtgagcgcaagcgtggtcgtcgtggccaatcgtccgaaaatcggcaagcgccgtgacgaggcgcaacaggcgttgagccatgccatcggctgtgaagtgtcgctgacggccaccactaccgacggcatgggattcaccggttcgggcgagggcatcgcggccatcgccagcgccttggtggaaccgatcggctgatactttcgctacctgcggcgtgccgattcgattattttggcgacaatccagaacagtgtggaaatcgtcacgatgatgaagctcgggggagcggggaacatggcggaaaccaacagtccaccccaaatggagatcaaacagatcacggtggagacgaccatcgcggcgaatggggaccgtgagatgatgttcgcagtcgcggcgggcgtgaccacaagagcgaatatcagcaacgtgcccacggcgggcaccgcgatggtgatcacaccggccataatggccatgaagcagatgttcatgagattcaccggcacgccttttgcctgcgccacctgttcatcaagcgagctgaacagcagcggtcgatagataacggccaaaacggccagcaacaacacgtcgaaaaccgcaaacccgacgatctgcccgtccgtgattgtcaggatggagccgaaaagaatcgattgcatctgctgcgaggcggaactggacaagcgtgcgaaaaacagacccatgcctgtggcgaacgccaatacggttcctgtggcgatttcgcgttgcgatgcctttttgcccaatgcgccgatcaccaatgctccgccgagagcgaacacgccgagaccggcactgaccggcagactcaacagcacggctccggtcgctcctggcagcccgatgtgcgccagcgcatgcgcggcgaacgtggaatgacgggcgatggtgaagtaacccatcactccagcggccaaggcgatgcacaggccggcgaggaaagcgtttgtcatgaatggcgcggtcagcgtgcccatccaatccggatcgaaggagaaagcggtttcgttcatgatcatgcctcctgcgaaatgcggttgtgtcggtggaatcttgcgatttcctccggcgcgtgggcgtcgacgtcaatgtcatcaggctcatcctcgcttggagtgacgaacatatctccttggggagtggtgaccacctgcaccgtggtgccatatagatgggtgagcagcttcgaatccagcacctcgttcatcttcgcataatgcggatgcccgtcgagcagatatacggcaccggtgagaatcggcagaagcatgttcaaatcgtgcgccactacttgaatggacatgccgagttctcggttgagtttggcgagcacgtgcaccgtggcacgttggctggccagatcaagattggcgagcggttcatccaacatgagcagttgggggtccgacaccagcgcctgcgcgatggcgacgcgttgccgcaggcctcccgagagctccgacagccggtatctcgccttgtcctgcatgtcgacgaattccagcgcattgcgtactttgtctttttgcaggcgggtgatgggatgaatgccgaaccttgccccggtcaggccaagcagcaccgactgttcggcggtgatgttcgattcgatgtcggatgcgtagctctgcggcacataccctatacggtgattcatggcgccggccggcttgccgagtacggttatgccgccgtgggcgatgggaatcaatccgagttcggctttcatcatggtggttttcccggttccgttggtgccgacgatggctgtcaccgagccttgcgggatacggaaggtgccatgctgccagatgatgtgtccgccgcgtgagacccctgcgtcgtcgaattcgatacagaatgatgccttgtcgtgcatggctcgctcccttgataagtcaacgatagtattctcacaaacggtgttgacaatcattctcaataagaagcatgcatggacgatgaaaagtctcatgatgaatccgcctggatcgtaactgttgctgggaaaaagaattcgccgatgtcggggaattgctcgacatcggcgaatcggggggagggaggatggccgtggctttatttaccaggatccgtctgccctgtgttgtccggcgttgcggcgtcggaatcggagtcgggattgtcgctcgacggctgctcgccattcgattcagagggagagacgtccgaatctgatgatgtcgcatcatctttggaggaaaccgcctcattcatttgcttgatgagctgcgcgatccatgagatcaggcttttgctgtcggccggcatctgttccgtgacgtcgatgaccggcacatcggatttgtgtgcggtgccggtcagaatatttgtggcatcctccgccttctgaacattgttgatcagcatatccacttgatgaccctccagaatcttctggaagtcctggagttccttggacgagggctgagagccttccgagatggactgcgtgtagctttcgggagtcttatcggataggcccatgtcgctgagcagataatatgcgaccggctcggtggctgcgtaggagacgttcttatgcgtatcggagaactctttcatgcttctctcgattaccgtctcgcgtctgttccacgccttgagtttgtttgtgaaatatttcctttgcttgggcatgatgcggctgtaggtgtcggcaagctccttcgccatggcgttgcgtgcgtcgctggagaaccagagatggggattgtctccctcaacggctccgaccatttgcgcggccgaaacggaaacggtgtctctttccaggttttttgtggcccaggagtcgtatcccgctccgttggacacgacgacctgtgccttctgcagggtgtcgacagcagtggtcttcggttcgaacgtgtgggcgtcctctgttgtggaggacagaatcgaggtgactttgacgtgcgcgccgccgatctgctccgccagagccccccactggttgaccgacgccaccacgttgatcggggtggtctgctcctttggtgcgtcgggtgccgttggttgattgggctccgaagaagcgccaaagcaggaagcggtgcccagcacagtgcacaatgtgattcccgcggcaaggatgcggaaaaatggacgctggtgagagcgcatgtcgattgccttcctcttgggtcgtccgtcgtttcggtcgtgtccatctcatatagcacatgcgcgacttacgactgaaaccaagatagcctacgatacttgcaaatgccaatacgacaagcgacttagcgaggaagtggaccacatgggaacaaggattgatggcaaaaaggtggcggcacggaccaaggcggacctcgccaaacgcgtggaactgctgaaggcgaggggaatccaacctggattgggtaccattttggtcggatcagaccccggctccgtgaaatatgtcgccggcaaacatgccgattgcgccgaaatcggcgtgaattccatcaagcgcgagctgcctgagaatgcgacgttcgatcaggtcgccgatgcggtccgccagctcaatgcggatcccgcctgtaccggatatatcgtgcagctgcccttgccaaggggaatcgacgagaacgccatcatcgatctgatcgatcccaagaaggacgccgacgggatgcatccgtataatctcggcgaacttgtgctgcatgcccgaggagacatcaccacgccgttgccatgcacgcctcgcggcgtgatcgagctgttgcgcgcctacgacatcgatttggacggcaaggaggtgtgcgtgctgggccgtggcatcaccatcggccgcaccatcggtctgttgttgactcgtaaggcggtcaacgccaccgtcacgctgtgccatacgggaaccaaggatgtgcgtgaccacatgcgacgggccgatgtgatcgtcgcagccatgggagtggctggtttcgtcaagccggaagacatcaaggaagggtcgattctcgtcgacgtcggagtatcccgcgtgttcgacgaggaatccggccgatacaaggtcaagggtgatgtcgataaagcctgttacgagaaggcttttgcatacacgccgaatcctggaggcgtagggccgatgacgcgtgccatgctgctgcagaatgttgtggagatggccgaacgtcagttgtgagtttcgcgatagtgctttcgggcgtgtcgtgacatgcgacacgcccgatttttgtgcatggcttcttgtagactttcgccttgtgtgtatttgcgcacacgtataactgaagaacgattttatccatccactattttgtaagaaaccacattaatggcagagaacaataacgaagtcgccaaggtcgccatcaacgacatcggcaccgaagaggacttcatcaaggcagtcgattccaccatcaagaacttcgatgatggtgatctggtcgaaggtaccgtcgtcaaggtcgatcatgacgaggtcctgctcgacatcggctacaagaccgagggcgtcatcccctcccgcgagctttccatcaagaaggacgttgatcctgacgaagtcgtcgaggtcggcgacaccattgaggcccttgtcgtcaccaaggaagacaaggaaggccgtctgattctgtccaagaagcgtgcgcagtacgagcgcgcttggggcgacatcgagaagatcaaggaagccgatggcgttgtcgaaggcactgtcatcgaagctgtcaagggtggcctcatcgtcgacatcggtctgcgtggcttcctgccggcatctctcgtcgagatgcgtcgtgtccgcgatctgtccccgtacatcggccagaagatcaaggccaagatcctcgagctcgacaagaaccgcaacaacgtggtcctctcccgtcgccagtacctcgaggagacccagtccgaagtgcgcgagaccttcctgtcccagcttaagaagggccagatccgtgaaggcgtcgtgtcctccatcgtcaacttcggcgcattcgtcgatctgggcggtgttgacggcctgatccacgtttccgagctgtcttggaagcacatcgatcacccgtccgaggtcgtcaaggtcggagacaaggtcaccgtcgaggtgcttgacgttgatctcgatcgtgagcgcatctccctgtccctcaaggccacccaggaagatccgtggcagcgcttcgcccgcacccacgttcctggccagatcgtcaagggcaaggtcaccaagatcgttcagttcggtgtcttcatctccgtcgaagacggcatcgaaggcctcgtgcatatctccgagctggccaaccgccacgtggagaacccggagaccgtcgtcaagccgggcgaggaagtcttcgtcaaggtgattgacgtcgatctcgaccgtcgccgcatctccctgtccctcaagcaggccaacgactccgttgatccggcttccgaggacttcgatccggctctgtacggcatgccggcagagtacgacgagcagggcaactacaagtatccggaaggcttcgacccggcaaccaacgagtggatcgctggttacgagaagcagcgtgaggagtgggagtcccagtacgccaccgctcacgatctgtgggagcagcacaaggaattcgttgccaaggaactcgagaacgccgaggcttccgcagccgaagacggccaggctccgaaggaagagaaggtcgaagaggtgtccaactactcctccgacaacacctccaacggcaccctcgccgattccgaccagctcgccgctctgcgcgaccagctgctcggcaagtgagtttcgacgaatcaaaataaactgattcgcgtaaaccgctgataaatggccccgcacctgatggtgtggggccatttgcgtatgttgcgagtccgtcaaacattacaatggcggttgtgatgattcgaattgggttgaccggaggcatcgccgccggcaaaagcaccgtcgctacgcatctgcgtgaactgggcgcgacgcttgtcgattatgatgtgctcgcccgaaaagtcgtggaacccggaagcgtgggcctgcaacgaatcgtggaacatttcgggccggatgcgatgaacgcgcaaggtggtcttaatcggcgatggatgtccgaacacgtcttctccgatccgaatgccgaatccgaacgtagaatccttgacgatatcgaacatccgttgatctacgatcttgcattgtcggaggaacggcaggcggtcgaaaagaatccggatgccgtggtcgtacatgatattccgcttttggcggaagtaatcgatgacatacccatgcgtttcgaccatatcgtaacagtcgaagcaccggaacagacgcgtgtggaacgtatgatgcgcacccgtggcatgagtgaggcacaggcgaaggcacgtatcgcgcatcagcccacgcgtgcggcacgagaatccatagccgatgcggtgattgactcatcccaggatgtagaacacatgttcgactgtgttgataggctgatggaacagtggcgtaaggaagcgagacggaaccatgggattcaacattgaacgagtgaacaagccgtttgtggtcaaatctccatataagccttcaggcgaccagccgaaggccatcgaggagctggccacgcgcatcgagaatggcgagaacgacgtggtgctcatgggcgccaccggcaccggcaaaaccgccactacagcgtggctgattgaacgtctgcagcgaccgacgcttatcatcgagccgaacaagacgctcgccgcgcagttgtgcgccgaattccgcgaactcatgccggacaatgcggtgagctacttcgtttcctactacgactactaccagccggaagcgtacattccccagaccgacacctacatcgagaaggattccaacatcaacgacgatgtggagcgattgcgccacgccgccaccgcgaaccttctgacccgtcgcgattgcgtggtcgtggccaccgtctcctgcatctacggtttgggaacgccggaagaatacgctggccgtatgctgttcctccaggaaggccagcagatcgaccgtgacgatttactgcgcaaattcgtggacatgcaatacaagcgcaacgacatcgccttcacgcgaggcacattccgcgtgcgcggcgacaccgttgagatcatccccgtatacgaggaactggccatccgcatcgaattcttcggcgacgaaatcgaccgcatctccactctgcatccgctgaccggcgacgtgatcgcgcacgaatcgcaggtgcacatcttcccggcctcgcattacgttgccggagcggaacgtatggaacgggcgctcaaaaccatccaacaggaacttgacgagcgtaccgccgaattgcataagcaaggcaaggaacttgaagcgcagcgtctcaccatgcgcaccacatacgatctggaaatgctctcgcaggtcggcacatgctccggcgtggagaactattcgcggcatttcgacggacgcgcgccgggcacgcctccgcacacgctgcttgactttttccccgatgatttcctgctcgtcatcgacgaatcacatgtcaccgtgccgcagatcggtgccatgtacgaaggcgacgcgagccgcaaacgcacgctggtcgaacacggtttccgcctgccgtcggcaatggacaatcgaccgctcaaatggccggagttccaggaacgcgtcggtcagacggtgtacctgtcggcaacgcccggcgattacgaactcggtttgagcgacggcgtggtcgaacagatcatacgtccgaccggactagtcgatccgcagatcgacgtgcggccggtggaagggcagatcgatgacctgctcgccgaaatcaaagaccgcgtggcaaggaacgaacgtgcgctggtcaccacgctcactaagaaaatggccgaggatctgaccgactatctgctggaacgcggcatcaaagtcgaatatctgcattccgatgtggacaccttgcgtcgtgtcgaactgctgcgtgaactgcgtgaaggcaagatcgacgtcatcgtcggcatcaacctgctacgagagggcctcgatctgccggaagtgtcattggtcgcaatcctcgacgcggataaggaaggcttcctgcgttcctaccgttcgctcatccagaccatcggccgtgcggcgcgaaacgtgtccggcaccgtcgtcatgtatgcggacgacatcaccgaagccatgcgcaaggccatcgacgagaccaaccgccgccgtgacatccagatcgcctacaataaggaacatggcatcgatccgaagccgctcatcaagaagatctccgatgtcaacgacatgctcgccaaggaggacgtcgacacccagacattgctcggtaccggataccgaaacgcggacaaagccggcaattcgcatctcggcgtgccacataccagcaaggaggaatccggcaggcggcacgaggagattctcaaggccggattgcccgcgcaggatctagctgatcttattcgacaactgtccgagcagatgcataccgccgcagaacaactgcaattcgagcttgcggctcgtctgcgtgacgagatccgtgacctgaaaaaggaacttcggcagatgacggaggcgagcaaatagttctcgaccggtcatacggcatccgtaccatagtggattatggctgaaacaccacttgtttttgaaatcgccacgtttgcggtgcttgccgtcttcttcgtggtggacctgttcatcatcgggcgcaaaccgcatgtgccgtccaccaaggaatgcgtgcagcatatcgcgttcttcgtggtcatggcgttgatcttcggcggactcatgtggttcttcgccggctcgaagcctgccatcgagttctactcaggttggctgaccgaatattcgctgagcatagacaacctgttcgtgtttgtcattatcatgtcgaatttcgcggtgccgaaggaactacagaaattcgtgctgtcagtcggcatcaccgtcgcgctcgtactgcgaggcatgttcattttggtgggcgctgccatcatctcgcgcttcacttgggtgttcttcctattcggcgcgttcctcatcgtcacggccatcaaactcgtcaccgggggagacgaggacgaggaataccatgagaacgcgttgattcacgcgctgcgcaaggtcatcaagatcaccgatgaatacgacggcgaaaagctgcgtactatcaagaacggtgtgaagcattggaccccgatgctcatcgtgttcctgaccatcggcaccaccgacgtgatgttcgctttcgattcgatccccgccattttcggtctgaccaaagatccgttcatcgtgttcacgtccaacgtgttcgcattgctcggtctgcagcagctgtacttcctgctcggagagctgcttgacaagctcgtctatcttccgctgggcctgtccgtggtactgggcttcatcggcgtcaaactcatcatggaggccctgcatggcaattcgctgccgttcctcaatggcggccagccgatttcctgggttccggaagtgcccacatggctgtcgcttgtcgtgatcgttcttgcgattggtggtgcggctttggcaagtgttattaagatgcgcaccatgaaagcgaacgaaaagtgacagtccggcaaacgttgggagaatagagcttttctattctcctacgaaattgtgagcgctcacaacacacctagttctgaggtggaagtgggcgctttttgctagtaagctatgccattggaaacagggtcgtcagatccaaaatcaatatcaacaagaataggcaggcattcatgcgtaaagccaagatcgtagataccatcggtcccgctaccgagtccctggaaggcatcaccagccttgtcgaagcaggtatggacgtcgctcgtctgaaccgctcccacggcactccggaagaccacctcaaggtctacaacaacctccgtgccgccgccaaggccactggccgcaacgtcgcagccctggttgacctgcagggtccgaagatccgctgcggttggttcaagaagaacgccgacggcgaggataaggtccagctgaccgaaggccaggagttcgtcatcaccactgatgacatcgaaggcgacgagcacatcacctccaccaccttcaagggtctcccgggcgactgccatgcaggcgatccgatcctcatcgacgacggcaaggtccgcctcgaggtcaccaaggtcgaaggcaacaacgtgtacaccaaggttgtcgttgccggaccggtctccagccacaagggcatcaaccttccgggcgtcgccgtgtctctgccggctctgaccgagaaggacgaagaggatctgcgctgggccatccgcaccggcgccgacatcattgccatgtccttcgtgcgcttcgccaccgacatcgatcgcgcccatgagatcatggacgaggaaggccgccgtatcccggtcgtcgccaagatcgagaagccgcaggccctcgagaacctcgaggagatcgtcaaggcgttcgacggcatcatggtcgcacgtggcgatatggccgtcgagtgcccgctggaagaggtcccgctggccaccaagcgctgcatcgagctggctcgtcagtacgccaagccggtcatcgtggccaccgaagtcctcggctccatggtcagctccccggtcccgacccgtgcagaggcatccgactgcgccaacgccgtcctcgacggtgccgacgccaccatgacctccaacgagaccgccgtcggcaagtacccggcagtcaccgtgaacaccatgagccgcatctccaccttcgccaccgagcatggtttcgaccgcatcccggagctgaagaacctggatatgtcctccaccggtgccgtctcttccgccgccgtcgacctggccgacaagctcaacgccaaggccatcgtcgcctacacccagaccggttctaccgtgcaccgcgtgtcccgtgaacgtccggccaccccgatctacggcatcaccaacaatgagcacaccttccactggctggccctgtcttggggcaccgagtccttcctggtcgacgaggattaccatgacaagtcccgcaaggacctcatggttttcaccgacaaggtcctcaaggacgccggcaaggtctccgatggcgacaagatcgtcgtgctgagctccgcccagggcgaacaccagccgggtcgcaccgattccatctacgtccacaccgttggtgcctgcgactgagatttgaatcgtcgcgttaaacgctgattccataatcctcccattggttcccgatgggaggattattgtttttacgcgatgtctccgaatgatgacaacgccgagatttggcgcaaatcgcaatcatgtggtattcttccagagttgcgtgcaagccctcgtatcccaattggtagaggaagcagcctcaaaatctgcgcagtgtgggttcgagtcccaccgagggcacgtaagaaatcaatatcaatccaggcccgggttggggcatgttaggccggctttgggtgtgacagtggaaagagaccgacatggctgcagagaagaccacggaaccggacgaagtactcactgatgaggagctccaagctgctgcggctcccgagccggattctgccaataataacgaggcgcacaagcgcaccgtcgtcgttgccgaagacgaatccgtgaaccgcatggatttggtcgccatgcttgaggataacggctatgaggtcgtcggagaggccgccaacggtgaggaagccgttgaactgacccgtaagttccgcccgagcgtggtgtgcatggatgtcaagatgcctcgcatggatggcatcgaggccgctggcatcatctgtgatgagaacatcgctccggtcgtcatgctgacggcattctcccagtctgatttggtcaaaaaggccacgggcgctggcgccatggcgtatgtcaccaagccgtatgaggaatccaagctgttgccggctttggaagtcgccatgggccgtttcgccgaaatcaacgatttgcttgacaatgtcgaacgtagcgagtccaaactgcaggaaaccgaggaacagctgaagaaggccgaagagcagctgaagaaggccgaagaaacgctggaggagcgcaagctcgtcgaccgcgccaagggcctgctgatggacaaggcggacttctccgaacagggcgctttccgttggattcagaagacctccatggaccagcgcattccgaagaagcgtctggccatggccatcatcgccaagtatggcgaacagaagtcggaagcagaggatgcgcgctaacacaccaactgtggaaggcacttcacgcggaacgctattggtcgttgacggccattctttggcgttccgcgctttttttgccttacccgtagagaatttcagtacatcatcaggtcaggccaccaacgcggtctggggattcgccaccatgctttcgcaggtgatcgatgccgaacatccagaccatcttgccgtcgcattcgatgtgaagggcggcacgttccgcaaccagatgctgccgcagtacaaaggaactcgcgacgcggcccccgaggaactgctcagccagctgccattaatccagcagatgctgacggccttgggcgtcacatacatcgaaaaacccggttacgaaggtgacgatgtgatcggcacgctcgccagcatgggcgaccaggcaggctaccgcacattggtgctgtccggcgaccgtgatgctttccagctgatcaacgacgacatcaccgtgctgtatcccggccaccatttcaaagacctcaaacatatgaccccggatgccgtgcaggagaaatatcatgtctctcccgcgcaatacccagatctggccgccttgcgcggagaaaccgctgacaacatccccggcgttcccggagtcggcgacggattcgcggccaaatggatcaaccagtacggcggacttgagcagatcatcgaacacgccgacgagatcagcggcaaaaaaggcgaagccctgcgcgaaaacatcgaacaggtcaaactgaaccgttccgtgaacgctttggttcgtgaccttgatcttggcgtgtcggtatccgacctgacatttggacaagtcgacgctggtcaactcgacgatctattcaccaagctcgaattcggtgttcggaccaagaatcgcgtgctcaaaacgttcaatgcggacaaaccatccggggacgtgcacgaatccagcaagctcgagctgccacatgtcgaagacgtcaacgatccgcatgtggtggagacatgggtccaaaaccatttccccgtggtgcaggaacatctgcacgaacgccatgaacgctcctccaacgacattccggaattcggcttcgaaatcgattcttcgacccgttgcacggacaaggtgaaacagtcctggacgctttacgccgaaggtacgagcaaacccggagaagcctctctttcggcattgatgatcgccgtgcacggcgaagccattcgcatcgacgtattcagtccggatatggtgcaatgcctgcaaaggctgttcgaccgctatcaccattccatggtcgtgcacggttacaaagaacatgcgcatctgctgggcagcatcggcgtggaacttccggaaccattgtttgacaccaagctcgccggatatcttgcccacccggatttccacgcggacacgctggaacaggttgcggcccatttcctggatctgcacatcgaagcacaagccgaagccgcgacacaggggaccttggacttcgacgagcctgaggaaaacgattccaagaacgacgagctgatactcacccgcaccgcaatcgtggggcttttggccgaatatttggccggtgtgctggataagcgcgaacaattcggtctcctcaaatccattgagcttccggtctctcaggtcctgcatggcatggaacaggtcggcgcccaagtggatatggcacgtctggtgcagatgcgcgaccaacttgccgccgacgctgcccaggcacaggaaacggcgtggcagttcgcgggggagcaggtgaacctgcaaagccccaaacagctgcagaagatcctgttcgaagacatgggattgaaaccgacgaaaaaaaccaagtccggttcatacaccaccaatgccgcggcattgcagaccttgcgtgaccgctcgtacgataacgaccgcgcatgccagttccttgacgcgttgctgatgcatcgtgaaaagaacaagctcaagcagatcgtgcagacgttgatcgacgccacaaaccgtcatgacggtcgcatccacaccactttcgaacagacggtggcagccaccggacgattgagctccgtcgatccaaacctgcagaacattccgaaccgggatcccgcaggtcgtgagattcgatccgcgttcgtgccgggagagggcttcgaatcgttgctgagctccgactactcgcaggtcgaactgcgcatcatggccgacctttccggtgatgaggcgttgatagaggccttccgctccggcaaggacttccataagtatgtggccagcttggtctacggcattcccgttgacgacatcacgtccgatcagcgtagccacgtcaaggcgatgagctatggacttgcctacggtctgagcacgtatggacttgcccagcagctcaagatcaagcccaaagaagccgaatcgctgaaaaaccagtatttcgccacttttggcaaagtccatgaataccttgaatcgcttgtctcgtccgcacgcgaaaaaggatataccgaaaccattttcggaaggcgcaggtatttccccggtctcaaatcgccgaaccgtgccgtgagggacgcggccgaacgcgccgcgttgaacgcgcctatccaaggctcggcggcggacatcatgaaaatcgccatgattcgtgcgtatgacgcactgcaggaagcgaaccttggaagtcgcctcatactgcagattcatgatgaacttgtagtggagatcgcgcccggtgaggagaagcaggccaccgcgctggtgaaggatgccatggagcatgccgttaccatggccgttccgttggacgtatcgacgggcatcggttccgattggcaattggcggcccactgatccgttcccgtcggataatcgaaggctgattaaaaaagaaagaaggaagattgtggcaacgctgaagcaggtcgtggatgtgcttgaaacgctgtatccgctgcgttacgcggaacaatgggatgagccgggactcatcgtgggagaccttcgccacgacgtgcgcaacatcgcgttcgcggcggacccatccatggcggtgatcgaccaggctatcgccggaggcatcgacctgctgatctgccaccatccgctgttcttccgttccgtgcatgcggtctccggactaggattccgtggtgagatcgtccggaagctcaacctcgccggttgcgcgctgtgggttgggcacaccaatgccgatgcctcctaccgaggagtcggcatggccgccgccgacgcgttcggcctaatcgaacagcgtccgctggtacccatcgaagatccgaaagccgaacatccggtcggattgggccgtgtcggccggttgcaggagccgatcgcattgcgtgatttcgcccgtcgtgtggccgacgcgctgccatacaccgaacttggcgtgcaggtgtgcggcgaccttgacgcgacgatcggcacggtggcgatattgccgggctcgggcgattccctgttcgatgaagtgcgtgccgcaggcgtcgatgtgtatgtgaccagcgatctgcgccatcatccggtgaccgatgccatcgagcaggcgcgctatgaggcgtccatgcgtgccgcggacatcgaactcggccgaggcgacgccactgttcgtccgatgttcatcaacacgccacacagcgccatcgaatccatatggttccaatacgccatgggcgatgtgcctcgtgccgtatctgaggcgaccggagacatccccaccgtccgctggatttccatgaacaccgatccctggaatctggtactgccgtcctgcgggcaggaacgctgaacgacgatgtccgatacgaccagcatggatatgtcgctgaacgaatccagcgatggcgtggacatgaccagaccggccacagtactcagcagagagcacgtgtatcaaggcgcgattttcggcgtggaggacatgcgtatcgcgttgcagacacgagacggcggacaaaccgtgatccgcagacaggtgatgcggcacgcgccctgtgtggtcatgctggtgcatgactgcgcgcaggatttgtacttggtcgaacgagaataccgtgtcggctgcgacgccttcgcctacggtctgccggcaggactcatcgatgacggggaagacgtcgatgcggccgcattgcgtgagctgcgcgaagagaccggcgtcgagccaatcgacgaaaacagttgcgatatcgaccatgtcgggcaattctattcatccgagggcatgaccgacgaactggccaacatcatggtgatgcacctgcgccactggcaggccgtcgaacggcatttcgacgccgacgagcatgtcgaatctgcttggatcccgtggaagcagctacgagacacgcacatcacggcctccaattcggagatcgccattttgcatgagcaaattcgcagaatgcggcaacaatagcggcctgcaggtttcgaattgtaaaaacaatcgccggaataaacgaaataacgaattcaactcgcaaaacgtgcgatacttgaattatgcaaatcagacctggatcgatgtatccactcggtgcgagctacgacggcgccggcgtgaatttcgccctcttctctcaagtggcccagaaagtcgagctttgtcttttcgatgaggaagatcgtgagacccgagtggaaatgacggagcagaactcctacgtatggcataactatctgccgggaatacaacccgggcaacggtacggctatcgtgtgtacggtccgtatgatccagcaaagggcctgcggtgcaacccgaacaagttgctgctcgacccgtacgccaaagccatcgagggaaacatcgacggtgacgaaagcctctattcgtattggttcaaaagccctgaggacgtcaccagcatgaatacgctggattccgcgccgcataccatgaaatcggccgtggtcaatccgtatttcgactggggcaacgaccaacatccgaacatctcctaccatgattcggtaatctacgaagcccatgtgcgtggcatgaccaatctcaacctggacgtgccgccggacatccgtggaacctacgcgggcctcgcatatccatcggtcatcgaatatctgaggaagctcggcgtcaccgccatcgaacttatgccgatccaccagttcgtcaacgacagcttcctgcaggaaaaaggcctgagcaactactggggctacaacaccatcggcttcttcgcgcctcataacgcgtactcaagctccggacaacgcggcgagcaggtcaacgaattcaaatccatggtcaaggcctaccatcgcgccggcatggaagtgatcctcgacgtggtgtacaaccacaccgccgaaggcaacaacctcggcccgaccctaagcttcaaaggcatcgacaacggtgcctactaccgtctggtcgacaacgaccgacgccactacttcgacacgaccggcaccggcaactccctgctgatgcgctcgccgcacgcgctgcagctcatcacggacagcctgcgctactgggtcaccgaaatgcatgtcgatggtttccgattcgatcttgcggccacgctggcccgccaattccaggaagtcgacaagctgtccgccttcttcgacatcgtcgaacaggatccggtcatctcccgtgtcaagctcatcgccgaaccttgggatttgggttccggcggctatcaggtgggcggcttcccgtccagctggtccgaatggaacggccgctaccgtgattgcgtgcgtgacttctggcgttcgcaaccatcgacgctaccggaattcgccagccgtctgatgggcagctccgacctgtatcagatgaacggccgccgtccggtggcttccgtgaacttcatcaccgcacatgatggcttcaccatgaacgatttggtgagctacaacgagaagcataacgacgccaacggcgaaggcaatagggatggcgaaagcaacaaccgttcctggaactgcggtgtcgaaggcccgaccaccatcaaggacgtcaacgacctgcggcaacagcagatgcgcaacatgttcgcgacgttgctgtgcagtcagggcattccgatgatctgcggcggcgatgaggtggcacgcacgcaacagggcaacaacaatgcctattgccaggacaacgccatttcatggaccaattgggatcttgacgatagtcagaaggatttgcttgagttcgtttcgaagctgattcatctgcgactcgagcacccggtgctccaccgtcgtcgtttcttcaccggccgcgagccaggagacccggacgataagattccgcaggtcgaatggatggaccacaccggttccatcatggacatggaagattggtccaatacccacgcgttctcggtgatgatctatctgaacggttccgatattccggaagccgactggtatggcaaccagatggtggacaataacttcatcctgattttcaacgcgcattacgagccgattatgttcaccttgccggacgagcggtatggcaagaaatggcgtctggtcgttgacacgcataatccgaagggtccggaactcaactatgaggccggcttcgcgatcacggcgcagtcgagaagcttcctgttgctgatgagcgatagaaagcccaccacaaagaactacgatttctgatagccatgagaacaggcgaggtaccatccgtacgggtgacacacctcgccgtattgtttgtggactgtgctcgtgaaccgttacgagaattagacttccgacgagagtcgggaaacggttccagaaacggtttcgctgacctccgcaagatcctcgacggattctggccgcttggtttgcgccagaataagctgcgtctgcacacgatcggattcgatggccgcaatctgccgtgaaaagatgatgaaccagcccagaaacatcatgccggcaagagcctcgacgttcgtcaacgtgttacgccccgccagccactggaacccggcaagagccccgatcacgatagctaggtctgaaatcacatatactacttttgaaagctgcggggccagccaaggcagcgcgatcatcagcacgctcatcaggcagggaagaccgcgggcgaatacgttgtgcagaatcggatgcggcgtgtaacggaacatgccgatgccgatgaaggcgatgcctgcgagcgtcagcatggtcgatagcagaagaatccgcgccttgaagtgtttgggagcttctttttcatcgcttgcagacagatactgcatctgcagacggtgcgtggtgatgagctccgaaatcgcgaaatagctgatgatgacgatgcagacgccggccaacatcaatgtcgaattgaacatacgagcagcaaaagtggttcgatcgcccaattgggagaaattgttgttgtaccagtatggatcatcggacgtcaatcctgcgatgctgacaccggaaaccacgaagaacggcaacaaggatgcgatggtcttggcattcatgagttccgcctgtacgaacgtgacatagcctacgacccccgagatcgcggcgcagagtgcagtcagatagccttttaacgtgcgcaaccccatcatgttgctggcaatggaaagcagcatgaacgccgtgacgaaaatggtcgacgcgtagaccacggacaaagcgagtatctcgaagatacggcgaataggaatggtccagccatgtttcaacgtcatcgacctggagttgcgcgcataccccaaggtgaacgagatgactccacatcccgcggtgattccggcacacacggtgaacaggcgttgggtgacacgccagatggcgggagcgaattgcagatataggtccatggcgatccatgcaagagtggcgcatgccatgaaggaaatgatgcctgaagcctcggcttgctgatgacgtcccatgcgcgttccctccagtatttgccattctagcctgtcgttgtcctaccatacgctacaatagaaactcgtgttcacctgccacgtgcgggagtgcatgaacgggctgtagcgcagtttggtagcgcgtctgctttgggagcagaatgtcgcaggttcaaatcctgtcagcccgacaaaaagcccggagttccaatggttttgccacttggaattccgggcttcaatgattgtgcgcacaaaagaaactcagatgccacacatgttgtagtcggcgctcagatcattcatggcatgcaggatcttgtatgtgtagaccaacggcccgacgatgatcaacgtgccgagaacgctccatagccagtatgtcgcggccgtcacggtcaccggcaaatgccgggcggcctgttcggtgccgattcgagcgctgagacgatggttccagacaagccagccgatgccgaaagtcagccagccgacaatgaagaacatgaggcaatagtgcatggtgcgcttgccgtcgcgacgcgtggcgatcaggttcaaggtttccccaacctcactcatctgccaaatgtcgtagatgccgaaagtgatgagaccaagcagcacgaatttgagcaggccgcgtttggtacgcaacgccgttcccgccggaacgggaaccggagccattggctgaggctgttgagcggcaggcggataatattgctgtgatgcggacgcgtagagctgcggctgcggcacggccgcattcggttgttggggttgcggcacaggcacatatggctgtggttgctgtggcgatgtcatattctcttctttcttctatgcgctcgtttcttctatgcgctcgctcttctccacattgaggtgaaaaagaacggacgtcgtcaaaggacgcctacacgcaatgatgggcagatggggaaggagttgtatagtttgcatcccatatggataccagcatgtcgctgacgagatggacacgtctttttccgcaggttttggttaccatgggtcgcatggaagcacttcaagagaacctatggccggcaccgtatgccggcaaaccgctcaacgccactgtggtggtgccgggtagcaaatccctgtcgaaccggtatctcattctcgcggctctcggatcggagccggtgcgtttggtagggctgctgcgctcgcgtgacaccgagctgatgatggaggcgttacgtgcgcttggcgtccgctgtgaggttgatgtcgaaactgatacgacggtaacggtgacgccgccagcggatggccacttccatggcaatgcgaaaatttactgcggacttgccggcacggtgatgcgtttcgtgccgggacttgcgatgttcgccgatggtcccgtcgatttcgatggcgatgagcaggcatatgcccgcccgatgaaaccggtgttggatggcttgcggcagttgggtgcgaccattgaataccacggtgaagaaggccgtctgccgttcacaatcactccgcccgcatttgattcggccgtgcgcgaaacgccgaatgtggtctccatcgattcgtccggctcttcgcagttcatttccggcctgttgctgatcggctcgcgtgtgccaggcggccttgagctgcaccatacggggaaaaagactccaagcctgccgcatatccgaatgacggtggccgatcttaaaagtgctggtgtggatgcgattgcagatgaagacgttcatgtctggggagtcgctccgggaacggttcaactacccggacaggtgacggtcgaaccggatttgtcgaatgccgctccgttcctgggcgccgcgttgatcgccggcggaaccgtgcgtgtgccgcattggccggaaaccaccacgcaacctggtggtttgctgccggggtatcttgaacgcatgggagcgcaagtgtctttcccggaaaagaacggcatccgttattgcgaagtcacaggtggacatgccatcaacggtttgggtgatttcgatctgaccgctgccggtgaaatcgcgccatcgcttgctgcgattctggctttcgccgacaaaccgaccaatatgatcggcatcggccatttacgcggacacgagacgaaccgtcttgaggcgttggtcaatgaaatcacgcgtattgggggagaagctcgtgaattgccggatggattgaagataacgcccgtatccgcgggctgccttcgaccggccgtgatggagacttatgccgatcatcgcatggccacgttcgctgcgatgcttggtttgcgcatcaaaggcatccaagtggagaacatcgccgccacggcaaaaaccttgccgaatttcgtgaatatgtggaacgacatgctttcctgacggatgtatgaaagagatgttgtgaaggagattgttcgattctaacgagagtggactcttttcgccgcataatgggaggggctttccgcgagtagttccgcgggaagcccctcccattacgtgtctaagcctgcgggctcactcccattcgatggttgccggcggcttggaagtgcagtcaagcaccacgcggttgatctgacggcattcgttggtaatacgcgtcgagatggtggcgagcacgtcgtacgggatacgcgaccagtcggcggtcatggcgtcttcggacgacaccggacgcaacacgattggcgagccgtaggtgcgttcgtcaccctgcacgcccacggaatgcacgtcggcaagcagcacgaccgggcactgccagatgtcgcggtcgaggccggccttggaaagctcctcacgtgcgatggcatcagcttcgcgcagcaagtcaagacgttccttggtgatttcgccgatgatgcggatgccgagacccggacccgggaatggctgacgccagacaatctcatccggcagaccgagttcggtgccaatggcgcgcacctcatccttgaacagggtgcgcagtggctcgatgagctggaatttgatgtccttcggcaggccgcccacattgtggtgcgatttgatgttggccgcgccatcgccgccgccggactctacgacgtccggatacagcgtgccctgcacgaggaatttgacttccttgccggaggcaccggcctcttcgatgacctgacgctgggccttctcgaacgtgcggatgaacttctctccgatgatcttgcgcttcttctccggctcgctcacacccttcagggcggtgaggaagtcttcggaggcgtccacggcgatgagcttgatgccggtggcctcgacgaaatcatgtttgacctgctcggcctcgcccttgcgcagcagaccgtggtccacgaacacgcaggtgagctgctcgccgatggccttatgcaccagagccgccgcgacggcggagtcgacgccgccggacaggccgcaaatcacctgggcgtcgccgaccttctcgcggattttcttgacctggtcctcgatgatgttggacgcgttccagttatcgccgaggccggcgcacttgtgcaggaagttctcgatgagcttctggcccatcggagtgtgcttgacttccggatgccactgcacgccgtacagtttgcgggactcgtcctgcatggcggcgaccggtgcgccttcggtgtgggcgagcacttcgaagccttccggcgcggtcttgacggccacgccatggctcatccacgtgctttgctctgcgggagagccgtcgagcagaccctccgccttgtcgatggtggtttccgttttgccgtattcgcccagggcggccttgtcgacatccgcgcccaacgcgtatgccatggcttggaagccgtagcagatgccgagcaccggaacgcccgcgtcgaacagcttcttgtcgacgcgcggagcgcccggttcgaacacggaagcggggccaccggacaggatgatggcctgcggatccttggccagcatctcatcgaccggcatggaatgcggcacgagctccgaataaacattggcctcacgcacgcgacgtgcgatcagctgggcgtactgggctccgaaatcgacaacgagcacaggacctgcagccataacactctccctttaatatgaggtatcaagaaacgaacaatactaactgctctattgtgacgttgcaaggagacattggaaacacgtgaacggagaatgaacgaatctcacaattgcttactcccacctactcaacacgccgcgtgtgtatctagggaaacgaacgtgggaaacatgtgttaaccgactaaaaacgttgattttgagccgtttttcaatctttttgatagagtgtgaagtacgcacaaaaatctcgataaaagcacacatttgcgtacagaaaaataacaattgaacacacagtcgcaaaaaaacagcaaaaagtcgaaccgcgctcgtaatatgtgcaagtgactggaaatgaggcataccgcgtaaccgcaaggttttaggcatggctcatgacctaaggaaataaacaatcgcacatcacagtgcaggagtacaggagtacacatgacgagtcctgttattggcaccccttggaagaagctgaacgctccggtttccgaggaagctatcgaaggcgtggataagtactggcgcgcagccaactacctctccatcggccagatctatctgcgtagcaacccgctgatgaaggagcctttcacccgcgaagacgtcaagcaccgtctggtcggtcactggggcaccaccccgggcctgaacttcctcatcggccacatcaaccgtctcattgctgatcaccagcagaacactgtgatcatcatgggcccgggccacggcggcccggctggtaccgctcagtcctacctggacggcacctacaccgagtacttcccgaacatcaccaaggatgaggctggcctgcagaagttcttccgccagttctcctacccgggtggcatcccgtcccactacgctccggagaccccgggctccatccacgaaggcggcgagctgggttacgccctgtcccacgcctacggcgctgtgatgaacaacccgagcctgttcgtcccggccatcgtcggcgacggtgaagctgagaccggcccgctggccaccggctggcagtccaacaagctcatcaacccgcgcaccgacggtatcgtgctgccgatcctgcacctcaacggctacaagatcgccaacccgaccatcctgtcccgcatctccgacgaagagctccacgagttcttccacggcatgggctatgagccgtacgagttcgtcgctggcttcgacaacgaggatcacctgtcgatccaccgtcgtttcgccgagctgttcgagaccgtcttcgacgagatctgcgacatcaaggccgccgctcagaccgacgacatgactcgtccgttctacccgatgatcatcttccgtaccccgaagggctggacctgcccgaagttcatcgacggcaagaagaccgagggctcctggcgttcccaccaggtgccgctggcttccgcccgcgataccgaggcccacttcgaggtcctcaagaactggctcgagtcctacaagccggaagagctgttcgacgagaacggcgccgtgaagccggaagtcaccgccttcatgccgaccggcgaactgcgcatcggtgagaacccgaacgccaacggtggccgcatccgcgaagagctgaagctgccgaagctggaagactacgaggtcaaggaagtcgccgagtacggccacggctggggccagctcgaggccacccgtcgtctgggcgtctacacccgcgacatcatcaagaacaacccggactccttccgtatcttcggaccggatgagaccgcttccaaccgtctgcaggccgcttacgacgtcaccaacaagcagtgggacgccggctacctgtccgctcaggtcgacgagcacatggctgtcaccggccaggtcaccgagcagctttccgagcaccagatggaaggcttcctcgagggctacctgctgaccggccgtcacggcatctggagctcctatgagtccttcgtgcacgtgatcgactccatgctgaaccagcacgccaagtggctcgaggctaccgtccgcgagattccgtggcgcaagccgatctcctccatgaacctgctcgtctcctcccacgtgtggcgtcaggatcacaacggcttctcccaccaggatccgggtgtcacctccgtcctgctgaacaagtgcttcaacaacgatcacgtgatcggcatctacttcccggtggattccaacatgctgctcgctgtggctgagaagtgctacaagtccaccaacaagatcaacgccatcatcgccggcaagcagccggccgccacctggctgaccctggacgaagctcgcgccgagctcgagaagggtgctgccgagtggaagtgggcttccaacgtgaagtccaacgatgaggctcagatcgtgctcgccgccaccggtgatgttccgactcaggaaatcatggccgctgccgacaagctggacgccatgggcatcaagttcaaggtcgtcaacgtggttgacctggtcaagctgcagtccgccaaggagaacaacgaggccctctccgatgaggagttcgctgagctgttcaccgaggacaagccggtcctgttcgcttaccactcctatgcccgcgatgtgcgtggtctgatctacgatcgcccgaaccacgacaacttcaacgttcacggctacgaggagcagggctccaccaccaccccgtacgacatggttcgcgtgaacaacatcgatcgctacgagctccaggctgaagctctgcgcatgattgacgctgacaagtacgccgacaagatcaacgagctcgaggccttccgtcaggaagccttccagttcgctgtcgacaacggctacgatcacccggattacaccgactgggtctactccggtgtcaacaccaacaagcagggtgctatctccgctaccgccgcaaccgctggcgataacgagtgagcctaggctatttggcctgattgcttgataaaagccccaagggattgttcccttggggctttttcgtattacggtgcgatatgcttggcttaaaacagcaaaaccgctagcgcgtgtcagttaccgtttgcacattacaattgctcattgtgcgaacgatgcggtatcgcacccgaataatgcgaagtacataggagacaccgtgagttttaccagcgtcaccatcatcagtcccgaagcggctaacggccgtaatgttgtcgcccttggagtcaccaagacacttgccgcagccggcaagaccggagtgttccgtccggcggtctgcagaaaagacaccttcacggacgtgctgatcgaagcttccaatgccggtttgagccgggaacagtccgtcggcgtgtgccccaagcgcgctcgtaacgataaggaaggttcgcgggcggatatcgttgcggcctacacccaagccgtagaaacagcccgaccggatgccatggtgattgtcggcaccgacaggtcagcagtcaatgatcccgcgatgttctctttcaacgctgacgtcgcggcagacctccaatcgccggtcctgctggccgtatgcactatcgaacgcacaccggaacaagtcaaaagcacggttgaggcatccaccaaggtcatcgaagacgccgggagcaaagtcgtcggcgtgttcattactgggtgtgacgacacgcagccgaatccactcaaagcatgcttcgtcgactacccggtgccggtgtggacgctacctgccgtcgatttcaacgacgatgacgccatcagcaaggcagacgaagcgttcgcgacgaacgtcgacgccgtggaactgaccgtggcactcgaatcgccattcgacgccccgaccacaccctatgctttccaatacggtctgctgggcaaggcgaaggcggacaagaagaccatcgtgctgccggagggcaacgaggatcgcatcatcaaagccgccgattatctgctggagcgcgacatcgtcgatctgatcatcgtcggagacgaaaacgccattctcgcccgcggccaggaattgggattgaaatcgcttggcaaggcgaaattccaagccaaggatgatgaaacggtgctggaacccatggtggcgaagctgtgcgagctgcgcgccaagaaaggcatgaccgaagagcaggcgcgcaaacagctggccgatgacagctatttcggcaccatgcttgtggtgatgggcatggcggacggtctcgtgtccggttccgtcaactccacggccaataccgtgcgtccggccctgcaggtcatcaagaccaagccaggaacgtcgctggtctccggagcgttcctgatgtgtttcaaggaccatgccgccgtgttcgccgactgtgccatcaaccttaaccccaatgccgagcagctcgccgaaatagcaatccaatccgccgaaacggccaaggcgttcggccttgaaccgaaggtgggcatgctgtcctattccacgctgggctccggaaaaggacccgacgtcgacctcgtcgaggaagccaccaccatcgtcaaagacaaggctcccgaccttgcggtggtcggatcgatccagttcgacgcggcatggtctccgaccgtggccgcgaccaaagccaagggcgatccggtggcgggccatgtcaatgtgttcgtattcccggatctgtgcgcgggcaacatcgcatacaaggcggtacagcgttcctcgggagcggccgccgtcgggccggtgctgcagggtctcaaccgcccggtgaacgatctgagccgtggcgccacggtccaggacatcatcaacaccatcgccctgaccgccatcgaggcccagtaatcgggcattttgtagcaagcaacgagtaatctaaggttttggaaagtcgcgtaagcggcacatcgattaacacatggaggatgcccacaatggcgaaaaccgtccttgtcatcaattccggttccagctctatcaagtatcagctggttgatcttgaaaccggcgaaggtatcgcttccggtctggtcgagaagatcggcgagccggttgacggtcattacaagcacgagtacaacggcgagaagcatgagctcgaagagccgattcacgaccatgagcagggtctgaagcgcgtgctcggcttcttcgacgagttcggcccgaagctcgccgacgcaggcatcgtggccgtcggccatcgcgtggtgcagggtggttccatcttcccgaagccggctctggtcaacgacaagaccatcggccaggtcaaggacctcgccgtgctcgccccgctgcacaacggtccggaggccaagggcgctgaggtcatgcgctccctgctgccggatgttccgcagatcttcgtgttcgattcctccttcttcttccagctgccgaaggcttccagcacctacgcgctgaacaaggaagtcgcccagcagtaccatatccgccgttacggcgcccatggcacctcccacgagttcatctcctccgtcgtgccgtccgtcatcggcaagccggccgaaggcctcaagcagatcgtgctgcacatcggcaacggtgcttccgcctccgccgaaatctccggcaagccggttgagacctccatgggtctgaccccgctggaaggcctcgtgatgggtggccgtaccggcgacatcgatccggccgtcgtcttccacctgattcgcaacgcccacatgagcgtggacgaactggacaccctgttcaacaagcgttccggcatgatgggtctgaccggcttcggcgacctgcgtgaagtgcatcgtctggtcgaagagggcaacgaggacgccaagctggctctcgacatctacgtgcaccgcatcgtcggctacatcggcaactacaccgctcagatgggtggcgtcgacgtgatcaccttcaccgcaggcgttggcgagaacgatgacgtcgtgcgcaagatggtctgcgacaagctcgctccgttcggcgtcaagttggatgaggagaagaacgcgacccgttccaaggaaccgcgcatcatctccaccccggattccgcagtcaccatctgcgtcatcccgaccaacgaggagctggccatcgcccgcaagtccgccgccatcgcagaagaaggcaaggactcctacggcaacgtcttctccaagtgagtgacgtgtcacgtttcggctggtagaggaacgtgacggcaaacggtatgaatctgcgccgccgtgcctgataatcgatatcatcggtcaatcaggcacggcggcgcagtgcgttgggccccctttccgcgattcgcaagggattgcttggtagtacgatacgacaggttgcactgtaccgtgcaatgatgtaagagagaacggttggttattcgtggctgctaaacgacgtttcgtcggtttggacgggcttaaaggcatagcccttattgcgattgtgctgtatcactgcgatgagctttcgcttcaaggcgggtttttcggtgtggatgtgttcttcaccatctccggtttcctgattttctcatcgctgctcaatcgtatcgattcaggtaaaggcttggaactgggggagtacttcctcaaacggttccgccggatttatcccgcgctgtttgctcttatcccgatttcggtgacgttggcatggctggtgaaccgcgacatgcttgtcggcatccggaaccagatcatgaccgtgcttctgggatgctacaactggtatgccatcagcagcggagccagctatttctcccagatgaaccctgacatattccgtcacctatggttcatgtcgttgctcatgcagttttatctgatcgctccattcgtggttttgctgctgcgaaaaatcatcatcagatgggctccggtatgcatactgacagcccttgccggagcaagcgcggtatccatgggactgctataccactctggcgctgaccccacacgtgtgtatttcggcaccgacacgcacgccatgggcctatggctcggtgccgcgctggcttggatactgccgattctcagacatgagcatgggcgagccaatgaatcgcggataatggaacgattccataagatatggattcaattcggcccgatagttgcctttggctcattgctggcattgctgtggatgatgcggcatatcactcaaggcccagcggcgttccatggcggtatcttcgtcgcctccgtgcttgctgtggtgctgatcgcaggaaccataccattcggatcctggatgcaggatctgcttgtgttcaagccgcttgccgctttgggtcattattcgtatggcatttatctgtggcattggccattatggctgctgctgaggtccctgctgccccagtggggcgcatggcatgccgacaggctgctggccttcaccttcatcctcaccgtgctgttcgcgttcgcatcttggcggctgttcgagaagccagtcgctcgtgcgggattcatcgcgttgattcgtccgatcagtggagacgaagccgagcattgcggccgtctgatatccacggtcgtggtgctggcatgctcatggagcttctgcggatacgctgtggcgacggcaccggaacaaaccagtgtggcgcaatccttgggtatcagcgccaggctgttgcagcaacgcaatcatgccgctttggaacgacgcagaacaccgatgccaaggaagccacggcataagatgccggatggttcgcaaatggccgccatcggagattcggtgatgctggcgtccagcaaaggattgcgggacacgttccccaacatcattgtggatgccgaagtctcacggtcgatggcgaagggacagggtcttgtcgatcaattgaaagcgcaagggaatctgcgcccctgggtcttggtgggacttgccaccaactccgtggtgaccaatgatcagcttgacgatctgctgaatgatgtcggccccgatcatgtgctggtgctcattaacgcgcacgctcccgtttcatgggttcctggcaccaatgccgtgttgaagcaattcgccgcggcgcattccaacaacgtcgtactggtcgattgggacgggaccatttcccagcatgctgacgaacttgccggagatggcatccatccgggaatgtccaatacgatctacgcgcaggcggtcaaggattcaattgccgcttggatcaagcaagggcactgattgatgcgttgacgacttccatacgaggtccgccacatgccgtcgcatatgaatgatccccattccgtggaaatcggaatggggatcattcatatgcggacgatgccgatattagggaaatcaggcctcctgatgctgaggagcggacaggaagtgctcctcgctaggcagaacggcgttgagaatcacagccaccacgaacgacaccgcgatgcagttggaagcgaagatggactggaacagcgccgggaagttggcgaaaatgtcgccgacctgggtgaaaccgatgccaatggtcaggctcaacgcggcgatggtgatgttgcgctgcgtgtaaccggcctcggaaatcatctggaatccggacaggatgatattgccgaacatcatgatggtgcagccgccaagcacagcctgcggcagggagttgaagacctctgcaacggccggaacgaagctggcgagcaccaaaatcagaccgccggaaagaatcaccttgcggttgaccaccttggtcatcgccaccagaccgatgttctgcgcgaacgaagtcaatggcaggcagccgaacaaaccggacacggaggagattaagccgtcgccggcaatagctccggcggtttccttgtcggtgggttgacggtcgagaccgaccttggtaagcgccgctgtgtcgcccaacacctcaaccgaggaaacgacatacagcagagcgaaggagataatcgcacccggatcaaactcaagcttgaacggcatgaaatgcggcaccgacacgacctgcagattggcgaaaccggagaaatcgacctttcccatgaaaatcgcgaccacatagcccacgacaaggccgaacagcacggaaagctgcttggcggtgcccttcatgagcagctggaacgcaaggcaagccaccagcgaaatcaggccaagcgtcagattctgccagctgccgaaatccttcgcgccggaaccgccgccgaagctcgtggcgccgacggacaggagcgaaaaaccaatcgaggtgacgacaatcgcggaaacgatcggcgggacgaaacgacgccaatacttggccgtcaaaccaagcacgacctccaacaggccgccaagcaccacggcgccggcgactgcgccataaccctgatgctgcgcgatcgacatggcggccgcgacgtaggtgaaggaaatgccggtgaccatcggcagacgggaaccaatcagccacacaccgtacagctgcaggcaggtgccgagacctgcgaccagcaggccggcctgaatgatggcggcggactgcgcggcatccatcttggcggccgtggccaccaggaagataggcgcgagattcgccacgaacatggccatgacgtgctgcaggccgaacggaatgcccttccagaacgacaccggtgcgtcaagactgctcaacgcctcaaaagacacgccttttttagtgtcttttgccttcgtctttttttcggttttctctgtgttcttctcttcgctcaactgttacatcctctcttataatcgtttgagcgtgctgaaaaaaatcaggagcggaattcgatggtgccgttttccggatccatcgattcgacgattgccagggaatcgacgtcgtacccttcctcacgcagctggtcgccaccgccttggaagcccttttccactgcgatgccgatgccttccacagtggctccggcctcatggcatagctcgatcaggccttttaacgccttgccgttggcaaggaaatcgtcgatcagcagcacgtggtcaccttcattgagatagcgcttggacacgatgacagggaactccttctgcttggtgaaggaatacacggtggtcgtgtactggtcgccgtcaagattgatggactgcgccttcttggcgaacaccaccgggacattgccgaaatgacgggccacgacacaggcgatgccaatgccggaagcctcaatggtcagaatcttatcgatggtcttgcccttgaaatgctcggcccaagcggcgcccatatggtcgaacagctcgacatcgcactgatggttgaggaacgcgtccactttcagcacattgccgggtttgacggtaccctgctgcacaatgcgctcttcaagctccttcatgaaaccccttaatcttgtcggccgcgaaagcggcatcagatgatggcatacggcgagccgtatataggagttcagcatacgcgccccaattgaccgtgcgagtcggacccctgacctgctcatgtgataaacatgaatgctgcgaacaaatgtttgaatatgagcgtgcgcgaagaaaagaggaatcggtggaacagagcatgggacctgtgatgtgcgatccgcggagcctgatagagggactcaacccccaacaggaagaagcggtgaaatactacggccaggcattgctcatcggcgccggcgcaggctcaggcaagacccgtgtgctgacacgtcgcatcgcatggctgctggcgcatggcttctgggcaagcagcatcctcgccatcaccttcaccaacaaggcggccgcggaaatgcgtgaacgtctcgtgactttggtcgggccggaagccgaacatatgtggatctccaccttccactccgcctgcgtacgcatcctacgccgcgacggcaaggaaatcggccttaaatcgggcttctcgatttacgacaccgcggacagcgagcgactggtcaaactgatcgcagccgacctgaacatcgatacgaagcggtatacgccacgcatgctgctgggcaagatatccgactgcaagaacgcgttggtttcctggaaagaccagctgaaaaaagcgaactgcgattacaccccgggacagcgtggataccaggtgagcgccggcgacgtcgacgaactggtcgccgtcgtctacgccgaataccagcatcgtctggcgctcgccaacgcagtcgacttcgacgatttgatcatgcgcaccgtggaattgctccaaacctgcccgcaggtgagcgaatactatcggcacaggttccgttacatcttcgtggacgagtatcaagacaccaaccatgcccaatatgtgctcgtacgtgaattgtccggcatcgattcggacgaacagcccgacccgcaggcgaggggagcgggccgtgtgggaccgagctggattaccgtggtgggtgattccgaccaatccatctacgcgttccgaggtgcggacatccgtaacatccaagatttcgaacaggatttcccgaacgccaaaaccatcatgctcgaacagaactaccgttcgacgcagaccatcctcgacgcggcgaacgcggtgatcgcgaaaaacgaaaaccgcaagccgaagaaactgtggacggcgcttggtcaaggcgacaaaatcgtcggctatgccgccgacaacgcacagcaggaagccggatggatagcgaacgaaatcgcacgaatccacaccgaggaagacgtcgcttaccgtgacatcgccatcatgtaccgagccaacgcgcagtcacgttcgctggaagaggccatgatcaacgccaatctgccgtatcagctggtcggcggcaccaaattctatgaacgtagggaagtcaaggacgccatcgcgtatttgcaggccatcgtgaatcccgcggataatgtgaacgtgcggcgtatcctcaatgtgcctaaacgaggactcggcgcacgcgcggagggattggtggccggctacgcggacgcgcatggcctcacgttcttcgaatccattgaacatatggaccagattgaaggcatgacaggccgtaccaccaaaccgttgggcgcattccgtgatctgatgcacgagctggccgatttcgccaaggaacatgattcgaaaccatccgaagtggtggccgaagtactggacaaaagcggtcttctggaggaattgcaacgttccgaggatccgcaggatgcttcgcgtgtggacaatctttcccagttgcagtccgtggccgccgaattcgagcagaacacgccggatgccacgttggccggtttcctggagactacggcattggtcgccgactcggatcagttgccgggagagggcgaggattccggcaaggtcacgatgatgaccttgcatacggcaaaaggtttggaatatccgtatgtgtttcttacgggtatggaacagggcacgttcccgcaccagcgtgccatggaggacaccagcgagctgtccgaggagcgtcgtctggcatacgtgggcatcacccgtgcgaagcgtcggctgtatgtgacccgtgcggcggtgcgtgcccaatgggggcaggccaatgacatgatgcccagccagttcctggatgagattccggatgaactcatcgattggaaacgtcgtgaggccggtgtggagcgcatgcgcgccagctggggagatgacgacgagttcggcgggtgggacgatgatgacgatttcggatccacttccttcggcggatcgatgtacggatcgtcgacatacggttcctcatcgtatggttctggttctcgcggatcgcatcccacttatgggtcgtctcatggatcgcacagctcgtatggttccggacggtcctcctacggctcgggaagccgccgtttctctggcggatcgcactctggctcgtcctcatacggttcgtatggctcatcccggtcgtcatacggctccggcaagccctccggcaaatccggtaaggtcaccacgcgccgcgccaagccaaaggatctgacgaaatcggctccggcaagttcgttggacggcaacaacggattgagcatttcggatttccagataggcgacagaatcacccatgaccattacggtttgggaaaggtcatcgaaacgcaggacaagggcgcgaattcggtgatcaccgtcgatttcggcacggatggcgtcaaacgattgctgcttcgtgtggcgcctattgaaaagctctgacgtctttttccaataggcgcccctcgtggcggcgccgttgtgggctcataacacggattgagtgaaaaaacaagtcttttctttcggagcatttgttgcgataatcggcgatgtttgcttttcgagaggaagaaccatgccaagaaaactgttcgccgcgatatcgcagattgttctgggcgcgctgattgccatcgccccacagaccttcgcgcatgtgtgtgccgtcaaagacatgcccatggcatgccactacaccgctcgggtcgctctgggactgggcgtcgtcatcgcattgctggcaataatcggatttttcgcgccaagccgggtcagggccggattggatatcgccaatgccgtgctgggcgtgcttgtcgttctggtgccgaccatgctggtaggcgtatgcagaggctccatgatgcattgccatatggtgacgatgccgacgcttatcgtattgggcgtgctgctggcggcgctcgcagcagtcgccgcatatctcgatctcaagccggcaaagcgtggctgacgtgccgcatatcacccttgcgaaactaccgctggccaatctgcgtcgcaagccattccgcacttcggcgcttgtcattgtggtcgtcatgctcactgtggcgttctatggaggcgcgctgctttccatgaacctgaacaacgggttgaacagcatgcgggaacgtatgggcgccgatctgatggtcacgccgcagaacacgaaaaaccaggctgaggcgttgctcacgggaaactcttcgagcacgttctacttcaccaatgacattggaggccaaatcgccaaagcggacggtgtgggcgaaagcacggtgcagacgtacatctcctcgcttgcggcagcctgctgcgacgaaaaggtgcagatcatcggcttcaaccccgacaccgacttcgtcatcactccttgggtggcttcgcaattcgacggcacactccgtcgcggccaaatcatagcaggcgccagcatcaacgtgtcggacaacaatacggtcaaactgtacggtcatgaattccccgtggccgcgcaactggccgataccggaacgtcactggacaattccgtattcgtgaacatggacacggtgccggatgtcgtttcctattccgcgcaggtcggacatgccgcgattcctgaagaatacgccggcaaagcggtatccgccgtgctcgtcaaagtcaaggacggatattccgcacaacaggtcgcctcgaatatcgcaaaagccacggggatcgaaagtttgggatatgtgtatccgggcggcatcacggctacgacgaaaacgaatctcaaggtgatcatccgctatgtggcggtgttcatcacggtgttctggactatgggattggtcgtgatgttggcggtgttttcgtcggctatgaacgaacgcaagcgtgaattcgccgcgtaccgtattctcggcgccgatcgtgcgaccctggtgggcattatcgtcaaggaatcggcaaccatcggagctattggaggtgtgatcggtgtgacctgtacctcgttggtcgtgtttccgttcagtggtctgatcgctaaggaacttcaattgccgtatctgcagattggcgtcggtaaagtggcggtactgatagtcgtcgctctcctgttcgccgtgcttacgggcctggtcgcatccctcgccacaacggtgcgtctttccgccccacaggcatacctgacgctgagggagggggagtgatgccggaacagtccatattggaggttcgtggccttacccgtgaattcgtacgccgaggcaaacctttccccgcggtggatgatgtgaatctcacgctcgatccaggcgaattcatggcgatcgtcggccgatccggaaacggcaaaagcactttgctcaatctcgtcacgggattgctgaaacctacatccggttcgattctgctggccggtaacgaggtgaccacgttaaacgacaaacagatgtcgattttgcgcaaccgcaccatcggcttcgtcacgcagatccagacactattgccgaacctcaccgcaatcgacaatgtggtccttcccgcagtgctgcatcgcaacccgtctcggtatgaaaccgaaatcgatgaacggacgaatgacgcacaatcacaggaacagacggcgtcttccgtcgtggtcgatggccttcccgacgtcatccaaccagcttcgacgcagatggcttcttcatctcagcccgaccatttgacgcaacgcgcgcaacatctgttggatcaactgcttgtaggcgagcttgcgacatgctatccgaaggagctctctggcggcgagatgcgccgcgtctccatcgcccgagcgttgatgaacaagccgaaactgctgatcgccgatgaaccgacaggagatctggatgccgaaagcgccgcaatcgtcatgcggctgctgcggcaagtagcggatgacggtacctcggtgcttatggttacccatgatccggacacgcttgcttatgtggaccatacctatcgtatggataggggagtgcttactcgggcctgacgtttttaagacatgccgatgtaggtgaatcggagcatctcgtccgtcccccatgtgtatgattagcgattggtgtgcgcccggaaggacgtatgccgtctggagtcttagcccatcagtgggtcggcggccatccgtggtgttctgcattgcgggtcaagccgttcgcgcattgcgcgaagaagcactggagaggctggctcagcgtatgccggacttcggcatacgttccgttcagacaacgacagaacaaacaaaggattaaaccaatgacgaacgttcagcgttcccgccgtcaggtgcgtctttcccgcgccctcggcatcgctctgacccctaaggctcagcgcatcttcgaaaagcgtccgtatgctcctggcgagcacggccgcacccgtcgccgcactgaatccgattacgcagtgcgtctgcgcgagaagcagcgtcttcgcgcccagtacggcatctccgagaagcagctccgcgccgcttacgagaagggcacccacaccgccggccagaccggcaacgccatgctgaccgatcttgagacccgtctcgacgctctggtcctgcgtgcaggcttcgcccgcaccaccgcccaggctcgccagttcgtggtccatcgccacatcctcgtcgatggcaacatcgtcgatcgtccgtcctaccgcgtcaagccgggccagaccatccaggtcaaggccaagagccagaccatggttccgttccaggccgctgccgaaggtgtgcaccgcgatgtgctgccggcggttccgggctacctggacgtcaacctgccttccctgaaggccaccctgacccgcaagcctgaagccgaggagatcccggtgcaggtcaacatccagtacgtggtcgaattctacgcccgctgatctggattaccatactgtaagaacatacagtttaaggacatacagcgaaagcctcgcagccgttacggttgcgaggcttctcgttttttatggcgtttccggcggcatgtcgtttggctgattccacaggtaccatggaaaccatgttgcttcatcttcatctggtccgtcacggacagacgtttttcaaccgatataacagactccagggatggtcgaattccccgttgaccgatgcgggacttgccgatgcggacaaggccgctgccaaactccgggacattgagttcgccgcggcatactgctccgacaccacacgcgcccaggtgacggcacaacggatcctcgatgcgaacgaagccgcaggacacgttcgtccgtcactggtcagcgacatgcatttccgtgagcagttctacggttatttcgagggacaggacatgtccgtcgcatggaccgctgccggtggtccccatggtgcgaagaactacaacgacatcgtccgcaaatacgggcttgccgccacccgcgactttctcaaagaagccgatccgttccatgacgccgaatccgataacgagtattggcatcgtgtggaggacggcttcgctttgattgcggacaaccctcggcttaagaacggcgaccacgtgctgcagatctcccacggcaatacattgttgagccttatgcaccgattcgccccggaaggatacgatttgagcgaacgtccggccaacggttcggtgacctgccttgattttgacacgaacgaacccatggaccgcgcggtgagtgtggtctcgtacaaccagtgaacgtatttgccacagtcgtggctttttactagtcttatgcgggtattgtgttcgcgggcaaccgtggagctgaaaagaggtacaagatgggtgttggagagatcgccggtctgattgcggcaattgcattcgcggtgcttgccggtttcatgatctacccgctgatccgtctcggcaaattgttcgaccagatcgcgcagaccgtcaaagacaccggagaccatgcgattccggcgcttgacgagggcgtgaccacggtgcagcaggtgaacaagtccctggaggatgtcaacaagatctccgccgcggcgtccaccacggccaataatgtcggcgcgctgactgatctatatggatcgttcttgggcaagcccgtcatcaaggttgcgtccgccacctatgcgttgaagtccactgtgcagtctttcttggctaagagagacgtcaatcacgcggcaggcaataagggggagtgatgttcaagcgtcttttctgggtctccatcggcgtgggcatcggtgtcgtcgctgtcacaaaagcgcaggcatacgttaaagccaacacaccggacaccgcccgccaattcctgcttggtcccgaccaggaccatgtgaccatgcgcacgcttgaaggtctggtcaatgagttcaatgccacgcgtcgagcccgcgaggctgaacttaacagcaaatatgcggcgcggaacgagtagtcgttttccgcccgacagatacgctcaagcaaccaatcacacgtttggaaggcatcaggcctccaacaacaaaggagctcaaatccacatgcgcacttctgaaatcgcgaagcgctttcttgactatttcgaacagcacgatcatcttgtcgttccttcggcatcgttgatttctccgaacccgaccactctgttcaccatcgctggcatggtcccgttcatcccgtacctcatgggtgagcagaccccgccgaagcaccgcatggcttccaaccagaagtgcgtgcgtactctggacatcgacgaggtcggcaagaccacccgtcacggcacgttcttccagatgcttggcaacttctccttcggtgattacttcaaggaggaggccatccactatgcgtatgagctgctgaccaccccgcaggacaagggcggctacggcttcgatccggagaaactgtggatgaccactttcaccgacgacgaggaagcccgctcgatgtggaagaacgaaggcgtcgatcctgaacatatccagatcatgggtatggaagataacttctggaccaccggtggccctggccctggcggtccgtgctccgaaatctatgtagaccgtggtccaaagtacggtgtcgaaggcggcccgatcgccgacgagaaccgttacattgagatttgggatctcgtgttcgaaaactacgaggtcgacaacgtcaagtccaagaccgacctgcatatcgtcggcgagcttgagaacaagaacatcgataccggcgccggtctggaacgtctcgcctatctgatgcaaggcaagcagaacatctatgagaccgacgaggtcttcccggtcatcgaagccgcgcagaagctttccggccgcacctacggcgatgacgaggccatggacgtgcgtttccgtatcgtggccgaccacgtgcgttccgcgctgatgatcatgtccgacggcgtccgtccgtccaacaacggccgtggctatgtgctgcgccgcctgctgcgtcgaaccgtcaaggccatgcgcgagctcggcgtgacagagccggtcatgccgaccttgctgccgacctccaaggccgcgatggaaccgagctatccggagcttaacgacaccttccacgacgtgtccgaagccgcctacggtgaggaggacgcgttccgccgcacgctcgaatccggcaccgagatcttcgacatggccgtgacgaaggccaagcagggcggctcggacctcgtgtccggcgaggatgccttcaagctgcacgacacttacggcttcccgattgaaatcacgctcgaaatggccgccgaccagggcgtgaaggtggatgaagccaagttccgcgagctgatggccgaacagaagagccgtgcccgtgcggacgcgctgaagaagcgccacaacgtggatttgtccgtctatgacgacttcaagaagaccctgctccagccgatcgacttccttggctacaccgacatgtccgcacgtgccaaggttctgggcatcatgcaggagggcaagggttccgttcccgccgtcaccggcccggccaacatcgaggtcatcctcgaccgcacgccgttctacgcgcaggccggaggccagctcgccgatcagggcgagattctgtccgacgatggcgcggtgcttgaggtcgacgacgtgcagaagccgatcaaggaccttatcgtccaccagtgccgtctgaccgaaggcacgctggttgtgggcgccgaagtcaacgcgaacatcgatctcgagcgccgtggagccattgcacgttcccacaccgccacccacatggtgcacaaggcgctgcgtgaggaacttggtccgcaggccacccagcgtggctccgaagacgctccgaaccgtctgcgcttcgatttccaatggtccagcgcccccagcaaggacgccatgaacgccgtcgaagcccgcgtcaacgagaagcttcgtgagaaccttgccgtcaccactcaggaaatgaagttcgatgacgccatcgctcttggcgccatgcatctgttcggcgagaagtacggcgacatcgtgcgtgtggtgtccatcggcgaggacggctggagccgcgagctctgcggtggcacccatatcgaccacgtcggcaagatcggcgccatcaacatcatgtccgaggcgtctatcggttccggcgtgcgccgcgtggacgcggtcgtcggccagggcgcgtatgagttcaacgcccgcgagcacgcgctggtttcccagctttccgacatggtcaacgcccgtcccgacgaactcgccgagcgtgtgaacatgctgcttgccaagctcaaggaatccgaccgtcgtcttgccgcaatgtacgagtcccagcttgcggcctctgtgccgacgctggtggctgaggccaaagcttcctcggctccggtcaaggtcgccaagaagaacgttggacatttcggctccttcgacgcgctgcgcaagaccgtgctcgacgtgcgcggccagctcggcgaagatgctccggtcgtggtggctcttgccggcatgaacgaggacggcaagcccatggtcgccgtggcaaccaacgaagcggcacgcaagcaaggcatcaaggctggtgatctggtccgtggcgcttccaaggttcttggcggtggtggcggcggcaagccggacttcgcacagggtggcggcgcggacgccaccaagatcgacgaggcacttgaggcattggccggccaggctctgaagggctgattctccaagcatggtttggcttggtatcgatctgggtgatgctcgggtcggacttgcgttgtccgatcccgagctcaccctcgcacatcccataggcaatattcaagtgtatggggattctttccgcgcgttggatgaagtcatcgacgtcattggggacgagtcggtggaccatgtggtgattggcctgccgttgctgctgaacggcgaagaggggaaaagcgccaaaaaagcgagacgctggtccgtcaatcttgaaaaacgactgcatgcggccgtggaggatgaatcatattcggtgacgcgggttcccaccattgaattggtggatgagcgtctgacgacagtgaccgcacatcatcagttgttcgatgcgcgcatcggcggacgcaagcaccgtccgatggtcgaccagcaatctgcggtggtgattttgcagacggcgctcgaccgaagcagagagtaaggggagagagacctttgaccgataatctgaacgattttttctccgataacgcgcagtgggtcgatgatacgtcagcgggctcgtcattcgatgccgcgttgccgccgcaaccgccgaaatcgcgacgcgacatgcgtaaacgacgtgagcaacaacgtcgtcgtcgctatgtcacaatcatcgcggctgccgtcgttgtcattcttgtcgtcgtcggcggctttttcggcgtgcgcatggttaaacatctcaggcagatgaacgccaacggctcgcaaatccagattgaggattacaccggttcgggagacaaagacacgacgttcaccgtggaaaccggacaaggcgcagccgaaatcgcacgaaatctggtcaaggcggacatcgtcaaatccgaatcggcgttcacctccgcagtcgcggccgccggcgcgacgctttacccgggttcgtacgcgttgaagacgcatatgaaggcggccgatgtcgtcaagatcctgtccgaccaaagcaaggccggcggtttcgccgaagtcaaggccggcgaacgggtgtccgatgtcatcgccaacgcggccaagatgtcaggcaaggacgtgtccgaattccaagcggtcatcgacggtggcggcgcgggcattctgccagatgaagcgggtggcaaattcgaaggatggcttgagcccggatcctacagcgtccaggacaagtccgccaaggacatcctcaaggaaatggtcacggcacgcgtcagcaaactggacacattgggcgtgccagatggaagcgaacgcgaacgtatcatgaacatcgcgtccatcgccgaatccgaggcatgcaatcctgacgattacggtaaggtggcgagggtcatcctgaacagaatcgaccaggacatgccgttgggcatggacagcaccgttgcctacgggttcaacaccacaggcagcaagctgacagacgagcagcttgaggatggaagcaacccgtacaacactcgcgtgaacaaaggacttcctccgacgccgatcagcaatcccggcgattccgctatccaagccgcgatgaatcctccggaaggcaaatggctgtacttcgtcaccaccaacctcaagaccggcgagacgaagttcgtggaaaccgaagacgaattctggaagattcgcgacgaatacaaaagcaacaacgcgaatgccaactgacggtatcacgcattaacacaacgcgtgcatcgcgatgcttatcgccccggccacgacaatggtcggggcgaacggcgtcttaccggcgaatcgcgtatgcttctgcgggtcgaaccgtgtccaaatcgcaagccacagcagccccagcacactaatcgcaaaccaccagaacatcactggaaacaggccgaacatgcctacggccaagccgataagcaacgtcgtggtgacgtcgccgaatcccaaagcccctggcttgatgagcgcaagcgcacattgcagcacggcggataacgcggcgaacaacagagcctgcaatgccagaaacagtgaattaacggacaacgcatacgtgatgtccacaatgacctgcgccaaacaccctacggcgatccacatgcgtggaatgcgtcgtgcccggatatcctcaacgctgacggccattccacagagcagactcggcaggcaaatcatgtaccacataccgttaagatagtccacgaatcgtatttggcagaaaaggagtgttggcatgttgcgctggcagacagcaggtgaatcgcacggcgaagcgcttgtcgccatgatcgaggggctgcctgcgggcatccacgtcactactgaggatatcgtcggcgcattggcacgccgacgtctcggatatggccgtggtgcgcgcatgaaattcgaacaggacaaggtccgcatgctcaccggtgtgcgtttcggcgagaccatcggctctcccgtcgccatcgagatcgccaataccgaatggccgaaatggaccgaggtgatgagcgccgatccgcttgaccatgacattccgcgcgaaggccgcaacgcgccgctatcccgtccccgtccggggcatgccgatctgactggcatgcgcaagtacggtttcgacgacgcccgtccagtgctggaacgttccagcgcacgtgagaccgcgtcgcgtgtggccttaggcgaggtcgccaagcagttccttgagcagacgttgggcatacgtaccgtctcccatgtgctgtcaatcggtggtgctggcatcaccgacccgcagaatgcggtgctgccgaagcctgaggacctcgaagcattggacgcttcgccggtgcgcacattggataagacggccgaacagcagatgatcgcacgcatcgacgaggccaaggagaacgccgataccttaggcggcgtgatcgaggtcgtggtatacggcgttccggctggaatcggcacgtacgttgaatcggaccgcaggctggacgcggcattggccagtgccgtcatgggcgtccaggccatcaagggcgtggagatcggggacggtttccttgaggcgatgcgtcctggctcccaggcgcacgacgaaatggcggttggcgacgatggccgcatcacacgtctgagcaatcgtgcgggcggaatcgaaggcggcatgtccaacggccagccgattgtggtgcgtgccgcgatgaagccgattccatccattccaaaggcgcttcgcaccgtcgacgtcaccaccggcgaggcggcccaggccatcaaccagcgttccgacaacaccgccgttcccgcggcggccgtcgtggccgaggcgatggtgcgcctcaccatcgcgcaatacgtgctggagaagttcggcggcgacagtgtggccgaaaccaagcgcaacgccgaatcctatgtggcgtcctggccggagcacatgaggtgaccgattcgatggctggaatgcgtagacccgtcgccgtcatcatcggcatgatgggcgcgggcaagacccgcgtcggcaaggaagtggcgcagatgatgcaactgccgttcgccgacgccgacaacgagatcgaacatgacgcgggaatgaagattcccgaatatttcgaaaggtacggcgaaccggagttccgtaagctggaaagcgacgttgtgcttgacatgctggaggatttcgacggcatcttctccttgggcgggggcgctccaatgaccccgtccatccagcaggggctcgccgaatacatcgccgacggcggcaaggtcgtgtatttgatggccgatccgaaggaagccatggaacgcgccaaccgcggcggcggccgtccgatgctcaacggcgacgccaacgagcgttggaagaagttgtacaaggaacgcgacccggtgttcagacgcgtggccaatgtgcaggtgcgcacccacggacaaaccccgcaagtggccgcgagaaagctgatggaaatgatcgatcaacgtatcgtccacgtcaccggattcaccatcgaaccatacgatgtgtgcataggcgaaggtgtgatgagccagcttgcgcaggtgttgggagacgagcccgccaaagtggcattgattcacacccagccggtgcaacggcattccgaccgcgcgcgcacgctgttgcgccagtccggttatgacgtgcacgacatcgtcattcccgatgctgaagccggcaagaccatcgaagtggccaacggcatctggcagcgtctgggggaggaaggcttcacccgttctgatgcgattgtcggtctcggcggtggcgcagccaccgatctggccggtttcgtggccgccacatggatgcgtggcatccgctacgtcaactgcccgacctcgctgctggccatggtcgacgcctccaccggcggcaaaaccggcatcaacactccacaaggcaagaacctcgtcggctcgttctatacgccggccggcgtgctcgccgacatgggagcactcgcctcgttgccgaacgacatcttcatcgaaggtctgggcgaagtggcgaaatccggtttcatcatggatccggagattctgcgcatgcttgaagaccatgccgacgagctgcgctcgttcgacggttcgacgttccttgactccgatctgaaggatgtggtcgccgaactcatcgaacgtaccgtgacggtgaaggcgtaccatgtgtccgccgacctcaaagaagccggattgcgtgaattcctcaactacggacatacgcttggccatgccatcgaaaaactcgaacacttccgctggaggcacggcaacgccgtcgccgtcggttgcgtctatgcggccgaactgtcccatctgctcggctacatcgaccaggatctggtcgactaccatcgttcgctgctcggctcgctcggcctgccgacatcatggaacaatggcagctgggatgatgtgctggcgctcatgcaccgagacaagaaggcccgcggcaacaaactgcgtttcgtcatactcggctcgctcggccatcccatccacctcgaggatccgccggcggacgccgtcgaggaggcgttccgacgcatccagcggtaggacgcaatcgcaagaacgaacacaaaaggaagcaatatgaccaaagtagtggttgtcaacggaccgaacctcggccgtctcggagtgcgccagcctgacgtatacggcaagcaggatcttgagaccctgcgcaaactgtgcaccgaatggggtcatgaactggggcttgacgtggaagtgcgtcaaagcgacgacgaggccgagatgattcattggatgcatcaggccgcggacgaaaaaacgccgatcgtcatgaaccctgccgccttcacccattattcctatggactcgccgacgcggcgtatatggtcatcgatgaaggtctgccgcttatggaggtgcatatctccaacccgtccgcacgcgacgagttccgcaagcgttccgtgatctctccggtggccaccggcaccatcaccggcatgggattctatggctacaagctggcaatcgaagcggttgcgcacttgttggaagaacgctgacatcgacattccgtcatggattcagccggatgcctgtctttaaggcatccggctttttcgtgccaatgaggacgacgcatatcccggtctccccggattggtatacagtgatattgcaaacgtatgcaaaccgggagcatggcgaagtgacgaagaggtcgatgactatgggcgcaatcgcaagaagaatcacacgtgtcattacggcggtcgtatgcgtcgcggtatcggtcggtgtctcagtcgccacgcttcacgtgccgacacgtgaaggcggcggggaacgtttcaatcccgcgcgataccgcagcgacgtgatcgtgaccatgttccaagccaattggaaatccgtcgcccgcgaatgcggcgaagtgttgggacccgaaggcgtcggctacgtacaggtctcgccgccgcaggaaagcatccaaggcgcgcagtggtggacgagctatcagccggtaagctacaaacttgactccaaagaaggcaccgaagctgaatttaagaacatggtccggcaatgcaaggccgcgggcgtcggcgtgatcgcggatacggtcatcaaccacaccaccggcgtcgacaaaacacaagggaccggcaccgccggaagcccctacgacaataaaggcgatttccctgaagccggatacacgccatcggacttccatgccccctgttctatctggacgtaccgcgacgccgaaagcgtgtggaactgccaggtatcgggtttgcaggaccttgatacatcaagcccgcacgtgcgcgacgtgctgtctgactattttgtgaagcttctcgactacggcgtcgccggattccgcgtggatgccgtcaaacacatgcctccggaagacgtactggccatcaagaaactcgttgcgaagaaatccggacgttccatgaacgacatctggtggacgcaggaagtgattggcgacaatgcggaagccgccgaaatccaaccgaggaactatctcaaaaccggccaggtgaacgaattccagtacgcatatcggcttaagtccctgttctccaactcgctggcaggcggaagcctgtcgatcaaagacattccgcagaacatcaccgacagtggcaaggccagcgtattcgtgacgaattgggataccgaacgcaacaacatgacgctcacctacaaggacggcgacgcctaccagctagcgaacgcgttcatgctggcctacccgtatggcaccccaacgtgttctccggatacgaattccatgacaccgactcgggagctccaggcgccactgcaaccagcgtgcccgatattgactgctccaaagactccggctgaagctgcaccgaacgctggcctgacgtgcacggtatggtcggctggcataatgtcgcaggcgacgcgccgctctccgattggcaggatgacggcgacaacatgatcgccttcggtcgagggggacgtgccttcatcgccatcaacaattccgtgcgcacacgtactgtgacgtaccacacggctttgccggcaggggagtattgcgatgtctatgcttccgccgactgttccggcagcgtgcatgtgcgtttcgacggggatgccacactgacggttcctgccggtagtgcagtggccttccatatcgccgcgacaccgtataccgtgagacaatgattgcaatcgtttgctgtttttgcagctatttctgaatgttttctgcttgacttgcagaaaaaaattttgcttgcagcaacaggttgcacttcggcatatatgaagtgcatgtgcagcagagggtcacgctgtttcattgccacgcgcagccattggcatacagttaactctgattcagagtgtaaacgtatgcatattcatcgtcgagtggattctgaatcatccgcgtggatgcggatgtccatggcgcatacgttgccggttgcggagcctgccatgggcgcttgaaccggcctcacagatgagaacggagaacaatggtcgttcagacgaaccggccgtttggccgtgtggtggcaataggagccaccgcagccatggcgtgcgcctcgctggtcgcggcgccgattatggcccaagcgcaatccaacgcgcaggtcagcgccaaaaaggatgtgcaggtcatcgcgttccaacagacatggaacacgatcgccaaggaatgcaccgaaacatatggtcccgaaggcgtgggctacgtcgaagtatcgccgccgcaggaatccatccaaggcacccaatggtggacgagctaccagccggtgagctacaagcttgactccaaactcggcgccgaagcggaattcgcaagcatgatcaagcagtgcagcgccgccggcgttaacgtcatcgccgatgtggttctgaaccaaaccaccggatccgatgtggccaaaggcgaacaggccggcgttgctggaagcaaatacaacggttccaccggcgactacccgggattcgccaccaagcagtatccggacggcatcaccgcagcagacttccacagctgcgacaagaacatctccaactacaccaatcagcaggaagtgcaggaatgccgcctgagctccatgtgggacttcaactccgaaaacgagaaggtgcaggacatccagtccgactatctcgtcaagctgtggaatcttggcgtacgtggcttccgtatggacgccgtcaagcacatccacacggacagcatgaaggccatcaaggagaagttcgccaagaagattggccagaacgccaatgacatctactggattcaggaggtcatcggcaattcctccgaagccgcaggcatccagccgggcaactatgtgcagaacggcaccgtgaccgagttcggcttcaagtccgaaatgaaccaatacttcaaggacaaggtcgccaagctcaaaggactgaacgaaagactgagcaaggatctggcctccaaggacgccaacgtgttcgtcaccaactgggacaccgcccgcaaccagggcgcgctcacctacaaggacggtgcgaaatatcagctggccaacgcgtttatgctcgcctacgattacggcacgccgcgactgctctccgactacaagtgggatgacggccacaatgatgacggtgcgcctggcgccaccgcggcttccgtgccggacgtggatatgaacaaggaatgctccacgaacaactccgcatggaactgcgagcagcgttggacctccacccgcggcatgatcgccttccataattacgtaggtgacgccgaaatgaccgattggcaggatgacggcggcgacaacatcgccttctcccgcgacgaccgtggtttcatcgccatcaacaacggcaagaaagagaaggacgtcacctatacgacgtccctcgccgacggcgaatactgcgacgtgtatgccacaatggactgctccaagacggtgaccgtcaagggcggcaaggtcgagacgaaggttccggcacgttccgcgatcgcgctgtatgcaggtgccaccaaggcctcgcatcccgccgcctccactgcgaccgatccgtccgatccggacgtaagcaaaatcgacgacgaggtgacggccaccgacaagaccatcaccatctattacaagcccgcggattccacatggaaaaccccgaaggtgcactatggtcttggcgacgactggaaccagccggaagccgacatgacgctcgatgagcagggctattaccgtgccaccatcgatacgaagggcaagaagatcgacttcgtgttccatgacgccgacacggatcagtgggagaacccggacggtggaggcaactaccatgccaacgccggtatcatccaggtcggtgtggccggccaggagctgtccatcggcaatcccgagtccgtcgggcagaagacccgtctcgtagtgcactacaagcccgcaaaggctgatggccagcgaggcgtatacgtgtggggcacctccactgacggaaccgatatcacggccacgaaccatccgttcaccggaaccgattgctggggcaaggtggcgacgctcgacttcgatggcgaattcaccgatttcggcttcatcatcaccaccgaggactggaacaagtacggtggtgaccgtaaggccacggtcaataagaccggcaccgcagaagtgtggatcgacggcaccaagaacgaggacaagggcgaatccaccacagtggaaaccctcgactccgctcccgccgactacaattgcaaggccgataccgtgaacgtcaccgtgcattactaccgcgatgacggcctctactacaatgccaaggacaccaaggtgaccgtgccgcagtgggatatctggacctggtcgagcaattggaacggcggcaacgccaccttcgattcccatgacgattggggcgaggtcgcgaagtattccgtgccgaattacacctatagcaacgcggatggcaattccgacatcggcatgctgcgcaggtatggttctgacgcatgggcttccaaagacccggatgacgccaaccatatgatcccgtccgacgcgctcgtattcgacgcagacggcaacgcttccgccgaagtgtggctggtcggcggcgatcccacggtgtattcctcccgtccgtctctgaagatcgcacttaagtccgctgagatctccgatttcaaggaactgaccgcgcgtctgtcgaagaagccggccgatggcgccatcacgaaggccatggtggccgtcaaggacgccgatggcaacaaggtcgatgttgaggacgtcaccgtcaataagagcacggtgaagatcaagaccgccaagaagctcgccgtcaccggcaagtacaccattgagatcgagggcatgggctctcagacggccatcgccggcgctctggtgcgtaccgacgccttcgacaaggcatacgcctatgatggcgacgatttgggcgctaccttcaaggaggctcggaccggtttcaaggtgtgggctccgaccgccaccaaggtagagctcgtcatctacaagtccaccgatccgaacgccgaagtcgacaagaccatcgatatgaccggcgaagacaagggcgtgtggagcgccacggtgaagaagctcgcttccggcaccgcatactcctacaagctcactttcgccgatggcacggtcaacacctcctccgatccgtacgccaccgccgcggtcgccaatggcgagcgttccgtggtgctgtccaaggaggatatgggatccgccggcaagcgcatgccggccttcggcaagaccactgacgccaccatcgcggaaatgaacattcgcgacttctccatcaacccgaattccggcatttccgcagacaagcagggcaagtacctgggtgtcgtggaatccggcacgaagacgaaggaaggcgccacctccggccttgactacctgaagcagctgggcatcagccatgtgcagatcatgccgatgtacgattatggttccgtcgatgagaccggcgacctgagctacaacgcgaatggcgcgcagaactggggctacgatccggagaactacaacgtgccggaaggctcgtattcctccaatccgtccaacccgagctcccgtgtcgccgaaatgaagcagatggtcaaggaactgcataagaacgacatccgcgtcatcatggatgtggtgtacaaccacgtctacaatgcggcgaaccactcgttcaacaagacggttccgggctactatttccgctatgacgccaacggttcgctggtcaacaactccggctgcggcaacgatacggcctccgaacgcaagatgatgcgcaaatatatcgtcgattcggtgacctattgggcgaagaactacaacgtggatggcttccgattcgaccttatgggcctgatcgacaccgaaaccatgaaggaagtccgcgccgcgctcgacaagatcgatccgtccatcatcatcctcggcgaaggctgggatatgaacaccacgatggacaagagcaagatgaccatccagccgaacgcctaccaggtcgcatcggacggcaagaacaacggcattgccttcttcaacgattccatccgtgatggtctgaagggctccgtgttcgacagcgccgacactggcttcgtgtccggcaaggccggtcaggagaagctcatcgcgcacaatgcgttgggctgccagtatgacgccgaagcggaaacgacctgctggaacggcaatgcgcaggatcattacgcggatgccggccaggtggtcaactacgccgaaatccacgacaacctgaccctgtacgacaagctcaaggcatccgttccgacggatgacgaggccaccaccgtggcccgcgccaagctcgccgattccgtggtctacctgtccgaaggcattccggccatccagctcggccaggagttcctgcgcaccaagggcggcaacggcaacagctacaacgcaggtgacgcggcgaacgccatcgactggaaccgcgccgcgcaatacgccgattccgtcgactacgtcaagggtctgatcaagctgcgtaagcagatcaaggcgctgcgcctgaccaactacgacgacatcaacgacagtgtgacgatgctcaagtccgatgaaggcgtcgtagcctatcaggcaaaggattccagcggcacctacatggtgatcttcaacgccaacaacgagcccgccgccgttgaaggcataggcgccggcaagtacaacgtgctcgccggcgacggcaccgtgtacgacgagaacgccaaggatgccttcgtccgcaagggctccacgtacactgcaggcgcgctgtccgccaccgtgctcaaggtcgcctctgccgacgatgtcgttcccgttatcagcggaatgaccgaatcgacgaccatcaccgtgggatccaagttcgattcgatggccggcgtcactgccgatgactccattgatggtgatctgaccgacggcatcaaggtcgaaggcactgtggacgccggcaaggtgggcgactacaagctggtctattccgtgagcaattcccgcggcaagaccacaacgtttacccgaacggtccatgtccagaagaaggttgtcgtccctacggccgaggcgaatgcagccagcggtaaaaagaacgagaacgcatcacgggcgcagagtccggcaaccggctccaacgtcatgggcctcgccctggcgatcgcggcgctcgtcatcgcagcgggcgcgctgatcgtctcccacaggaaggaggtcagcaaccgataagaccataatcgtctgactgcatctcctattcctggaagatggggccgcgcatgaagcgcggccccatcttttcatatagtccgaaacacgccacgtctcacaccgctgataaactgaagttccatggttagaagacaacatggcaattctcaagagcacgtcaccaagcatattttcgttaccggcggcgtagtctcctcccttggcaaaggcctgaccgcctcctcccttggccgcctgctccgtagccgcggcatcaaggttttgcagcagaagctcgatccgtacatcaacgtggatccgggcacgatgaatcctttccagcacggtgaggtctatgtcaccgaagatggcgcggaaaccgatctcgacatcggccactacgagcgtttcctcgacgtgtacctgagccagaaggccaacgtcaccaccggccagatctatcaggaggtgctgcgcaaggaacgcgccggcgaatacctcggccagtgcgtgcaggtcatccctcacatcaccaacgaaatcaagtcccgtatgcgcgcgcaggcgtccgatgacgtcgacgtgatcatcaccgaaatcggcggcaccgtcggcgacattgaatcccagccgttcctggaggccgctcgtgaagtacgccgcgacctgggcgccgaaaactgcatgttcgtgcacgtctccctggtgccgtacatcgccgccgcgcatgagctcaagaccaagccgacccagcattccgtcatgatgctgcgccagctcggcatctccccggacgcgctcgtgctgcgttccgaccggccgctcaaccagtccatcaaggacaagatctccctgatgtgcgacgtggactccgaaggcgtcgtcaactgcgtggacgctccgagcatctacgacgtgccgaagaccctgttcgacgaaggcctcgacgcctacgtggtgcgtgaactcggcctgccgttccatgacgtcgactgggacgagtgggaggacctgctcgaacgcgtgcaccatccgaagcacgaggtcaacgtggccatcgtcggcaagtacattgacctgccggacgcctacctgtccgtcaccgaggccatcaaggccggcggcttcgccaactgggccaaggtcaacgtcaagtgggtggccgccgacaagtgcgccaccgaagaaggcgccgcggcggccctcgaccaggtcgacggcatcgtgattccgggcggcttcggcatccgtggcatcgacggcaagatcggcgccctgcgttacgcccgcgagcacaagctgccggccctcggcctgtgcctcggtctgcagtccatggtcatcgaatacgcacgcgatgtcctcggcatcaccgacgcgaactcctccgaattcgatccggattgcgccaacccggtcatcgccaccatggaagagcagaaggacatcgtcgccggcaagggcgacatgggtcacaccatgcgtctgggctcctacccggcggaactggaggaaggctccattgtcgccgaactgtacggcaccacgcatgtcaccgaacgccaccgccaccgttacgaggtgaacgtggcatacaaggatcgtctgcgcgaaggcggtctggtcatctccggccagagccctgacggcgaactcaccgaattcgtcgaactgccgcgcgaggtgcatccgttctacgtggccacccaggcccatccggaattcaagtcccgtccgaccaagccgcatccgctgttcgcgggtctggtcaaggccgctctggaccaccagcaggcgcgctgagacgatttgagcgcataagctcgattcatcgcaaagcggaagaccgaatctgcatggtcttccgcttttttgtaaggcaaatcacgggcgaatactgtcgaatttcgaataaggtctagtgtttcgctgtgtgttctgttaggttgtcataggtatcaatgagtgaatggaggcagcgtacggtggcagagaaccaagcgtccaacgccgcggccgacgtggagatgagccagtatgtggctgatcgcacgcgcgtgaacgaagacaagatcaagcaggatgacgagatcatcgagcaattcggtgactacaactacggttggcacgatacggacttcgccggcgaggcggcgaagaaaggcatcgacgagaacgtcgtgcgtgccatctccgccgacaaacacgagccggaatggatgctggaaaagcgattggaagggtatcgcgatttcatcaaccgtccaatgccgcagtggggcgtcgatttgaaggacttcgacgccgacgatttcaagtactacgtcaagccgatcgacaagcaggccaccacttgggaggaactgcccgacgaaatccgctccacgtacgacaagctcggcattccggaagcggagaaaagcagactcgtctccggcgtcgccgcgcagtacgagtccgaggtcatctacaattcaatccagaaggatctcgaagagcagggcgtcatcttcgtcgacaccgacaccgccgtgcaaaagtacccggaactcgtcaagaagtatttcggcaaatgcattccgagcaacgacaacaaattctcggcattgaacaccgccgcatggtcgggcggctcgttcgtatacgtgccgaagggcgtgcacgtggacatcccgctgcaggcatacttccgcatcaacacgccgaacatgggacagttcgaacgcacgctgatcatcgctgatgaaggctcctacgtgcattacgtggaaggctgcaccgcgccgatctactccaccgactcgctgcattccggcgtggtggagatcttcgtcgagccgcacgcccgtgtgcgttacaccaccgtgcagaactggtcgaacaacgtgtacaacctggtgacgcagcgcgcctacgtgcgtgagggcggcaccatggaatgggtggacggcaacatcggctcgaaagccaccatgaagtatccggcatgcatcctcgccgagccgtatgcgaaggccagcaccatgtcgttgggcttcgccggtaagggacagtaccaggacacgggcgcgaagatgattcacctcgccccgcataccagctccaccatcgtggcgaagtcgatttcccgtggcggcggacgttccgcataccgtggcctcgtcaaaatcgtcaagggcgcggaagggtcctccaattcgacggtctgcgacgctttgctcgtcgacgaattcagccgttccgacacgtacccgcatgtggatgtgcgtgaggacaacgtctccatggcgcatgaggccaccgtttccaaggtctccgaagaccagctgttctatctgatgagccgcggcctgtccgaagacgaggccatgggcatgatcgtgcgcggcttcgtcgaaccgatcagtcgcgagctgccgatggaatacgcgctcgaattgaaccgtttggtggaattgcagatggaaggatcggtgggctgatcaccatggcacaaactcaggaaatcaacatccccgtcgcggatccgtccgatccgtacgcgaatccggcggccatgccgtcatccgcggaccgcgctccacgctcattcgacatcgaagcgttcgccaagccggaccgcaaacaggaggactggcgctacacgccgatagagcgcatcgaggagttcttcgatgtgttcgaaccatccaatgaaacgcaggtcaccgtttccatgatcgacgggtcgccgcttgccgaaggcgtcacgtatgccgaaggcacggtgggggacaccggcacaggcatcgtctccaagccgaacgaccgcgtgtccgcagtcgaatggaattccggcaaacgcgctggaatactgaccatcgacggtgagatcgaccagccggtgctcgtcaaaatgcatggcaccggcaaggacctcgacgcgttccacctgtcgatcatcgcagccgaccgcgcccatgccgacgtggtcgtcgaacatgacggcgacgcacgtctcgccgaaggcgtggaaatcaccacaggcaaggactcccacatttccaccaccttcatccaggaatggaacaaggactccaaacacgtcggcaaccagcgcatccacgtgggcgaggaggcgtccctgcgccattccgtggtcaccctcggtggtgatgtcgtgcgcattcgcatggaccaggacttcggcggcgaacagggcgacctcaacatgctcggcatctacttcgtggacccggacgagcatatcgaacaccgcacgatggtggtgcacaaccatcccgaatgcaagagccgcgtggtctacaagggcgcgctcgacggcaagggcgcgcactccacatgggtcggcaacgcgctgatcgagcctaccgcgccaggcaccgactcctacgagctcaaccgcaatctggtgctcaccccaggtgccatcgccgattccgagccgaatctggaaatcgaaaacggcaacatcatcggtgccggccacgcctcatccgtcggacgattcgacgacgaagagctgttctacctcgaatcgcgcggcatctcggaaaacgaggcccgcaagctcgtggtgcgtggcttcttcggcgagctcgtcgaggaaatcggcattccggcgatttccgagcatcttatgaacgtcatcgacaagcgcctggcccgcggcgaaagcgacgcgatcgcacaggtattggaagagaaataatcgtcaggagaaaccatgtcaacccttgaaatcaaagatctgtacgcgcacgtcgaaaccaaggacggcatcaagccgatcctcaaaggcgtgaacctgaccgtcaactccggtgaaacccatgccatcatgggccccaacggttccggcaaatccaccctggcatacacgctggccggccacccgaagtacatcgtcgactccggccaggtgctgctcgacggcgaggacatcctcaagatgaccccggacgagcgagccaaggcgggcatcttcctggccatgcagtacccggtcgaagtgccgggcgtgtccatgaccaatttcctgcgcaccgccaaaaccgaagtggacggcaaggcgccggccatccgtacgtggacgaaggaactgtccgaagccatgaagcggctcaagatggacccgaagttcgccacccgttccgtgaacgaaggcttctccggcggtgagaagaagcgcgcggaagtgctgcagctcgaactgctcaagccgaagttcgccatcctcgacgaaaccgactccggcctcgacgtcgacgcgctgcgcatcgtttccgaaggtgtgaaccgtgccaaagaagccaaccagttcggtatcctcatggtcacccactacacccgcatcctgcgttacatcaagccggacatcgtgcacgtgttcgccgacggccacttcatcaagaccggcggtccggaactcgccgacgagcttgaggagaccggctacgacgcatacctgccggaaggctccgattcggaaagcgcattggcatgaccgatttcgcagcgatccgcagccaatttccgattctcgaccaggaaatccacggccatccgctggtatacctcgattccgccgcgacatcgcagaagccgcagtgcgtgatcgacgcggaatcggacttctaccgcaccatcaacgccggagtgcaccgaggcgcgcatgagcttgccgcgcgtagcaccatggcgttcgaggatgcgcgcgccaaagtggccaagctggttggcgccgattcggcggaaggcgaagaggagatcgtcgtcaccgccggcgccaccgcaggactgaacctgttggccaccgcattcggcaacgcgtcgcttggacgcgggggagaggccgccaagcgtttcgcgttgaaaccgggcgatgagatcgtcgtcaccaaggcggaacaccattccgtgctgctgccgttccaggaacttgcgctgcgcaccggcgccacgctcaaatggttcgacttggacgaggaaggccgtgtgcgttccgacaccgcgaacgaagtaatcaccgaccgcacgaagatcgttgccgtcacgcatgtgggcaataccacaggagcgattaccgacatcgcgccgattatccgccgcgcccacgaggtgggtgccgtgttcgtgctcgacgcatgccagtccgtgccgcacctcaaagtggatttccacgctttggacgtcgacttcgccgcatggagcgcccacaaaatgtatggcccgaccggcgtcggattcctctatggcaagcgtgaaatgcttgaggcattgcctccggccaatttcggcggatccatggtggagcttgcctggatggaccaggaagcccagtacatggagcctcccgcacgattcgaagcgggcacgcagccggtggcacaggtcgtcgccgccggtgtcgccgccgaatggctgatgaacatcggcatggaaaacctcgaggcgcacgaacgcaccatcaccgacgaactgctcaaaatgggcgatatcgacggcatccgaatcctcggaccccgctccaacaaggagcgcatcggtaccgtcgcgttcgaagtcgaaggcgtgcacccgcacgacgtcggccagttcatcgacgcgcagggcatcgccatccgcgtcggacaccactgcgcgcagccggtgcaccgccacttcggcgtgtatgcctccaaccgcgcgtccagcggcatctacaattcggtcgaagacgcgcaggccctcatcgaggcgctcggcaaagttcgtccgttctttggagttgagtaacgaaatatgagtgattttgagatgtccggaagcgaccttgagcagatgtaccaggaagtcatcctcgaagccgcgaagaacccgcacggcaaggagcatttcgcacctgacctcgcttcggaaaacgcctcgcatgccgccgaaaccacggtgcaggccagccacgaatactgcacgccgggagaatcgcaccaattcaacccgacctgtggtgacgaggccaccatccatgccgaagtctccgatgccgagccatacaccatcgaacggctcgtatgggatggccacggatgctccatctcccaagccagcctgtccgtcatggtcgatctcgtcgaaggcaaaaccgtggacgaggccatgaaactcgccgaaaccttccataagcttatggagtcacgcggcaaaggactgaatgacgaacaggccgaggaatccttggaggacggcatcgtcttccaaggggtctcccagtatccgatgcgcatcaaatgcgcgctgctcggctgggagggcatgaaggacgccgtggccaaggctctggccgcgaaagcctgagccttcaactcggcgtttggaaaaacactagtgacaaaccccaagcgacgcgctattcttgctcaacagatacaagcaacgtccatcaacagtttggagagacaatgagcgacaccctggtacccgaaccgcaggcgtcgatcttcgattccgtgaccaaggccttgggcaacgatgaggacgcggcccgtcgcgtcatgctcaatccgaacctggccaaagggttcaaggacggcaaaccggtgaacaaggaatccaaaaaagacgggcaggacacttgcggctgtggcaatcatgccgacgcgtgcggatgctcccaaccgcaggatgacgacattccgctgaaagccgtcgacgatatcggacgtgccacggcagctgacgtgaaagaagccctgcaccaggtcatcgacccggaactcggcatcgacgtcatcgaccttggtctggtttacggcatcgaaatcgacgaactgggccgagccatcatcacgatgacgctcaccacgccggcctgcccgctgaccgacctgatcgaagacgaatgcgccagcaccctcgccggtctcgtcgaagaattccgcatcgactggacctggcaacctcgttggacgatggacaagatcatgccggaaggccgtgaccagctcgccgcgctcggcttcaatttcgacaatctgccgaaatactgacgtttgctgcggttgccgtgcagtgaaccgcagccgccaaacgtaagaaaaacggaacaacatacgaaaggcgcgcctcccgaacggggaagcgcgcctttcgtattacgacgtatgtcagtcgtcgaccacggtacccttcggcaccacggtgatgccttccggcgtgacggtgaagccacgcgccaaatcatgctcggtatcgatgccaacggtcgaattctccgtcaacacgacgttcttgtcgagaatcgccttgtagacccgcgcgcgacggttgacgaccacaccgtcgaacagaatcgaatcgacgacctgagaccacgaatggatgcgcacgttcggcgacaggacggaatggtgcacctcgccgccggaaacgatgacgccgggggagacgatcgaatcggtggcatggcccaggcggtcgcggccggcatgcacgaacttcgccggcggcaggttgccggacagcgtgtagataggccattcggtgttgtacaggttgaactccggcacataggagatcagatccatatgcgcatcgtagaactgcttcagcgtgcccacgtcacgccagtaggcgtggtcggtcggtgtggctcccggaatctcgttggaattgaaatcgtagacgccggcctcgttgcgtgccgcgaaatacggcgcgatgtcgccgcccatatcatgcttcgtatcctcggccttctcatccaacgaaagcgccgcgaacaaggcatcggtgttggccacatagttgcccatggaggccaggatggaattcgggtcgtccggcagtcccgtggtggtctgcggcttctcctggaagctcttgatcatattcggatgatcgggatcgacctcgatcacaccgaactggttggactggctgatgggctgacggatgccggcaacggtgaattccgcgccggattcgatgtgctgctgcaccatctgctggaaatccatgcgatagacatggtcggcgccgacaatcaccacgatgtcgggctgcacgtcctcaatgatgttgatggtctggtagatggcgtcggccgagccgagataccaatgcttgccgagacgctgctgcgccggcacaggggagacgtagttgcccaacagcggcgagaaacgccatacagtggagatatggcggtcaagcgaatgggacttgtactgggtaagcacgaccgtctgcatgtagccggaattcaccagattgctcagcggaaaatcaatcagacggaacacgccgccgaatgggacggcaggcttggccctgtccctggtcaatggcatcagacgggtgccctcaccgcctgccagcacgatggaaagaatctttgggttcttcgccatgggaactcctctctgagagcgtcttgcgacaccgtacgcacggtcggtccgcttcatcacgaaaccgcttacgcacactatgattgcataaattcagcaaatcgcaaggagtttgcagcgcgagtcttgaaaatttccagttcgtttcagcaacgtttcaccatgcgttcatgcgcgtctcacgcatgatggtccactcgacgcgtcgcatagaaggcgaccgcgcttgatgcggcgacattgagactgtccacgccgtggctcatgggaatcttcaccgtaaggtcggcgcgggagatggtgtggtgcgacagtccatctccttcggtaccgaaaatcaacgcgagcttgtcaatatggtcgctttcagtctcggcgttgttgagacggcggaccaattcggccaaagaaatggaatcatcctcaagcgccatcgctacggtggtgaaccccagatcatgcagttcccgcatgccggtgaacggccaataatgcttgtcgtcccctccgatgcgcgtccacggcacttggaacaccgtgcccatggacacgcgtgccgcgcgccggtacaacgggtcgccacaggacggagtgacgagcaccgcatccacgtcgagcgccgcagccgaacgcatgagagcgcccacattcgtgtggtcgacgatattctccatgaccgcgacccgtcgagcgccacggcagacctcttcgacgctgggcagggaccagcgtttcatcgcggcaagggctccgcgatgcagccggtagccggttagacgtttgagctgctcaggcgaagcgacatacacgggaatgccatcgccccaacgtttctcgatgacatcgaacatgccgctcatgccgtcgatccacgactcctcgaccagcagggaaatcggctcgcgtccagcggccagggcacggtctatcactttgggcgattcggcgatgaacaatcccttgctgggctccagcctgttgcgcagctggatttccgtgagattcacataagccgccacacgctcgtcgtcgatggagtcaagatgaatgaaccgcattgcccgtattccgccaatctttcgtcagatacaagaaaaccccttgtctccaaggggtttattccggtgtccggagcgggacttgaacccgcacgcctgtataaaataggcactagcacctcaagctagcgcgtctaccattccgccacccggacaggtgtgttgctcagcggcaacgaatgaaaactatagcagttgaaatccatgatgcaaatcccggcgtgtcgcgataggtccgatatgggttatgtggggttcctgataggctcggaagctatgactgatgccctttttctgcttgatacggaccatgacgacgtaccggtgaacagcgacgagctcaacgccggatggaggctgacgcttccctcatccgtacgcaggcacgccatccaggccatgcgattgaaggacggcgacgaactgcagctttccgacggcaggggattgcgcatccacgccgtactgcgcgacgtgcagcagggaatcgcggaagtgctgcgattcggcaaggagccgcagccggtcaccaggctcgcgctggtgcaggctctcgccaaaaccggccatgacgagcaggcgatcgatatggccacgcagatcggcgtcgatcaggtgattccctggcaggccgaccgttccatcgccaaatggaaggcaggacgtactgacaaaaagtggaggcaggtgctggaatccgccaccgaacagtcgcgcagatcgtggacgccccagctggacgattgcgtgaccagcaagcaggtggtcgccatctgcaagcgcgcatgcgtgcatggcgacatggtgatcgtgctgcatcaagatgccacgaagacctgggaacaactggaaaccggtatcgccaaactgtccgatacgtgtctgaaggacggacgtccgcgcaccatatatgtgctcgtcggtccggaaggcggcatcagcgacgccgaagtcgaggcgttcacgaaagccggcgccgaagtgtgcgtgctgggaagcaacatcctacgtgcgtccaccgccggtccggtcgcgctgtcattgctcgcgcgagcattgggacgtttcgtctgatcccggctccattgcgtgaaattgccggaatcgccccgtttcctgctggtgtagcatggtagcgaaggtttttccaataccgataaggagcgttatgagcgacaaggattgcctgttctgcaagatcatcgcaggtgagattcccagcgagaaggtgtacgaggacgatgccacctacgccttcaaggacatcaatccgaaagccaaggtgcacgtactgatcgtgccgcgcaagcactacgcgaacgtcgccgaactcgccaaagaggatccggcacagctcgcccacatggccgaagtggcgcagaaaatcgccgaccaggagttccatggcgccttccgtctgatcttcaacaccggaatcgacgccggacagaccgtgttccacgtgcacgcccacgtgcttaccggcgaaaagctcgacgaatagtccacatactgcctaccgccaataccgacatcggaagaggttctgtgcccaccactacacgcaccatcgcgataccccaacagcttgatccggtgaccgtgctcggccctgtggacgaggtacttcgggaagtcgaacgtgcgttccccgacctgaccatcatcgtacggggcaaccgcatcgccatcatgtcgcattccagcaaatccgaatcccaagccgcccaagccgaacaggtggttgccgatatcatccaagccgcctataccgcgccgatggacgccgataccgtccgtcgcatgctcgaccagaacgtgcttaaaaatccggtccgcgccacacatcccggccacggccgcgtggtggaggaattgcgcatggccggcaggcaacagtcgcacgcgtcccatcgtgaggaaaccgccgacaggcggcgtcctcacgtgccgggcgtcatcaccttcgcgctcggcaaaccggtccgtgccaaaaccgccggacagatagcctacgtcaacgccatcgaatcgcacaccatcaccttcgccatcggaccggcaggcaccggcaaaacctatcttgccgtagccaaagcggtacgtgctttccaagacaggcaggtccggcgcatcatactgacccgtcccgccgtcgaagcaggggagaacctcggtttcctgccgggcacgctcaacgaaaaggtcgacccgtacctgcgaccgctgtacgacgcgctgtccgacatgctcggagcggaccagctcaagcgatacatggacgacggcaccatcgaagtggcgccgctcgcctacatgcgcggccgcacgctcaacgacgcgttcgtgatcctcgacgaggcccagaacaccaccgaacagcagatgaagatgttcctgacccgactgggattcaacaccaaaatggtcatcaccggcgacgtgacccaagtggatctgaccgtgccgaaatcaggtctggccaccatcgaacgcatcctcgacggcatcgacgacatcgccttcgcccacctgaagcccgaagacgtggtccgccacgcgctcgtgggcaaaatcgtcgccgcttacgacaggcacacggccatagcgggagaccacagcagaagcgcgcgtgccgcatcatcgcaaccattcgacgacaagaacaaggaaaacgcataaatgagcgttgaagtgacgaacgaaaccgcctggcagatcgacggcaaaatcttttccgacctcggcgtatgggtcatgagccagatgagggtcagcacacaatccgacctgaccatcatgttcgtggacccggatcccatcgcccaactgcacatgcgttggatgaacctcgaaggccccaccgacgtcatgagcttcccaatggacgaactgcgccccggagacggcggaaccgaaatggaaggcgtgctgggcgacatcgtgctatgcccgtgggtggccgcccagcaggcgctcgcggccggccacagcaccatggaggaaatgatgctgctgaccatccacggcatcctccacctgctcggatacgaccatgtcacacccgaacaggaacggcagatgttcggcttgcaacgccagctgctattgacgttcttcgcgcttcgacagggagccggcgcgcgggcgacgcttcccgccggcacgccggatgcgctcgccgaatgggaccgcgaacacgcggccggcggcaaaacggccaaatgacggcatgatgcatcatccgacggtttcgaaagtgggggttgacgaaccatggaaacaacgactatcacgatgattgcgattctcgtcgtcatcgcattgctgctggtctggctgtcgctgtcgatggccgcgacggaaggcgcggtgggacgtgtcacgagggcaagtctgaacaacctcattcttgagattcagacggatacggaggcgtcgcaattcatacgcgacaagaagatcaaacgcatccacaaggtgcagcggctgatcgccgaccgctacgcgaccgccggttcatgcgcgttcttccgcatcacctgcaatgtgcttgacggtgtgttggtcgccgcgatcgcgtcgttgtgcgatgcaccgttatgggcgggactgcttgtcggcttcgtgttcgcgctggtggtcgcggtgatttcgctgctggtccgtccacgtagcgcgggcgcctccaaaccggtcgatctgatgctgaagcatgccgatgcggcgtcggtcgcggtggctttgacgccgttcgctaaaatcggcggacagaaggatgcgaaacgtcattcgaatgatctgtcggacgatgaggagcttgaaaaaatccaactcgaacaagggcgcgccaccatagatcgtctggtcgaggcgaatgatttcgaccctgaggtttccgaaatgctgcgcaacgtattgacgttgtccgaaacgttgacgcgtgagatcatggtgccgcgcactgatatgatttgcatcgaacgcggggagacgctggagaacatgctgaaattgtgctcccgttccggattctcccgtataccggtcatcggcgatgatgtggatgatctggtcggcgtggcatacctgaaggatgccgtgcgcgccacggcgttcaatcccgcggcgatatcccgcgatgtcgaatccatcgtccgtgacccgatgctggtgcccgaatccaagccggtcgacgacctgttccaccagatgcagcgcacccgccagcatgtggctatcgtcgtggatgaatacggcggcatcgccggcctggtcaccatcgaagacaccatcgaacagatcgtcggcgaactggaggacgagcacgaccgtacccagcatgccgatccggaacaaatcggcgagaacaaatggagcatgccggcacgcacgcccatcgccgacttggaggagatcttcgaaatcgacatcgacgaggacgacgtcgacacggtatacggtctgctcaccaagctgcttggccgcgtgccgatcgtcggttcgacggccgtcaccaggggcctgcgcctgaccgcggtcgactccgcgggacgccgcaagaaagtgtccaccatcgtggtggaaccggcccacgtcgagggcgtggacgaaactgaacaacacgaagaccatacgaacggtgccgaagaggcatcccatgacgacaaggattccaaggacaagcatgactgacgcagatgtgaccgaaccggcttcccagcattccgacgccgaagcccccgttccatatcgttccggcttcgtcgcggtggtcggacgtccgaacgtcggcaaatcgacgctgatcaacgcgcttatcggcacgcagatcgccatcgcctcatcccgtccggagactacacgtaaggccatccgcggcattctgaccacagacaacgcgcagatcgtgctggtcgatacccccggtatccaccgtccgcgtacgctgctcggacagcggctgaacgatgtcgtcgacgaatcgctatccgatgtcgacgcgatcgccttcctgctacccgccgaccaggaaatcggccccggcgacaaacgcattctgagcaggctgcgttctgatttcgccgtcaaacgcgacgacggcacattcaaatggaaggtgccgctgatcgccatcgtcaccaaaatcgacgaattggaccgaagcgctttgatcgacaagctcatcgaaatcaacgagttcgccgacttcaccgacattgtgccggtgagcgccctcgagcacgacaatctcgccgaagtacgcaacgtgctggtggagaacatgcccgaaggaccgcagatgtatccggccgagcaaatcaccgaagaacgtccggaagacaccatcgccgaactgattcgaggcgcgttcctggaggaattggatgacgagctgccgcattcgctcgccgtggtggtggattccatcgaatatccggaagacaacgacagcggcgaatcctacgcgggcaaggcgcaggtgattgtgtcgatctacgtggaacgtgattcgcagaagccgatcatcatcggacataacgcggagcatctggtacgcgtcaagaagaagctgcgcaccgcggtcaaccgcatcgtcgggcagaaggccaagctcgacctgcatgtcaaggtggccaagggatggcagtcggatcctaagcagcttgagaagctgggcttctaagccgcttaggatccgcttcgcggcgaagccgctcacttcgcctacggtcagcccactgggctgcccgtttgacggctcagccaagcagcttgagaagctgggcttctgatttttttccgggtgggaacaataaagcctgccgctgtttatgcggcaggctttcttatgctctaagcttgttggtgctggatggtcacttcttcttggtgtacatttgcgtgttcagcagggtggcgtaacgcttgatcaccttcggacggatgaccttcatggaagcggtcatcaaaccgttctcctgtgtgaactcctccggcaggatgatgaacttacgcacggattcggcacgggacacgccctcattggcctgatcgacccacttctggacttcggcgcggacggccgcgttgctggaggcctcctccatcgacatatctcggttgagacccttgctttccagccatggacgcaacgcttcctcgtcaagcgtgatcagcgcggagatgaacggacgcttgtcgccaagcaccaacgcctgagagacgaattcgcaacgcttgatgacatcctcgatcgggccaggggagacgttcttgccgccggcggtgatgatgagatccttcttgcgtccgatgatgtacaggaagccatcgtcgtcaatgcggcccaagtcgccggtcttgtaccagccatcctcggtaaaggaatcctcggtggcctcgccgttcttatggtacttcgggaacaccgaagcgcccttgacctgaatctccccatcctcggcgatacgcagctcgaaaccagggaacgcgatgccgacggaaccctgatgatacggcacgccaagcacgttgaacgcgcacggcgcggtggtttcggtcaatccgtagccttcgtagaccggcacgccggcaccacggaagaacgccaacaactccggatcaagcggcgcaccgcccgcgacgatccacttggcgcgtccgccgagcacctcacgcagcgaggcatagaccaccggatcgaacgccgcgcgacgtgccttggtaagcgttccggtcttccccttggtgctgacttccttcatataattctgcgcggcgaccacggctgcggcgaaagcaacgcccttggcgccatgaccggccttctgggaagcagcgttgtacaccttctccagcacacgcggaacaacgatcatgatggtcggcttggccacctgcaaatcggcggtcaacgtcttgatgccctgcgcgatataaatatgcagattgcttgctacgcagatgtagttgatggcacgggcgaaggaatgcgcctgaggcaggaacagcaggacggtgttcttcttgtcatgcagcagttccggcatataatcgggcagattgaacgcggtggcgcaataatgctcatgcgtcatctccacgcccttcggcgcggcggtcgaaccggacgtgtacacaatggagcacagatcggtcttctgcacggaatcgattcgcgcatcgagcgcctcatcgctcacaccggagccatacgccttgatctcgtcaagaccaccggtctcgaagcagacgatgtgctccaaagtcgggcattcggtttcggccccgtccgccttcgccttcatatcagtggtttccacgaccagcagacgcgcatcggaattgttgacgatattgcggatctgctcggcggaatcggtatcgtaaatcgtggcgagcacgccgccgcaggccatgacggccgcgtcgaacacatcccaatcgtaggaggtgcggcacatgaaagccacgccatcgcccttcttcaaaccataatgcagcaagcccttcgcgacggcgcggatgtcggcgagcgtctcatttgcggtcttggtgtgccaatcgccatcttgcttgaacgtgtacaatggttcgtcgcccatacgagcggcgcggtcggcgtagatatcgtagatggaggtgccttcgtctagcggcggattgccctctgtcttcgtggtcaacagtccggtttcggggtcaaggaacgtggtggacgggtatcccggtccccattcagcggtgtgcggcagctcgatatggccatcgggggagaggatgctgttcgggtcgttgtaatccggtgtattgccggaatcgtcgctgaccgggtgcacgaaatcgttgcccaggcgcaacgcctttcttgcgagattagtggcctgcttgttcaacgaggtgatgatggacacgtgactctcctacgtatataaacggtatctaaagaaggaatgatagcccgtcgcgcgcgacacgtcaccttacggtagcgtaaggtgacaggccatcagggaaacgggcggcgcatgccggatacagcccgtgattcgaaagatgaacgattgcggccgcgatgttgccgtgtacgttacacttgggcgctgtatctgttcattagatttctttaacgaggaagaaagggcacctatggctgaaaaagctgaagccaccgtggtcttcggagttctcaatgagacttccgaacacgagtcccgtgttgctctgacaccggatatcgtaacgaggttgcgtaaatcaggtgttacatgtctgattgagtccggtgcgggcgtcgcatcgcactacgttgatgaagattatacgaaggcgggcgcgcaggtcgtctccgccgacgatgtgatagcacgcgccgacgcgctgggttttgtggaccgtccaagcaatgagctgctcgcccgcgtcaagcagggcacatggatcattggcatgttgggatcgttcaccgatgccgattacgtcgccgcgatcgagaaggccggtctggtcggcgtcgccatggaaaagctgccgcgtcagctgagctccgcgcagtccatggacgaaatgacgtcgcagaactccgtgatgggctacaaggccgccatcgtggcagccaacgcgtacggttccttcctgccgatgatgaccaccgccgctggcaccatccgcccggccaaggtgcttattctgggcgccggtatcgccggcctgcaggccatcggcaccgccaagcgtctcggcgccgtcgtcaccgcgtacgacgtgcgtccggcatccaagggcgaagtcgaatccttgggcgccaagttcctcgaccttggtcttgacttctccaagggccagggcgaaggcggctacgcacgcgcgctgagcgccgaagagcaggcccagcagcaggccgcggtcgatcagaaggccgccggcttcgacatcgtcatcaccaccgccaaagtgccgggacgcaagcctccggtccttctgaccaaggccggtgtggccggtctgcatcgtggcgccgtcatcgtcgattgcgcggcaagcgaccttggcggcaatgtcgaaggctcctccgtcggcacccaggtcaccgacaacggcgtgaccatcatcggcgccccgtatctggccagcggcgtgtccaccaccgcatccaacctgctgagccgcaacgtggccgacgtgctggcgcatttcgtgcgtgacggcaagctcgccatcgacctgaacgaagagctcgacaacgccatggtcgtggccggccgcggcgaggaagccaagaaggaagaggagtaaagcaatggatatcgtcgttgcgatcacactgttcgtcctcgcgctgctcatcggcgtcgaggtcatcggcaaggtgcccgccaccctgcacaccccgctgatgtcgggcgccaactccatccacggcatcgtcatcgcgggcgtcgtcatcgtcgccgcgcacgccaccagtccgctcgcctgggtgttcatcttcctggccgccgtgctgggcacgatgaacgtcgtcggcggctacgtcgtcaccgaccgcatgctggagatgttcaagtccgacaagggcaagaagaaggaagaggaggccaagtaaatgggtaccctggccgaaatgctgagcacgccgctcggcgtcatcgaatggttcgtctacctgctggccgcagtgatgttcgtcatcggcctgcacctgatgaactccccgaagaccgcccgcaagggcaacatggtctccgccatcggcatggtgttcgccgtggccatggccttcatcgtgctgttcgccggtgagatctccaacggtttcaaacactccgtcgccgtcgtggtgctgatcgtcggcatcgtcatcggcgccgtggcgggcgtggtctccgccaagaaggtcaagatgaccgacatgccgcagcttgtctccgtgttcaacaccgtaggcggtggcgcggctgcgcttgttgctctgaacgacattctgacctccgccgaaactccgtccattgtggtgctcatcactgctggactgggcattatgatcggctccgtcaccttctccggctcgctgatcgcagccggcaagctgcagggcatcaagtgggtcaagaagctgagcctgccgggcaagggcttctggaacatcctgttcgtcgtgctcaccatcgtgtccttcgtgatgctgtgcgtgcagccgaaccagcgtctgctctggtcgatcctgaccaccgtgttcgccctgtgctacggcctcgtgttcgtcatcccgatcggcggcgctgatatgccggtcgtcatctccgtgttgaacgcctgcaccggcaccgcagtggccatgtccggtctggccatcaacaacatcgccctgatcgtggccggcgcgctcgtcggtgcggcgggcgtgaccctgtccatcgccatgtccaaggccatgaaccgtccgctgctgtccgtccttgccggcggctttggcggatccaacgccgctgccggcgctggtgaaggtcctgaaggcaccatgaaggaaacctccgccgacgatctggccgtccagctcgtctacgcagagaaggtcatcttcgtgccgggcttcggtctggcccaggcccaggcccagcgtgagctcgctgaccttggcaccctgctcaaggaccacggcgtcgaagtctcctacgccatccatccggtggcaggccgtatgcctggccatatgaacgtgctgctcgccgaggccaacgtcccgtatgaggagctcgtcgacctggatgacatcaatccgcagttcccgcaggccaacgtggctctggtggtcggcgccaacgacgtgaccaatccggccgcccgcaagccgggcaccccggtttccggcatgccgattctcgacgtcgacaaggcgcagaacgtggtggtcatgaagcgtggccgtggcaccggttatgccggcatccagaacgagctgtacttcgaagacaacacgcagatgctgtttggtgacgccaaggcgagtctgcaggccgtcatcgcagcggtcaaggaactcatcaactgacggaccggctcgtcgcctacgcgaagatcaggcccttcctctttttggaggaagggccttttgttattgcgcaagttgtccacagacaggtatgggggtgtggataggtggaaattgtccacttattcacttttttcaaaggattgtgacggagaggtggacggatatgcgacagtaggtgcatctctacgacgaaggagttgcatatgacagttgccgtggccacgccattcaatatggacgaacaggctttcctgcaaacgatggatcggctgatcgagcgcttcgaccggtacagctcggggcgttgtttcgcggaccttgatcggatacgtctcgaacacgatatggaaggtccgctttccctgttcgatgacgtggtgcacgagcttgcggatgacttgttcggcggcacgtcatggccggtgaacctcgacatggatatgatcatattggatcggttccaaataggctatgatgccgaattcctgaccggatgccgcaatgtggttcgtaaatacggcatgagcgcatggctgtatgaaatgattaatgatgcttccgtcgcggtggcgacgcatcggccgagcaacaggatgccgttccagcttggtctgttcgatacacgtgaggtgttccgaaggaaaaagaccaaggggaagaagagcggaggcggaaggaggaaacggctcgaatgcatgatggaatacctgcgacagacctaccgtctggccgcatacactctgttgcgatggggagggggcgagcctagggccgctgatgcggcgctgatggttctcgcttatgggggattgggtatgtgtatgctccgcgatgatccgaaagtggtcgaattgggatgtgatcccgatttccgatacaggcatgtatgcgcccagttgcaggatatgcggatcaaggcggatctggaatatgcctgttctgtggatctgagcgtcaccagctcattggaatatccggcttgcctcgatgccagatatctgtatgacgccgaacacattgtggaggcatatcggaatctgtgggatgagaacactaagcccgtcgcccaactactggccgagatcgaggacaatggcgtatatgaagtggaggatatatggaaagacccgctctatctgcatgaccttgccatctcccttatggggccgtcggcttcgggtcttctccaggaaggcttcagactgcgtgatcgaaccatgttcgagaatggtgtcaaagaacttgacagccaggcacgcaatgtgaggaaggctggtctgctgcttacccttgccggatatatctttttcgccgaaccggaggatcgcatggatgcgatgctcgcttcgcacaaggatcgcaaacgcatgttggacaactatgaaaagcttggcgaaatggccgcgaccatcgccttgtaccgtcttcctcgggatcgcgaatcgcttcgggcagtgcgggccctgctcatgcatgagacgggcgtgtacgcggacaagatgggagagctcatgggtctcgccgacgagccggacggggaagacgaagccaccgctccggtcatggggtgaaagacggttttccgcatattggacatgacaatgctttgggattgactctacaaccattgtaaggtttagccttcctgctggaagacataggccgaaacgggaggataagagacaacccatgggaaagaacctgacaacgggaagcgtgttcagaacgatcgtcaccttcgcgttgccatatctgctgtcgtatttcctgcagacgctgtacggcatggccgatctgttcatcgccggacagttcatcggcatcgacggcatcaccgcggtggcgaacggcagccaggtgctgtacatgctcaccgtggtcatcgtgggtcttgccatgggcgcgaccgtcaccatcggccgtgcggtcggcgcgaacaggctcgaccgtgcggccaaggccatcggcaacgtcatcacgctgttcgcaggaatcgcgttggcgctgacggtcgttctgctgttgaacgtgcacaacatcatctcgctgatcggcgtgccagtcgaagccgtcgagggaaccgcgcagtatctgaccatctgctatatcggcatcccgttcatcgtcgcgtacaacattatcagctcggtgttccgtgggatgggcgattcgaaaagccccatgtatttcattgcggttgcatgcttctgcaacatcgtgttcgactacctgtttatgggctggctgcgtcttggtccctcgggcgcggcattgggcaccacactggcgcaggccatcagtgtgaccgtgacattggtggcgattcgccgccggcgtacgggcatcagactgaagttcggcgatcttcgccccgatagggccatgctccgcggcattctcggcatcggagtgccgacggcggttcaggacggctgcatccagatcgccttcatcatcatcacggtcatcgccaactaccgtggcctgaacgatgcggcagctgtcggcgtcgtcgaaaaggtgatcagcgcgttgttcctggtaccgtcgtccatgctggccacggtatccgccgtctcggcgcagaacatcggtgccggcaggatggagcgagcgacgaagacactgcgatacgccaccgcgatcaccgtcgtctacggcatcgtcatatcgattgtggtggaactgacggcgggctccatcgtcggcctgttcaccaccgatgcgacggtaatcctgctgggaacacagtacatccgcagctacatcgtcgacagcatcttcgcgggcatccacttctgcttcagcggcttcttcgccgcatgcgggcgctcctatatcggattcatccacaatatcgtggccatcaccctggtccgtgtgcccggggcgtatctggcatccaagctgttcccgaacaccttgttccccatgggcgtcgccgcacccgccggatcgctgctttccgtgctgatctgtcttggcttctacgcgtggctcaagcgtcacggcgtaatttcggagaaggcgcgtgcatgacggcgagtgagcgaagtggagggcgcgacgctttgccgggtgacggcagactgttccgtataggcaaggttgcagatatgttcaatgtgtcgctgggcacgcttcggcattatgagcgttgcggcttgctggaacccgaatatatcgacccgcgcaccgggtaccggtattacggtgccaagcagttcgaggtgctgaacaccatccggtacctgcgtgtgctggatatgccgttgacgcagatagccgagttcctgcacaatcgcgacgtgcatgtcatcgaggacaagcttgttgcacagaaagccctgatcgagcgcaaacagcatgagctggaaatggtccagcggaagatcgaccatcgcttggagcggctgcgggacgctgagcagtccgaattcgacgtgatacgtgttgtgcggcaacccgcctgcaggatcgtctggatcagggattcaccgaaggtcgactcgtatctcggcctggaatattcgatccgcaagctggagcagcatcagaaggattcgctggtcttcctcggcaaggtcggcgtcggcattgacaaggaatcgttggaacagggcggatatgccgattacgggttggtgttcctattgcttgacgacgaggacgaatatgagggcgacaccgtggcattgccggagaccgattgcgtgcgcatccggttccgggggagtcatggcgatgcccccgaccggtatcgcgagctgatatggtacaccgcagagcagggtctcgacatcaccgggttctcacgtgagatcgcgttgatcgatgaagggttgacatcggatcccgcccagttcgtgaccgagatctgcatcccggtgcgctagccactttccggcgacgtgtggcgctacttggctttctccttcagggtcggcgcaagggtgccggccagcgcgcgctcgcccggcctggccaatgggccgaccagttcatgcgccgtgtacggctcctcaagataggcgatgtcggattcgctgagttttactccaagtgcttcgatgacatcatccacgcgctccgtcttcgagcagccgacgatcggtgccgtgacgtccttggcccaatgccaggcgagggcgatccgcgccatcggcacgccgagccgttccgcgagcccgtgcacgcgttcgatgatcggcatatcctgcgcacgtgcctgatcgtacttgttgcgcatggtgccgtcggtggtgccgcgtttggaatcggaatcccaggacggatgggtcagatggccggacgccatggggagtatggggtgagcgccatgttgtactgacggctgttcggtggcgtcggcatcgatggtccactgatggaactacggggaggtcttgccgaaactcataccgccaaggcagaccttggaaacttggatgccggaccatcccagtggggcgtagctcatgtcagtcatactgaagctcttctgccgttgatgttcggaaggtcagcatatcccgtttcgattggcagaaccaatacctcgcatgaatggtttgatatgcaatcgacgcatggaacgatataccatactcacattggacattctttttcgccgggcgttgaatagggaacggtacagagcataaatgaaaggacgggtcgacaatggaaaatccgagcgcattcccgatgggagaaccgaacgacggcttcgcgcagtacttcgtgggacagagctaccttgctccggtgctcgagactccgcagattgccatccataacgtgaccttcgagccgggttgccgcaacaactggcacatccatcacaacgcggcgcaggtactcatcgcggtcggcggtcgcggttactaccagatcgagggacaggagccaaaggagctcaaggccgggcaggccgtctgcatccccgcggatacgaagcactggcatggcgccgcccccggcgaatcatgctcgcatctagccttcatggtccctgcgggcgatccggcatccatgagcaacgaatggctcgagccggtggatgccgaagcctacggcaaacttgcctgaggtctgttgttcttatatggagggccatcctgcaaaagtgggatggccctttttgttgttcagggcgataacggtttgaagccttgcggcgagtggcgtcatgcgaggaaatccgcaagcagattgtacaagtagcttgtgtaagtgctatggcggccagctggaggcaatcgaaatggatacgaaagacgaatattcgacatcggatgtcgccatggaattggcgattgcggtcagcaggctgcaagctcggatgaagcatgaggccggcatcgcggaacggggcatcaccgcttcgcagcttgccatgttgaagcggctggataccgagggagaactgtcggtatcgactttggccgcgtacgaacacgtatcgcaacaggccatcacccagcgtcttgaactactgaggtccacagggtatgtcacacagcatgccgattcgaaagatcgtcgtcgtcgactggtcggcttgaccgatgaaggacatgcgttcctcgcccacgtaaccgctagccaaacaacttggctggcgcatgccatcgaatatgcattggatgacggcgagcgcggggacctcgccgctgcgaccacattgatcgaacgcatcgccgccacggaatcgctgccgacgggaggcgacacgcgatgaagacggctgataagacaagagaaactcccgcgtttcccaagaccttcatcatggcgatgatatttggggtcggtctcaaccctgtcaacagcacgcttatctcgacggcgctcgcaccgatttcacatgatttgcggattgatgccggaagggcgaccctgctgatatctgcgctgtacctgacatgtgccatcgcgcagccgacggcgggcaagctttctgagatcattggtcctcgctcggtgttcatggccggtgcggcattggtcatgattggaggactactgggtggtttcgctccgaatctcggcgtgctgctgacgtcgcgtgtgcttattggtgcgggcacatcctgtggctatcctgctgccatgctgctggttcgcagacgggccgatcgcatgggattggcggaaccgccttcgttggtcctttccattctcgctatggtgggactggtgctcatcgctgtcggtccaccgttgggcggcctgttggtcacctttttgggatggcgctccaccttcttcgtcaacgtgttggtcggcatcatcacgattgtgctgggattggcaagcatcgagcccgatgcgaagcatgaacatcgcatgaccgtatccttcttcatcgcgcatctcgatgtcatgggtctgttgctattctccatcacaatcagcgcgctgctgattgttcttatgagtttgcctactttcgacaaggtgtccggttgcgtcactgtcatcgctttgttggcttttgtcgcgtgggagttgcatgcggcaacgcctttcgtcgatgtgcgttcactcgcggcggatagtgtgatgacgttgaattttctgcgtgcgatgctcaccatgcttggcgcttatgtggtcatgtacgccttgccccagtggctggaggatgcctgccatatgaacgccggtgtttccggcatgttcatcattccgatgggggtggtggcgacagtggcttcgttatccatcgcgaagaagccgatagtgcgcctgccgttgatggtgtgctgttcggcgatggtgacggtgggcatgttgttgacttgcacgtcatccgctggcatggtcgtattgccgttgaccgcctccgctgtcgcgggactggtgttgggactcagcatgtcgaccagtcagaccgtgctatatcgccgagcggcatccgagcatattggcacgtcgtctggtctgctgcgcacgtccatctatatcgggtctatcggtgcgtcctcattgagtggcgtgttcttcggtgagacggtcactgatggagggctccacggcattggcatcacagttgcggttttgggggtcgccgcgctattggcaacggttatggatcgtacgttgcggtagtccggggaagttgtccgcatcgtgaatgatggtacggatggcctcgcgtgccggatatactggactgcggtgatgggactcgcctgaagccgttacaggcttcgaaccgcaaacccgctgatggttcctacgacatagggtgtgctgtaccttatggctttcagcggttgtggcatcgccattcttccatgtctgtcatattggttcggcacctcgctggaaagaagatacatggcacgacaacatatcattcgagtcgatctcatatgcgtggtgttccttgggggatgcatcggaaccgcattacgctacgcttgttcggtcattcccgactgcggcgcattccatatcggcacattcgcggcgaatatggccgcctgcttcgtatacgcggcgctttcggcatggctgggaggaacccgcagaatcgtgggacgcgcgaaggaatatgtgaaccgtggatgtggcatgggcatgtgtggaggattgtccaccatgtccactctcgccctcgaggaattcactatgctgcatgacggcaaagccatggattgtgcggcgtattgttgcacgaccttcatcgtgggctgtctgctggcatacgttggcgcgcatgtcgggctgcggtttgccggtactgagcataacgatggtgatcgccatgccatgggcaaggaggcggactgatgaataatgcggtcatcgccgtatcggtgtgcctgtgtggtggtctcggcgccgccgcaaggtatgtttgtgattccgttatcaaagcttcttggcataaggcatttcctttgtcgacctttgtgatcaacagtattgccggattcctggcaggcgtgattgcaggtctgtactcacgccggtttctgtcggatcccgcgcatgtgatgttggcgaccggcttccttggtggattctccacattctccaccatgatgaacgaatccgtgacgttgttgcgcggtgggcggatcaccgtgttcgtgggatatgtgctgacgtcggtggtggttcctgtgatggccgcggcattgggatattgccttgtcgtctgagactggagcgaggacgttgactcggggcgtcgtttcattgtctctgggtatggatggtttatggattaccgcgacgcggattggatagttttccatgaaaacgaggaaaaactattgtcttttccgtgtttcctcgatacattggtggctggccgcccatgacaatcgaaaggactgaccatgacgcagcagggcatgtcgaccaagtcgaggcatctgaccattcccgatctcatcacgataggtgtgttcactgccttgtatttcgtgctggtcgccgtggccacgctgttcagttccgtggctttgatgggattcggcatgattcttctgcctgcggtcgccgcattgatctgtggttgcgtatatatgctcctggttgccaaggtcggaaaattcggcgcgattagcgtgatgggcatcgtcgtcggattgttcttgttcgtatccggacatttcatcctttcccttgctgcgagcatcgtgtttccggtcatcgctgatgccatcgctcgcgccggggactatcggagcaagacaggtatcctggcgagttatgtcgtgttctgctatgggctgaccggtccgattctgccgttgtggttcatgaaggatgcctatgtggccagtctgcaggcccgtggcaaggactcgtcctatatcgatggtgtgttcgcacatgtcaataccggcacgtttttcattgccatgatagcggtactggtatgtgcgttgctcggaggctggtttgggcagcgtatgctgaagaagcattttgcgaagaccggcatcatctgatggccctggacccaagaaccaaactgtacctagtggcattggccaacctgttgctgttcttccatgtcgacgtggttgtggagtcgcttacagtattgctgcttcttctgccactgctcggcgcgggacgatgggcggctgcggtacgcttcggttgcatctatgtattgctactggtggggacttgggcatcgacgcttgacgatggcggcagctggttgcatatgcttggtttgctttgtgtcggcatccggatgatgatgccttgtctgattgccggcatatacgcattcaccacgactacggccagtcaattcgtgtgtgccctgcggcgcatgcgcattccggagacgattgtgattccatgtgtggtgtgcatccggttcttcccgacaatccatgacgattaccatcagattcgtgacgcgatggcattacgtggcatcgcccaggggacattcgccctgctccgtcatccggctcagtctttggaatacatcctgatgccgttgttgatgaacgctacgggggtcgcccaggatttgtccgtagccgcactgaccaaaggaatcggcattcgcgggcctcatacatgtcataccgaaatccgcatgcatggcattgattgggcatggatggtcatctgcacggttcctctggcattgggcattggaggagcatggtgagtatcggaagtgatatcaatcggatagtcgcatggacgcaacggtgctcattcgcatatcatgctgatgaagctgctgaggtcgatgcgctgaatgacatcagctgtgccataccgcaaggcgagattgccatcttatgtggacaaagcggctgtggcaaaaccacgtacacacgtttgctcaatggtctgatacctggtttctattccggcgatttgcagggcatccatatgacgtgcggaatccgcgccggattggctcctgtggaaagctatgtgggacaggtgggcagcgtattccagaatccgaagacgcagtatttcaatgccgattccaccgatgagctggcattcccctgcgagaatacgggcatgtctcccgcgcggattcggcaacgcgtgcatgatgtcgcggagcagtttcacatcaggcatctattaggtcgtaggatcatgacgctttcaggtggccagaagcaacagcttgctgtcgcggcatcgaccatgctggctcctggactcatcgttatggatgagccgacaagtaatttagatatggtggcgattcgcaggctgcatgacatggtctcccgattgagagctgatggaatgaccatcgtcattgccgaacaccgtcttgcatggtgcgcggatttagcggaccgtttcatagtgttcgatcacggtacgattctcggtgaatatgaggcgtccgattttctggcgatgtccgaacagcgcgtcgcggcattaggattgcgcgccctcgatgacagaccatacaggcttgccgtgcatcgtaaactccaacatggaggcattgcgcccgacgaggacaagcgacaggtcgtcattggtgtgcgcggcctgagtgtaggccatacaaagcggggacttctaggccgcaagacacccgtattcgcacgtgatattcccgatttcgacattcacgagggtgagattcttggccttatggggtcgaacggggttggcaaaagcactttggcacgtacgctatgcggtcttgccgctccgttgaacggcatggtgctattgaatgggacgaaagcgagccgcggcgctttgactcgtgccggatttctcgtcatgcaggacgtcaattaccagctcttctccgatagtgttcgggaagaggcattactgggacttgatgggatggatgacgctgtgcgtgaccgatgcgatgctgtgctacgagacctcgacctattggattccgtgcagcgccacccgatgagtttatccggcggtcaaaagcagaggctggctatagcctgcgctttgatgagcgataagcgattcattgttttggacgaaccgaccagcggactggaccggttgcatatgacccaagtcggcggacttctgcgaaagctcgcggaccgtggcaaagcggtgttggtcgtaacacatgattatgagcttgcagcgctatggtgcgaccgcatcatagcgctggaagacgaactgcataacgaacagggagaagaagaggatcgtctggcatggacttcaatgtgaacgattggctgggagactggattagcttcgaacatttgatcaacaatcatgacccgaaccttgaccgggcttggaaggattcgacgaaagccatgcgatccaagccgctgttcgcgatcatgatgctcggcgatgcgcgacgcttctgggcaaaagcctgcaaaacctcgggcaaggagtggcgattccgcattggtggatggcatatcgagcagccgtccgcagttggcgacgatgatgctgtcgcaggctttaacctgacttggctggacgaaaaacgcacccccatcacaacacatgaatatcggctcgatcatgtgcacgacaaggggctggaaggcaaaccctgctatgtgttccacgctagcgatgccggtgcctccgatcccttcgccgtactcatcgcgatggagcccatgcctgaacgctccgcgctcagacacgggggactgctcagtcatctgcattttcaatatgcctctgatgaaggcgaactcatcaaaggtactggcaaacaagccacgctccgccatcgcatgtggtatcccaccatgtgcgccgctgaagggacgttacttgatcaatgcaacatcgtacgtgcgctgcatcatcttcaagcatggcgggaactgcctgtcccatcatcagactgactgcagatgcccgaagatgggacaatatcagcattgcgacgattgtaggtatcgtccagtgacgctttccggacatgcggcgatccgagaaggcgctccctcgcatactacgcgtccgcctgcttcaccgccgcccggtcccatatccaccacatagtccgcattggcaatcacgtccaaatcatgttcgatgacgaccaccgtcgcgccattcgctacaagttcatcaaatacgtgcagcagcacgcgaacatcaagcggatgcaagccgattgtcggctcatcgaacacgaataccgcatcatgctgtttccgccccatctcgctggccaatttcaaacgctgggcctcaccgcccgacagcgcgggagttggctcgcccaacgcaagatagcccaaacccaattcatgcaacgtggcaagcttcgtttggatcggtttgacatctcgtaagacaggcatggcatcgtcgacggtcattgtcattaactgcggcatcgaatacgccactccgtcggtgcaggggagcttcagctcggcgattgcatcggaataccgcgagccatggcatgccgggcattcgatatcgacgtcaggcaggaactgcacgtcgagcgaaatcgatcccgtgccgtcgcacgtcgcgcaacgcagcttgccagtgttataggagaatgcccccgctttcagaccgatggtccgcgcagcatctgtttttgcgaacgcgcgtcgaagatcgtcatggacgccgcaatatgtagcgacggtggaacgtatgttcgcgccgataggcgtggcatcgataagatgcgccttggacacaccgtccgcctcgaggagccgcacctgcgtcggctgcggcgacctgtcgatccgcgactgcaaagcgggcatcaacatctccagtaccatcgtcgtcttgccggaaccggatacccctgttacggcggtcagccgtccacggggaatatctaccgataacgggccgacggtatgcagacggtcggtttccatatgaattcgtcctgcggagaagatttcatgggcgtcaatgttgtcacgcacacggtcatgaacgttgccaccctgggcaaggaacggcgcgatgcgcgattcgcgggtatcaatcacctgcggcaccgttccctgcgcaatcacctgaccgccctttgcgccggcacctggccccatctcgatgagataatcggtttcggccagcacccgagtgtcatgatcgaccactaccacggaattgccatcagccaccaggtcacgcatgacaccgagcagtccgtcgacattcgcgggatgcaacccaatcgacggctcatccagcacatataacacgcctgtggtgcgattgcgcacggcgcgggcaagctgcacgcgttggcgctcgccggtggacagtgtggctccggcgcggtccaaggacagatacccgagaccgagttccaataaacgccgtgacgtattgaggaacgattcacagatggcgctcgccatggtgcgcatatgtggttccagcgattccggcacggaccctacccaggaaacgagtgcgtccagagacatcgcggttgcctgagccagattgatgtctctgatacgtggctggcgggcgcgttcggaaagtctggtccctccgcaatcgctgcagggacgctctttgaggaacctcgcaacacgtttaagccctttttcgtccttggctttggtgagggcgttctccacggtgtatacggcgttgtagtacgtgaagtcgagttcggcgaaatcgtcgccttttttcggcttgtataggatgtgcttcttgatggctgggccggcgaacacgatatctcgttcttgttcggtgagttggttgaacggtacgttggtacgtactcccatggccccgcatacttgcttcatcaaatcccacatcaacgatccccacggcagcacggctccctcgtcaatgcttttcgactcatccggtaccaaggcggaacggtcgacttccctcatgattccggtgcctgagcatgtcggacacgcgcccgcggcgttgaatgcgagatcctccgctgatggcggatgcatgagtccgccgcagaacgtgcaatgcatcggaagctcggcggcaacgttcatcgtgggttggttgcgtgctccgcagtgttcgcacacgtgcgatccgatccgggagaacaggaggcgcagactgttgagcagttcgctcattgtgccgaacgtggaacggactccaggcactgatggacgctgatgcagtgccaatgccgccggaatatgacgcacctcgtcgacggttgcgcggcttgcctgggtcatacgtcttcttgtataggtcgatagcgcttccagatagcgtcgtgatccctccgcgtacagcacgccaagcgcgagggagctttttcctgagcctgagattccggctatgccgaccatgctgttgagcgggatgtcgatgtcgacgtctttcagattatgtacgtgggctccgcgcacttcgatacatgaggggagtggccgagacacttgtgtttcgtatgcaaagatagaaggagacggtttcataccggcaattctatgcttgccatatggttatcacatatacggatgaaaagaaattcaccaaggaacagacccagcgactgtttctttcagtcggctgggtgtccggtcaatatcctgaacggttgcataaggcgttgatggggtcatccaccgtattcagcgcatgggatggcgaacgtctggtgggtctggtgcgagtgcttgatgacacggagatggtggcatacatgcactatgtgctggtcgatcctgaataccaagggcgcggcattgccggacatcttgtcggcatggtcaagcagcggtaccacgattacctgtatatcgaggttatgcctgaggaaagcaagaatgccacgttctatgagaagcatggattccatattatggaggatggcgtcgccatgcagatatgcaatccgggagaacggcactgacggaacgggcatcgggcatgtcttgagaacttcgggcggtgaggggcgccatctttcgccggaggcgtttccattaccgcttatattttttggggttcggctgtcagatcttgaatgaacgacggatgaatccgtatacggtgtcccagtagcgtttcggatccacggcggagctttccatatgatcggcgtccggaaccagcagacgttcgcggtcgatgctggagcaggcgttgtagttcatgtcgaggaaacgtgggctgaccatgcggtcctttcctccatggatgaacagcatcggaatgaccgtatgccgcaatgacggtatgcaggacgcttcggtgaaatcatagccggcacggcgcttgcagatcagacccgccgcgtccacacatgccgaggcgagaagctttggcatgtggaacatgcctcgcgcgctgtctatgaattccatgcgggcggaagtgtatccgctttcggcgattgccgcgatgacattgcgtggcagttccggcgtgccggtcgtcatcatcaccgtcgtggctcccatggatcctccgaataggagaatgcgtgcttgatcgtcgctatccacaatcagccgtatccaatcaagcagatcattgcgctccaaccatcccatgcctacatatcgtccttcgctcagatcctgggcccgttgggatggtgtgaggacggtgaagcccatgcgggcatagcggtgtgcccatttggcttgttcttcaggggctccggtatagccatgcacgcagatggcatatatatgcggcgtcgggtcgatgcaatccggatcgaagagccagccatgcagcttaagcccatcgcggctggtgatggataccggctgtttcgtttcggaaaaccattgcccggcctctttggcctcgccttggttcatctttccctcgcgatccggagcgatcagcgcctgatggaaaatggaatgcttccactgcgtgtcgatggcaaagcggaacagcatatgtgctgacgccgcgagcaatcccgtcgctgcgacggtcgtgacgccagtcgcgagctgaatgttgcggatgagcgcggaatggtcatgcgtcgttgccattttctgattccttaccactggttggtgcttgtctgactacgattgtacgtgggtttgcgcatagtccgcgttttatgcaccttgctcctctgattgcagggaaatgtcagcggcaccatgtatactagataactgttgtcttggcgagggaggttccgcctccgttatcgacttggcgtatgatatgaaactccttgggttttctatgcggctcgtcggtgcgccgaaacataagaacgatgtatcaaggagatattgattatggctaccaccatcactcttgaaggtgctgctcgtaccgagttcggcaagggcgctgcccgccgcatgcgcgtcgcgaacctcatcccggccaccgtttacgcgggtggcgaggatccgaccttcgtgcagctgccgatgaaggagaccactctggctctgcgtcacaccaacgccctgttcaccatcaagtatggtgacgagaccaagatggccgttgtcaaggacgtccagcgcaacccggtgaagcgcatcgtcgagcatgtcgatttctacgaggtcaaggccggcgagaagatcgacgtcgaggtgccggtgttcgttgagggtactccgaagggcgctgccgtcgcgttcgtcgacatccaggagctcaaggtccgcgccgatgtggccaacctgccggagaagatcgtggtcaacgttgatggcctgaccgatggttccaaggtcttcgccaaggacgttgtgctgccggaaggcgtcgtactcgatgtcgaggatccggaagaatccgtcgtcaccgtcgaggtgccggaagatgccgcaccggttgaggccgctccggctgctgacgccgctgccgctccggctgctgacgctgagtgagatcgttgctcaagctgatttgattccgatatgcctgccatatcggtagtacaaggtccctgtgtgtgaaaacacgtggggacctttgcgtttccttatgtttcttgctatctcatatcgcgaacgccggttatcgaaagcgtttatggtgtgagaaagtacataccagaacccggcgccacaagcgccggagaccaataaccgctggccgcctttgggtggctgatgcaactagaagaagtaaagaatgactgaacagaatcatcacgatccggcggagcttgacaagctcgctgagaagttcaccgtgctcccgaacgacaatccggcatccgacgccaagcgcgccgaactcatcgacaagccggccttcggtcaggtcttctccgacaatatggcccacatgacctggaccaagggtgaaggctggtccgaccgtcgcatcgagccgtacgcgccgctgaagatggatccgggcgcatctgttctgcattacgcccaggaatgcttcgaaggtctgaaggcctaccgtcacgccgacggctccacctggctgttccgcccggacgcgaacgccgagcgtttccagaactccgccaagcgcctgtacctgccggaactgccgatcgacgacttcatcggctctgtcgcggcactggtcaagcgtgatgtgaactgggttccgtcccgtcgcgaatacacgctgtacatgcgtccgttcatgttcgcttccgagccgttccttggtgtgcgcgctccgcaggaagtggattattgcgtgatcgcctccccgtccggcccgtacttcccgggcggcgtgaagccggtcagcatctgggtcgaggacaagtggttccgcaccggccctggcggcactggcttcgccaagtgcggcggcaactacgcagcctctctgctcggtgaatacaccggcatcgaccatggctgccagcaggtgtgcttcgtcgacgccgccaccaagacctacctggaggagcttggcggcatgaacatgatggtcgtgcacaaggacggccacgtggaaaccccgtccctgaccggcaacatcctgccgggcgtgacccgccgctccctgatccagctcatccaggacaacggccacgatgtggtcgagaccatgatcgccctggatcagctgcttgaggacatcaagtccggcgaagtcaccgaggtgttcgcctgcggtaccgccgccatcatcaccccgatcggtcgcttcaagtccgagaagttcgatgtgaccgtcgccgacggcggttccggcgagttcaccctcgcactgcgcaaccagctgctcggcatccagcttggcgagatcgaagacccacacaactggatgtggaaggtctgctgattttcccgttagcgattattagctgacatatagctgtaatggccgccggagggtggcgcgtgcttcaggccaagttcacatggtctgacaatgtacgtgccgccctccggctcttttattgcagctcttgccccatattgtgctatttttaacagctggttggaaaagaaatatgtgagggaaggggagtggccatggaagtggcgctggaaagcaacggcttcttcataggtatcgaatatctggcgaccttctgctgcggcatggtcggcgggctcgccgccgtacgcaaaggctatgatatttttgcgattcttgtcaccacatggctcaccgcattgggtggcggcatcattcgtgatgtgctgctcggagcgcttcctcccgcaggcgtctccgacaaagggctggtgatcaccgcactgctcgcagctgtggccgtagccatcatttatcccgaagtcgacaagctcaaatggtccatgctgtcattggacgcgctggcattgggcctttacgccgtcaacggcacatccaaagccatgatgtaccacatgtccggcaccacggcagtgttcctgggcatgttcacggcacttggcggcggactcatccgtgacatgctcatcaacgaggtgcccatggtgatccgcgacaagcattggtacgcggtgccttcagccgttggatgcgtattgacggtactcgtatgtaaaggagtgaacgagggaatcgtcagttttcccgccgaagtcgtgcttgatgtgctgattgtagtgctggtggtggccatgcggcttatctccgtgtttttcgacattcaattgccgggggctttggccaggcataacacctacctgccgagcgaagccaaatatctcaaacgtccggtcatccatcccgatcggaatgatgacgatatcaagcgtaagtgagcattttcaacagagcacgaaatgtaaaaaagaagaagccccgcaggttttcctgcggggcttcttacaagctgtgagttacgaaaactcagagagcgttgatggccacagcgagaccggacttgcggttggcagcctggttcttgtggatcacgccagcgccggcggccttgtcgagcttctgggctgcgaccttgtaggcggcttcggcggcggccttatcgccagcggcgatggcttcgcgggtggcgcgaacggcagtcttcaggctggacttcacggccacgttacgcttgtgcgccttctcgttggtgagaacgcgcttcttctgcgacttgatgtttgccactatttctccaaacgacgtttgctataaggacatacaaacgatgatgataacatggcacgcggataaatcgccaatgcgtataagagtgtcgcggaaggacatgccgacactaccagttagaatcgtttgcgtcgaatatttccagaggaggatggcgtggggcagcagcataatcagcccgggtacaccgatcagtcgttgatccgcaacttttgcatcatcgcgcatatcgatcacggcaaatcaacggtggcggaccgtattctgcagttgagtggcatcgtgccggagcgcgagatgcgcgatcgcttcctcgaccgcatggatatcgagcaggaacgcggcatcaccatcaaatcgcaggccgtgcgcgtgccgtggacggttgacggcaccgaatacacactcggcatgattgatacccccggccatgtggacttcacatacgaggtgtcccgagcgttggccgcatgcgagggtgcggtgctgcttgtcgacgccacgcagggcattgaagcgcagacgctgtccaacctgtatatggccatcgaccatgatctggccatcatccccgtgctcaacaaaatcgacctgcccagcgccgaacccgacaagcatgccgaggaaatcgccggcctgattggttgtgacccgtccgacgtgttgcgcgtctccggcaaaaccggagaaggcgtcgccgaactgctcgaccgtatcgtcgccgaagtgcccgcgccgacgggcaatccggacgcgcctgcccgcgcgctcattttcgactccgtatacgactcctatcgtggcatcgtcacttacattcgtatggtcgacggtgaactgaaatcgcgcgagaagctgcacatgatgggtatcggcatgacgcatgaccccatcgaaatcggcgtgatcagccccgacatgatgcccaccaaggcgcttggcgcaggagaggtcggctatgtgatcaccggagcgaaagacgtcagccagtccaaggtgggcgacaccatcacctccgccataaatccggctaccgagccgctcgaaggctaccgtgatccgcaaccaatggtctacgccggcctgttcccaatcgacaacgcgcaatatccggaactgcgcgaggcgcttgacaagctcaagctcaacgacgcggccctcatctacgaaccggaaacctccgtggcgttgggcttcggctttcgttgcggcttcctgggcttgctgcacatggagatcgtcaccgaacgtttgagccgcgaattcgaccttgacctgatctccaccgcgccgaacgtgccgtacgaggtcaccgcggaagacaattccgtgcatcgcgtcaccaatccgagcgaattccccgaaggcaagatcaagaagatcgtcgaaccgatggttgccgccgacatcatcacgccgaaggatttcatcggtgcggtgatggacctgtgccaagaccaccgtggccagatgggcaccatggaatacatttccgccgaccgtgtggaaatgcattaccgtattccactcgccgaaatcgtcttcgacttcttcgaccaactgaagagccgtaccaaggggtatgcgtcgctcgactaccacgaggatggcgaacagtccgccgatctggtgaaggtcgacatccttattcaaggcgagaaagtcgatgcgttcagcgccatcgtgcaccgtgacaaggcgtacagctatggcgtgatgatgaccaagaagctgcgtgagctcattccgcgtcagcagttcgagattcccatccaggctgccatcggttctcgaatcatcgcacgcgaaaccatccgcgccctgcgcaaggacgtgctcgccaagtgttacggcggcgacatctcccgtaagcgtaagctgctcgaaaagcagaaggccggcaagaagcgtatgaagatgctcggccatgtggaagtgccgcaggaggcgttcatcgcagccctgtccaccggcgaagcgggcaacgaccgcgacaccaaggacaagattcgcgccgcgcagaagtccgaaggctgagcctttcgtgacgttcgaaatctacattcatgttccgttttgcttacgtcgctgcggctattgcgacttcaacacctacacggccgtggacatgggcgcgggcgcgtcacgcggcaactacgcgaacatggttatccgcgaaatggcgattgtccgcgattggcagacaacgcacggtatcaacgagccgaaggtggcaaccgtcttcttcggcggcggtacgccgaccacactcaaggcaagcgatttggtcgccatgctggatgcggtacgcgccacatggggcatcgccgatgacgcggaaatcaccaccgaagcgaatcccgacacggtgaatgccgactatgtgaaagaactcgcagacggcggtttcaatcgtatttccttcggcatgcaatccgcggtaccgcatgtgcttgcaacgctcgaccgtacgcatacgccggaaaacgtcgctgccggaatcgcagcggccaatgcagcaggcatgcgttccagcgtcgatctgatctacggcgcgccgggggagagccttgacgattggcgcacatccgtccgcaccgccatcgatttgggcgtcaaccatatttccgcatatgcgctcaccatcgcgccgaatacgaaaatgggacgacggatcgcggcgggcacgttgtcgagaccggacgatgacgacgaagcgaacaaatacgaaatcgccgacacgatgttcaccgaagccggcctcgaatggtatgagattagcaattgggctcgtcctggatacgagtcgcaacacaaccttggctattggaggaacgtcgattgggccggtctcggtcccggtgcgcattcgcattatggcgattgcgaagacggcaaaggattgcgctcctgggatatcgcgcatccgcgattgtggggcaccgccatcaatgagggcaatgtgccatgggccggcagtgaacgcatcactgccgacgaggacatcgaagagaccatcatgttgggcctgcgcattcgtgaaggactcgacaccagacaattcagccacttgattcctgagcaaaaatggattgagcttgagcacgacgggctgatcacaatgcttgatggccgcgccatacccactttgcgaggccgactgctcaacgacaccatcatcacggagctgttggaaacactggactgaccgggttaatgagcataagtgaagtgcgtgcgcatgagcatgacatgcgaagtatgcgttcatgggctaaatcctctgcgaggcattgacaaaaatagccattcgttatatggacacgtgcaacgttgccgacataatggcgcggtattctaaaccacgcattaaagaaccgcaagacttttcttgcccaaaaacattgaaggtggtttcggtgactttccacgccccgttagatctgacgatccatgattcccaaggtatgtacgatcctggagccgagcatgacgcttgcggcgtgggtatggtcaccaccctcaacaagcgtccggaacgcaagatcgtcgatgacgccatcgaggtgctggtcaatctgaaccatcgtggtgccgtgggcgccgaggagaacacgggcgacggcgcaggcattctcatgagtatgcctgacgaattcatgcgtgccaccgccggtgtggagcttcctgaagaaggccattacgccgcgggcatcgccttcttggatcgcgacatcgccacttccggccagcaggagcaggccatttccaagatcgtgcgcgaagagggcctcgaagtgctcgcatggcgcgtcgtacccaccaatccggacggactcggcctgcagtcgttggccagcatgccggcgttcaagacgctggtcgtggccgatccggaaggcgaactcggtggcatcgagctcgatcgcaagaccttccgcatccgcaagcgtgtggaacatgaggtgggcatctacttcgcgtccctgtccgcacgcaccatcacctacaagggcatgctcaccaccatgcagctcaagcccttcttcctggacctgtccgacgagcgcatgaaggcgaaaatcgccatcgtgcattcccgcttctccaccaacacgttcccaagctggccgctggcacagccgttccgccagctggcgcacaacggcgagatcaacaccatccaaggcaaccgcaactggctgtccgcacgtgaaggccgactgagttccgaactgctcggtgaattcaagccgctgctgccgatcgccacctccggctattccgattccggcactttcgacgaatgcctcgaactgctgcacctcgccggccgttccatgccgcacgccatctccatgatgctgccgccggcatgggagaacaacgaccagctcgatccggacgtcaaggctttctacgaatacaacaacacgctgatcgaaccatgggatggcccggcgcacatcatcttcaccgacggcacccaggtcggcgcactgctcgaccgcaacggcttccgcccgggacgttggcaggtcaccgatgacggctacgtcgtgctcgcgtccgaaaccggtgtgctgccggaagtcgccgaggagcatatcgtcaccaagggccgtctggaaccgggcaagatgttcctcgtcgacaccgacgagggtcgcatcatccccgacgaggaaatcaagaagactcttgccagccagcacccctaccgcaagtgggtggaaggcaactccgtggaattgagtcagctgcccaagcgcgagcacgtcaaccactccggtcagtccgtgcagcgtcgtcagcgcgccttcggctacaccgaggaagatctgaagctgctgctcgccccaatggccaacaccggcaaggagccgctcggctccatgggcaacgatacgccgctcgccgcgctgtccaagcacagccgcatgctgttcgattacttcacccagaagttcgcgcaagtcaccaacccgccgctcgactgggaacgtgagaagatcgtgaccagcctcgaatccgccatcggtcccgagccgaacctgctggccgattccgaactgcacgccaagaagatcctcatcccgctgccggtgctcaactccgacgagatggcacagctcaagcgcctcgaccgcgccaagattctcggtggctattacaagccgttcatcgtcaagggcctttaccaggtggccggcggcggacaggcactgaaggaccgtcttgacgagatcttccaggagatcgacgaggcgattgagaacggtgccaacttcctggtgctgtccgaccgcgattccaactatgcgtggggtccgattccatcgttgctgctcacttccgcagtgcagcaccatctgctgcgccgccacacgcgtacgcagatctccatggtggtcgaagccggcgatgtacgcgaaatccaccatgtggcactgctgatcgcctatggcgctgccgcggtgaacccgtatctggcattcgaatccgtcgaagacctctcccgcaagggctacctcaaggtcgacgcggaaaccgccgtgaagaacctgacccgcgcgctgtccaccggcgtgctcaagatcatggccaagatgggtgtctccaccatcatgagctaccgtggcgcgcagctgttcgaagcggtcggcctcaacaaggacgtcatcgacgagtacttcaccggcaccacgtcccgtgtgggcggcgtcggcctcgacgagctcgccgaggaagtcgccagccgccatcgcgtggcgtatccgacccaatggaccgcccgcccgcaccgcaacctgcgtaccggcggcgactacaagtggcgtcgtaccggcgaggaccatctgaacgatccggaagccatcttcctgctgcagcagtccacccagcgcggcgactacaacctgttcaagaagtactcgaaccacatcaacgacacctccaaccgtctgatgacgctgcgtggcctgatgaagttcaagtccactcgcaagccgatcgacatttccgaagtcgagccggccagcgaaatcgtcaagcgtttctccaccggcgccatgagctacggctccatctcccaggaggcgcatgagacgctcgccattgccatgaacacgattggcgcacgctccaactccggtgaaggcggcgaatccgaggatcgtatcaacgatccgctgcgctacagcaagatcaagcagattgcttcggcccgcttcggtgtgaccagcgactatctggtgcatgccaccgacctgcagatcaagctcgcccagggcgcgaagcctggcgaaggtggccacctgccgggagccaaggttccgccgtggatcgccaaggtacgtcacgccaccccgggcgtggagctcatctccccaccgccgcaccacgacatctactccattgaggatctgaagcagctgatcaacgatgcgaagatggccaatccgaaggcccgcatccacgtcaagctcgtctccgaattcggcgtcggcaccatcgctgccggcgtggccaagtgccatgccgatgtggtgctgatttccggctatgacggcggcaccggcgcggctccgctcaacgccatcaagcatgccggcaccccgtgggagatcggcctgtccgaaacccagcagacgctggttctgaacggcctgcgttcccgcatcaccgtgcagtgcgacggcgagctcaagaccggtcgcgacgtggtgatcgccgcgctgcttggcgccgaggaattcggcttcgccaccgccgcgctgatcgtcgaaggctgcgtcatgatgcgcgcctgccagaagaacacctgcccgcagggtatcgccacccaggatccggagctccgagcacgcttcaagggcaagccggaacatgtcgtcaacttcttcatgttcatcgccgaggaagtccgcgaactgctcgcgcagctcggcttccgcacgctggaagaggccgtcggccatgtcgaatgcctcgaccaggacgaagccatcaagcgttggaagtccgacggcatcgacctgagcaacgtgctcatgcagccgggtccggttccgggaaccatcctgcacaagacgatcgatcagaaccatgagctcgacaaggcgctcgacaacaagctcatcgagcttgcccagccagcccttgacaagaaggagcccgtgcgtatcgaaatgccgatccgcaacgtgtaccgtacgctcggcaccatgctcggctatgagatcaccaagcgttacggcgaggaaggtctgccggacgacaccatcggcatgacgttccatggtgccggcggccagtccattggcgcgttcattccgcgtggcgaaaccatccgcgtctacggcgaagtcaacgactacgcgggtaagggcctgtccggcggccgcatggtggtccgtccagaggacggcatcaccttcgatccgcacgagaacgtgatcgcaggcaatgtcaccggcttcggcgcgacttccggccaaatgttcgtggccggccgcgcaggcgaacgtttcgccgtacgtaacggcggcgccaccttcgtggtggaaggcgtgggcgaccacggctgcgaatacatgaccggcggtacggtcgtgattctcggctccaccggccgtaacctcggcgcgggcttctccggcggcaacgtgtacgtgctcgacctcgacatgaagcaggtcaacccggcggccgccaccaacggcgcgctgctgttcgagccgcttgacgccgatgccgacaagctggtgcacggtctcgtcaagcagcatgccgaagagaccggctccgccttcgcgaaggccctgcttgacgactgggaaaacagcgccaagcgattcacccacatcgttccgaagcacttcctcgccatgcagaaggcgatgaaggaagccgaggagaagaacatcgatttcaatacgcccggcgtctgggaacaggtgtacgagcaggttatggaaggagcgcgctgacatgggagatcctcgtggattcctgaaggtccgtacccgtcgcgaactggccgaacgccccgttgaagagcgaatcaaggactggttcgacgttcacaccgaatccggcctgcagtcctggaccaccgagcaggcggcccgctgcatggattgcggcactccgttctgcatgagcggatgcccgctcggcaacatcattccggaattcaacgatctggtccgtcaggagaagtgggaggacgcgtacaaccgtctgtccgaaaccaacaacttccccgaagtgaccggtcgcatctgcccggcattgtgcgaagccgcctgcgtgcttggcatccatcagccggccacgatgattcagaacgacgaacgcaccatcatcgatcaggcatggagccttgactacgtcaagcctctgccgccgcagcgtctgaccgaccagaccgttgccgtggtcggttccggcccatccggtctcgcctgcgcccagcagctcacccgtgccggccacaccgtggtcgtatacgagcgtgatgacgccatcggtggtctgatgcgttacggcattccgaacttcaaactcgacaagcgcctcatcgaccgccgagtcgagcagatgggagccgaaggcaccgtgttccgcaccggcgtggaaatcggcaaggacatctcctgggatgacctgcgttcccgctacgacgcagtggtggttgccatcggctccaccgtgccgcgtgacatgaagattccaggccgcgagctcaagggtatccatttcgccatggagttcctgccggacgccacacgtcgcgtgtacggtgtcaagccggtcaacgacatcaccgccgaaggcaagcatgtggtgatcatcggcggcggcgacaccggttccgactgcctcggcacatccctgcgccaaggcgctaaggacgtcaccgtgctgcagatcatgccgcaggaaccgaaggagcgtccggccaaccagccatggccgaccttcgcccgcctgtacaaggaaacctcctccatgaaggaaggtttcgaaacgcagcgcgccgaatacgtgtacaacaccgactcggtcaacttcgagggctccgacgaggacaaggccaaggtgaaggtggagaactccaccgccaccgaaggcttcgtcgccgacgagaacggacatgtcaccggtctgaaggtcgtcaacgtcgctccaggagagaacgggccgttcacccgccagccaggcaccgaacgagtgattcccgccgatctggtgctcatctccgtgggcttcctgcaccctgacaccaccacgctggtggatcagctgccggtcgaccttgacggtcgaggcaatgtggcgcgtaacgacaagttcgccacctcccaggacggcgtcttcgcctgcggcgatgccggacgtggccagagcctcgtcgtgtgggccatctccgaaggtcgctcctgcgcggccgcggtcgacgagtaccttaccggctccaccgaactgccggcaccgatcgtcgcttccaagcgtccaatgatgctgccgcgatagacaacactgttgtaagggtatgaacgaggtggcccggctcgcgaatagtgagccgggccacctgtttttcacccgaaatgcggtaaagtaatcccagcaccatgcaacaaaggagtgactaatgccaaatcgcgcagaacgacgtgcccaagccaagcgcaatcgcaggggagtgccacagcaatacgaccaaacccaaggccgcgcacgttccggcatgttggacgagtatcagctgcaggaaaagtcacgtcgtctgcaggacggcaccgatgggccatggaagccgagtgccagtacggtcacggaaacggaaaacgcgctgaacaccaatcctgattacaagaatccgaagatgttcaaggcaccccattccgtccgtcaatggttccgtgtggccagctgggtgctgattgcgctgtcggccatcgccttcctcgtggtcatgtggctgccgtcgcatccgatgtggctcatctccacagtcgccatcgtcttcgcagtcggtgtgctgagcctgttcttcacggccggcaacccgaagcacaatccgaatctcgaccaaaacggaacagccgtctgatcacaaaaacgatggaaagcggtgagacaaccagaagcatttgtctcaccgctttttctatcggattttaggtatgcgctacttgacttcgactaaccgtaaagggtatgcgagaatgctgtttcatcgtttttcagaaaaagaatggaactttctgaaaaacgatgaaaacaatgagtgtttttcgtgtctgatgttttacagtagaacaggaaacgctggaagactcgaggaggagattacagacatgaaggttgacattctatcgcgtgaatacccgcccaaggtgtatggcggcgcgggggtgcatgccgaagagctttccaaggtgctggcggaacgtgtcgatgtgacggtccgcgcattcgacgggccgcgcacggccgccgacattcccgcgattcccggaacagacccgaaagggtcgctcactgtcgtcggctacgacgtgccgaaggagcttgaggatgcgaacggtgcgctgaaaacgtttggcgtcgatttgcaaatcgccaacgacgttgatgccgacatcatccatgcgcatacatggtacgcatgccttgctggctatctcgccaaaatgctgcatgacaccccattggtcatcaccgcgcactcgcttgaaccgttccgtccatggaaacgtgaacagttgggcggcggctacaatctgagctcctgggctgagaaagacgcctacgagcatgccgaccgcgtgatcgccgtatccgcgggcatgcgtgaggacatcctcaccgcctatccgaaccttgacccggacaaggtggtcgtagtgcacaacggcatcaccatgagccagtttgaaaccccggcggatgacgatccgggctggaaggtgttcgaacgttacaacatcgaccgcagcaaaccgaccttgctgttcgtcggacgcatcactcgtcaaaagggtctgccgtacctgcttcaggcactgcacttcgtggacccgaacatccaggtcgttctgtgcgccggcgctcccgacacgccggaaatcatggaagaggtcaagaccgccttcgccaagctcgacgaggaacgcggcaacatcatctggattgaggagatgctgccgaagccggagctcaacgcactcgaacatggctgcgacgcattcatctgcccatccatctacgagccgctcggcatcgtgaatctggaagccatggcatgcggtctgccggtggtcgcctctgcgaccggtggcattccggaagtcgtcgtcgacggcgagaccggatatctggtgccggtcgaccaactgcatgacggcactggcacccccaccaaccctgacaaattcgtgcacgatatggccgacgccatcaaccgcatcatggctgaccctgaaaaggcgaagcggatgggacaggccggttacgagcgcgcccgcgaccacttcagctgggagtccatcgcagacaagaccgtcaaagtctacgaggacgtgcttgccgaacggaagtagaaccgaacctgtctgatcgcggataaccgatccggctgatcgacagccagaataatcctgaaatgcctcctgccgacgcactatgctggcaggaggcatcatcgtatccaagtggtttgtgaaaatggaggggaccatgaacgaacagaacatcgcgttgaaactggacgatgtggaattccgtcgccgcaggcgcgtaattctcaccaaagtcaatctggaagtcaaaaaaggcgagaaatgggtgctgttcggtcccaacggcatcggcaaatccacgttggtgcagatgatgagcacccgtggattcccatccgaaggcacagtcgacattctgggaaaacgtctgggcaaagtgaacgtgttctcctaccgcaaccgcatcggtttgagctcggccgaactcggacgcgcgttcccgccgcaggaagatcctcttgacgccatcgtgacggcgctgaccgcaaccaccggccgttggcgcgacacctatactgacgaggattacgccaaagcccgctcattgatgcgtgaattcggcatcgaatacctggaaggcaagatgatgttcaagctttccgaaggcgaacgcactcgcgtgcttatctgccgtgcgttgatggcggatcccgatttgctgattcttgacgagccgaccacgggtcttgatttgggtgggcgtgagattgctttgcgtgcgttgagtcgtgttggtgcggagcagtctgaccgcgccgtgattctggtgacgcaccgtcttgaggagattccgcaaggcttcgaccacgtggcgatcatgggacgtatcaccggcaacgaggcggatgcgtatgccgataacgtcgccggcaacgatccggcgccgggcactatcgtatatacgggtgatttggagcatggttttacttctgaacggttgagccaggtgtttggattggatttgaaggtcacgcatgcgaatggtcgttggaacgcgtacgcggtgtgatgtcgacgtcgccgtcacattgccgtcgcttcgtgccgtctgccggtatgacggcggatacggtagcataggttcgttgctgtccgtggaatgcggtctgcaatcgtaagccatagtcgtgaaatcgcatactgaacgaacgtacgaaggagcgtaaaccatgcgtcgagggccgcttgccgccggtgaaaaagtgcagttcacggaccgcaggtcgaataaaatcaccgatcagctggtgccgggtggtgtgacgcagacctcgcatggcatcatcctgcatgatgatgtgattggccagacggaaggatccgttgtcgtgacggtgagtgcgaaacgtgaggctcaggtcaaccagacgcatccggaacgcgacgcgaacaagccgtggaagggaacgcgtgccatcggtggttgggagttcgccgtcatgcgtccgcgcttggctgactatgtgctgtccatgccgcgtggcgcgcagatcatgtatccgaaggacatcgcgcaggtcatccagctcggtgatattcgttccggtatgaacgtgctggaatccggagccggttcgggcgcgatgagcatcaatctgctggatgccgtgggggagggcggaagcctcaccaccatcgagatgcgttcggaattcgcgcgcgtcgccgaagccaacgcgacggtttactttggcaaacgtcccgcatggtgggatttgaggaccggcgatttcgattcggtcgcggctggtttgccggaacactccttcgaccgcatcatgcttgacatgcttgacccgtggaaccgtcttgaacaggcgtatcgcgtgatcgcgcctggcggcgtgctcgtcgcgtacgtcaccaccaccacgcagttgagccgtcttgccgaagcgttgcgcgaggtcggctgctggaccgagccggacatgcaggagactttggaacgtaattggaaggcgcaaggactggccatccgtcccgatcaccagatgattggacacaccggtttcctcatggtttctcgcgcgatggctccgggcttccaggcgttgcgtaaacgcgaccgtgccacgaaggacacgacgaccgacatcgattcgttgacgcccgaggagcgtgccgaacagcttgaggatctggaattgcgtgacatttccgatcgcaagctgcgcaaggtgctgcgtgacctcgacgcgcaggtcgaagccataaaggagtagatttagagcgtttcatgccatgtcccagcggaaaatctgagacaatggacattagacatttgaaatgcggcgctggaaccggatcggagcgtgcgattatgggaacgagcctgaagaaggtcgctaaaaaggccaaggaatacaagtatgtgctgctggcgatgcgccacgccaaaaccgagccgttcggcggcaacggcagcgacgtgggacgtgagctcaccgacaaaggacgtaagcaggccaaagccgtggccaaaggattggcggcgttcaaaatggtgcccactcgcatcgcatgctccagcgccacccgcgcccgtcagacctgcgatcgcatgctcaaggtgttcggcgacgatccgaaagtcgactaccggcaaagcctgtacgaaggcggcgtgcaatccgtgttcgacgagctcgcgcaaaccaaggaaaagcatcgcacgctgctcgtgcttggccacgaaccgaccatttcgatcgcctgccaatggctggccagcaccgaatccgatccgacgttgcttgacctgctgaatctcggcatgtccccggcctcgatcgccgtattcggctcgaacgagccattcaaccagtggcagctgcacagcggcgaactcatcgcgctgcttaccgccaaagacttcgagtagggcttgcgtgttccgggctgattcggaacgatgagcattccgcagagtgctgtgatttgacttcaagcggcttcaaggttgtatggtgctttctgaaccgatgttcagaatgatggataggagagcccatatgaacaatcccagtgcgttccctcttggggaaccaaatgacggtttcgcccagtatttcgacggacagagctggcttgcgccggtacttgacgcgcctgaagtgtcaatccacaatgtgacgttcgaacctggatgccggaaccactggcatatccaccatcacgcggcccagattctcattgcggttggagggcgtggctactaccagcttgagggcgaagagccgaaggagcttgaaccgggacaggccgtccgtattccgccggacgttaagcattggcacggtgccgcccctcgcgaagctttcagccatttggcgttcatgattgcggatggcacgggcgacgtgacgaatgaatggctggaacccgtagaccccgacgcatacgagacattgcgttaaatccgcttgccgggctgttctgcattattgatccataaacataaatgtgtgaatatagacggcatacggactgcgttataaggacagtttataacgacattcaaattttcttgatgtcttatagctggcggttttgtgatagcttgagcgggttgcattgttcatatcagatggaggattcatgtccgctcttacttccgtctccggtttcccgcgcatcggccagaaccgtgagctgaagaaaatcatcgaagcgtattggaagggcaacaccaccctcgatgaggtgcgtgccacagccaaggaactgcgcgccaagcattggaagctgcagcaggccgccggcatcgacctgattccgagcaacgacttcagctattacgaccagatgctcgacactgccatcctgctcaacgtcattccgcagcgctaccagcgtctcgccttcgagaacccggaagagaccctcttcgcaatgggtcgcggctatcagggcgagaagggcgacgtgaccgccctgccgatgaagaagtggttcaccaccaactaccactacctcgtgccggaaatcgactccgccaccgacatcaagctcaacagcaccaagccgttcgacgaattcaacgaggcgaaggcgctcggcatcaccaccaagccggtgctcatcggcccgtacaccttcctcaagctcgcccgcaatccgcaggccgaggagctcgactacgacaagggcctcgtcaacgcggtcgccgcggtgtacgccgaagtcgtcgccaagttcgccgaactgggcgtgcagtggatccagatcgacgaaccgtacctcgtgctcgacaaggagccgggcgacgtcgaactgttcaagagcctgtacgccaagatcctgcccgcccgcgaaggcaaggtcaaggtgctgctcaacacctacttcggacacatcgccgacgtgtacgaaaccgtcaacctgctcggcttcgacggcatcggcctggacctgaacgaaggcaaggacgaaaacctcgccgccgtcgaaaagtacggcgtggcagaaaaaaccaccatcttcgccggcgtgatcaacggccgcaacatctggcgcaacaactacgccgtgagcctcggcctggtcgacgcgctgaagcaggtcaccgccaacgtggccgtctccaccgccagctccctgctgcacgtgccgttcagcaccgaaggcgaggacggtctcgccgacgacgtgcgcaagcacttcgccttcgccgtccagaagctcgacgaactgcacgaagtcgccgtgctcgccgacgcttccgacgacgagaagaaggcatccgccgaactcgcagccaaccaggcgctgttcgacggcacccgcgtcgccgccgatcctgcggtcgccaagcgaatcgcaagccttaccgacgccgacttcgtacgtcagccggcacgcgccgaacgccagaaggagcagcgtgaggcgctgaacctgccgctgctgcccaccaccaccatcggctccttcccgcaaaccaaggaagtgcgcgccgaacgcgccaagctgcgcaagggcgagatcaccaaggccgaatacgacgaattcatgaagaaccagatcgacgcctgcatcaagcatcaggaggaaatcggcctcgacgtgctcgtccacggcgaattcgaacgcaacgacatggtcgaatacttcggccagaacctcaacggcttcctgttcaccaagaacgcgtgggtgcagtcctacggcacacgttgcgtcaagcctccgatcgtgtggggcgacgtatcccgcgccaacccgatcaccgtggaatggagcgcctacgcgcagtcccgcaccgatcatgtgatgaagggcatgctcaccggtccggtcaccatcctcaattggtcctggccgcgcgaggacatcacccacgagcagcagacccagcagctcgcgctcgccatccgcgacgaagtgctcgatttggagaaggccggcatcaaggtcatccagatcgacgaggccgcactgcgcgagaagctgccgctgaggaagaccgactggcacaagaagtacctcgactgggccattccggcgttccgtctggtgcattccgccgtcaagccgaccacgcagatccacacgcacatgtgctattcggagttcaacgacatcatcaaggacatcgacgcgatggacgccgacgtgatctccttcgaagcctcccgtggcgaccttgtggtgctcgacgccatccacgacgccaacttcgaaaccgaagccggcccgggcgtgtacgacatccactctccgcgcattccgtccgaacaggagatcgaggaccgcatctacgagatcctgaagaagatggacgtcgaaaaggtgtggatcaacccggactgcggcctgaagacccgtggcaacgccgaaacctggccgagcctggagaacctcgtcgcagcggccaaggccgtgcgcgccaaactcgccaagtaaggccggcataggcataaacaggcaagatttccaaggaatcacatgcattcgccaatcttctcgctggaggtgttccctcccaagcgcaccagccctgtgggtaccatctacgatacgttggatggcctgcaggggctggaccccgacttcatctccgtcacctacggcaccggcaaatcgtccgaccgcacgttgaccgcacgcatcgcgcatacggtgaacgaatacggcattccggccgtggcgcacctgaccgcgcaataccttgacaaagacgacgtggatgaggcgctcgacctgttcgaccaggccaaagtctccggcgtgctcgctttgcgaggcgaccgtgtggaaggagccgaaccggcgggagtgttcgaccatgcgagcgatctggcggcctacatccgcgagaagcgtccggatctcaagatctacggcgcctgctatccggaaaagcacccgcaggcggccacgcttgaggaggatatcgacaatctcaagaagaaggtcgacgcgggcgtaagccacctcatctcccagctgttctacgacaacgaggatttccttcgattcgtggacaaggctcgtgccgccggcatcgacgttccgatcgaagccggcatcatgccggtgatgaacgcgaagtcggtgctgcgcatgtcgaagatgtgcgaatcgcgtgttcctgaaaaacttgccgtcctgcttgacaagtgggggagcgacaccgcgctgcttaaagaggcgggtatcgcttacgcgtccgaacagatctgcgacttggcggcacgcggcgtcgacggcgtgcacctgtacacgatgaaccatccatgcgtcagccggcgcatctggtccaacgtcaaaccattcttcgtctgattcagacgatgcaacaaacacgaaagggatgatttccggcaactgtcggaaaccgtccctttcgccatacttacggatatgaacgattactatgggaaccatggcttcttctacgcatcagtttgaggtgctcgatctgattcgggcgggattgcaggatctggacacggcacgcacgttgcttgacgagttgcgcgccgacggcatcgacgacgaccggctatgcctgctgatgaaaacattggaacagacctgcgagcccgacatcgcgctacgcaacctcgtcgacatcatcaaagcgttgcaaagccaaggccgcgacttccaccaggtcatcaccgacgacgccggactcgtacgactcgtcaccgtgctcggcgtgtccgacggaatgggcaagctcatgcgcttccgccccgaactcgtcatggccgcagccagcgactcatgcgaaagccatctgtacaaccacgcgcaacgccgcgcgcatgtcctcgaagcggtcggtgccgacccggccgacaatcgcatgccaaaagccacgaaaccactcgccgaagcggcgaccgcgctacggcagacctacagaaaacagctcgccgccatcatggcgcaggacgccaccgcggacgacccaatcgaaatacaaccgagaatcagccaggaactgtccgatcttgccgacgcggccctggaaggcgcgctcgccatcgcccgcaacgaagtggacagcagcgaacacgtgcgcttcgccatcatcggcatgggcaagctcggcgcacgcgaactcaactacgtatccgacgtggacctcatctacgtggtggaaccggcggacgcggacaccaacggcatgaccctcaaccgtgtcggcaccaaaatggccaccaccctgcagcgcgtatgccaatccgtcatcatgggcgtcgccgaacctacattgtggcagatcgatggcggactgcgccccgaaggcaaggacggcccgctcgtacgcaaactcgaatcgcacgaagcctactacgaacagtgggcggaaaactgggaattccaagccctgctcaaggcccgccccgtggccggtgaccccgacctcggccaagcgtacatggacatgacccgaccgttcgtatggaccgcctccaaacgcgacaacttcgtctacgactgccagcagatgcgcaaacgagtcgaagacctcatccccgcgcccctgaaggaccgtgaaatcaaactcggccgcggaggcctacgagacgtggaattcaccgtgcagatgctccaactcgtccacggccgcgccgacgagaccctgcgcaccagctccaccctcgaatcgctgcaacgcctcgccgaaggcgggtacgtctcacgcagacaagccaagaagctctcctgggactaccgcttcgaacgcgtcatggaacaccgccagcaaatgtgggcgctcaaacgcacccacctgttcccggacctcggcaaagccagtctcggcggcatcgaacgcaaacgcgacgccaacgacgacgaactcaaccacaacctcgaactgcgcagactcgcccgggccttccacatgcaccctgaggaactcgtcgacaaatacgacgaaacccgacgtgaagtgcgccacctgcacatggacatctactaccggcccatgctgcccatcaacgccggcctcgacgacgaacaagtggaactgtccgccaacgccatgcaggaacgcttcgcctccatcggattcgccgaccccgacgccgccatgcgccacgtcaccgcactgaccgccggcatctcccgtgccgcgaaaatcaaccgcatcctcctgcccgccgtcctccaatggctcggcgaagggcagaaccccgacatggggctgctcaactggcgcaaactcgaagaacactttggcacggacagcgaatacctcggcttcctgcgcgactcgccgtccgccgcgcaacgcctgtgccacgtcctgtccaattcacggttcctgggcgacgcgctcaacaaatccgtcgaatccgtcacctggctcggcagcgacaacgacctgcagccacgttcgcgcgaaagcctcgacgtgcagacacacgcctccctcgaacgcaacgtaggcagcatcaacgacttcgccaactccatccgcgccatgcgacgccacgaaatcgaacgcatcggactagggtggatgagcggcgtcatcgacgacaaggcgtcgctcgcaggtatgaccgacgtatacgacacggccatcgacgcatcgctcacctgggccatccgccaccaaacgcaggaaatgggattcgacgaagcgccggcggcaatcgccgtcatcggcatgggacgctacggcggcagggaagtgaacttcagctccgacgccgacgtcatcatcatctaccggccgtccgataacgccgacgacaaccaagccaacctcttcgcacgcaaagtgcaggaagacctccgcgccatcctgcaaggaccgaccacgctcgaacccaaaatcgaactcgacatggacctgcggcccgaaggcaaaaacggacccctcgtgcgctcctacgcgtcctgcgaggaatactaccgttcctgggcgagcacatgggagcaccaggcgctcctgcgtgcgcgttacgcggcaggcgacgcggcgctcgccgaggatttcctgatgaacgtcgccgacccgctgcgctatccgaagatcgatttgacggaggcgcaggtcgccgaaatacgcaagctcaaggcgcgtatggaagccgagcgattgccgcgcggcgtgcgtagggaccgtcacctgaagctgggcaaaggtggtctgtccgacgtggaatggacgattcagctgctgcagttgcagcatgccggcgacaacgcgaacctgcgagtcaacggcacgatgcaggcgttggacgagttggagcggcgcaagctggtttccgccggcgacgccgtcgtattgcgacgcgcatggtggatgtgcacggccgcgcgcaacggcagctacctgtggagcgggcgcgtcaaccaggcggatatcctgccggatgacacgtattcgctgggaggactcgccgtctatctcggatacgacgcgaatcgcggacagcatttcgaaaacgatctgct

SEQ ID NO: 2 - DNA, 23384 bp, Bifidobacterium adolescentis WBS-01
cggatgaaatccacaaaaaggccttaagaggtatgaatattaccccctagggccttagcgattcaagaagactgccatctataagcgaaatagcatcggtcgggtgaagaaatccgccatccataagcgagatggcggatttctgcggctcactgcacggcggcgagggcttggtcgaggtcggcgatgatgtcggccgtgttttcgatgccgcagctcaggcgcaccaggtcgatgccgacgccggcttcctcaagctgctcctcggtgagctggcgatgcgtggtgccggccggatacagcgtgcagctgcgcgcatcggccacatgcgtggcgatggacaccatcttcagatggtcgaggaacgcggagaccttctcgcggccgcccggcacgccgaaggagatcacaccgcaggtgccgttcggcatgtacttctccgccagcgcatggtacttgtccgtttcgaggcccgggaagctcacccagctgacgcgcggatcggcgtcgagccacttggccacggccagtgcgttcgcgcagtggcgctccatgcgcacgccgagggattccagatgcatgcccatgatccacgaattgattggcgccggagtggagccgaagtcgcgcatgagctgcgcggtggccttggtgatgtatgcggccttgccgaattccttcgcgtaggtgacgccatggtaggagtcgtccggagtggtgaggcccgggaatttctccgcatgggccatccagtcgaaattgccggaatcgacgatcgcgccgcccacgcaggatccgtggccgtccatgtacttggtggtggcgtgcgtgacgatgtccacgccgtactggaacggacggcagttgatcggcgtcgggaaggtgttgtcgacgatcagtggcacgccgtgacgatgcgctgcgttcgcgaacttctcgaagtcgagcacgataagcgccggattggagatggactcgccgaacacggccttggtgttcggctggaacgcggcctcaagttcctcttcggtgcagtccgggctgacgaaggtacattcgacgcccatcttgcgcatggtcacgttgatgaggttgaacgtgccgccgtagatggcggaggaggcgacgatgtggtcgccgttgttgcagatgttgaacagcgcgaagaagttcgccgcctggccggacgaggtgagcatcgcggccgcgccgccttccagctcgcagatcttcgcggcgacggtgtcgttggtcggattctgcaggcgggtgtagaagtagccggattcggacaggtcgaacagtcggctcatctgttcgctcgactggtatttgaaggtcgtggcctggatgattgggggagtgcgggattctccattgcccggctgatagcctccctgcacgcagatggtgtcgacgttttcgctcatatgttccttctttcgattccgcgcttccgtgtgccgcgcaggtgttgcgccgcgatgcgaacaaacaaacacactgtatcactgcattgataaatggcttgattccaatggaaacgccgtatagtttaacgaattgacaaacttaggtaattcaatttattatgtagaccaagacgggcggaaagcccgctgcgaaataaagctttacgtaagtaaaccaagcaaaggagcattccatgggtctgtgggatatcgataagattccgtacgtcggtcgcgaaaaggggccgcaggagggtcttgctttccattactacgatgccgacaaggtcgttgccggcaagaagatgaaggactggctgcgtttcggcgtcgcatggtggcacaccttcgaccagcagctcgtcgatccgttcggcaccggcaccgcccagcgtccgtggtacggcaagtattccgatccggaggacgaggccctggccaaggtcgactacgccttcgagttcttccagaagctcggcgtcgagtacttctgcttccatgatcgcgacatcgctccggaaggcgacaccctgcgcgagaccgacaagaacctggacaaggtcgtcgacaagatcgaagagaacatgaagtccaccggcatcaagctgctgtggaacacctcctccctgttcaccaacccgcgcttcgtctccggcgcctccacctccccgttcgccgacatctacgcgtacgccggcggccagctgaagcactccctggagatcgccaagcgccttggtgccgagaactacgtgttctggggcggccgtgaaggctacgagaacctgtggaacacccagatgaagcgcgagcaggagcacatggccaagttcttccacatgtgccatgactacgcgaaggaaatcggcctggacgcccagttcctgatcgagccgaaggccaaggaaccgacgatgttccagtacgacttcgatgccgccaccgccatcaacttcctgcgcacctatgatctgatggacgtcttcaagctgaacctggaaggcaaccacgccaacctggccggccacacctaccagcacgagatccgcaccgcccgcgaggccggcgtgctcggctccttggacgccaaccagggcgacaagctcatcggctgggatatggatgagttcccgaccgacctgtacgagacctccaccgttatgtgggaagtcctcgccgaaggccagatcggccctcacggtggtctgaacttcgacgccaagccgcgtcgtacctccttcaccgccgaggatctgttccgttcccacatcgcaggcatggattccttcgcagcaggcctcctggtcgccgccaagatgcacgaggacaaggtcatcgagaacctgcaggccgagcgctacagctccttcgattccggcatcggcgcaaccgtcgagaacggcaccgcctccctggcttccctcgaggagtacgctctggatatcccgcagtccaagctcatcgaagccaccaagtccgatcacctcgagtccgtcaaggccacgatcaacaactacatgatcgacgccctggccgaggcgtgagccgaaaactcactagggttttaggtagcctcgggcgaagtccgagacggtagtcgagggcgagcaatgactgggcgcgcgtagcgttccggaattgcaggaccgaggcatgggcgcagtaaggagtttccgttaggactcctgattcatcgctggatcaaacagtggggctcgactgtgacagagccggatgtggtgtgccgaagcgtcggtgttccggcacaccactcacttttctttccttcctccttcctcaaatttccttcgcacgcaagtcgtttgccggctagatcgccggtgagcggcttgcgtgcgttgttagaccaagcgaaaatttcgattattcgcaatgatgtgatgtatccaaacgttcccgaatgaggcgtacttatgaccacaacgattaccatcgccaatcccattcttcacggaatgcatcctgatccgagttggatttgggatgatgatcttcggcaaatcgtgcttgtgacctccaccttcgaactggttccaggcttgcctatttacgtttccagggatatggcccactggaaacacgtgtcggatgccatagatgaggagttggcaagacgtttgctcattcctttcgtggatgactcgggtggcgtctatgcgccgacgctgcgtaggattcgtggcaaatacgtgattgcctgcaccatcgctcgcatcaatggacgcaaagccatcgcggaaggatgctcccaggccgaattggatgcggcccaggcggcggaaggcaacttcgttcttgagtcggactcgatcgacggaccttggcgtgggccgttctggatcgagggcgccgaaggcatcgatccagacatattcgaggacggggacggcaatgtgtactggacccagacccgtcctgcggtcaatccgcaatgggaaggccagaccgaggtctggacccaacgcattaatccggagacttggacttttgtcgatgacggtcttcctgcgggatcgggcaagacggtaatatggcgcggatacggtatggaatcggtgtgggctgaggcgccgcatctctatcgcgtgggtgattatgtgtatctgatgaccgctgaggggggcaccagtttcgaacatagcgaaatggccatgcgcatctatgcaccgcatggactgcttcgggcgttcgaagcttacgaacgggaagcatccgaatcgggtgagtgcattccgcaggttcgtgacggggaacgctgctatcttggcaccgcaatccgtgccttccacgcggataagaagaatccgattctcacccaccgacatctgggtttgtcggaaccgctgcaatgcgtgggacatgcggacctgttgcttcatccggaactgggatggtggctggtgtgtctcggcgtgagggagacgcggggaaagcatgacggcgaattattgagctacttgggaagggagagctttgtcgctccggtatcctgggaacataatccggccgattggaagctggacggcaacggtgcattagatacgcatgagggtgaccccggatggccagtgacgtgcgctggtcttggccgcttggccgacgagatcacggttactactgaagacgatggcatcaccatcgagcctagggtgaaatcctcgctcgccggtgacgtggaacctgcgctggtggatgtggctgatggctcgacgaacgatgtggtggtgcgcgacgagcgtgatgtcagctaccgcagaatagcgaaactgccgacgctcatgccgattcccatgtccggttctttagtgattcggcagaattccacgcattacgcggtgttttcgatgcatggcacggatgtgcgctacgagatggtgaatggagacgattcgcaagctgggtctgttgccgtacaggctgacggagtgcgtccggcggtacttttcgacgacaaccgcttgtcggtcatcgtaactggcatgcatggtccggttgattctgcgacgttcgtgcgtcaggggcaggtcctgctgagtgtcgatgcccgtttcctcagcaccgaatgggctggtgggttcgtcggttgcatggccggcttcatggcatagattctacggaatttcaggatggttcactgctggtgttccgacgggccgtcttagaacgaggtgaaaacgggtcgaaaggctaggagcgctgtgttctcccttacggttgtgcctgtgaggtttgccccgctgattaaccctcgagttgctgtgtgctgttgcgtaccactagcgatgtcggcatgatgatgtgcggttggatcacgtcgtcggtggacagcgcctcgaccagcatgcgtacggcggcccttgccatgtcttggagcggctgccgtacggtggtcagcgccgggccaaggaatgcggcagtctgcacatcgtcgaatccgaccacggataaatcctccggaatacgtaatcccagctgtcttgccgcctcgtagacgcccatggcctgcagatcgctgccggcgaagattgcggtcggacgatttggtcgtttcaacagggagatggactgtgcgtaaccgccggaagtggtgaaatcgccttcggtgataagttcgggatcggtttcgattccatgttccgcaagcgctgatgtatatccgtccagacgtgctttggaacacatcatttcctccggtccggtgatgatgcctatgcgggtatgtccgagtgcgagcagatgcctggtggcgattacgcctccggtccagttgtccgcttgcaccgacagcgtgtctggatctggattaccgaatggatcgaacaagacgaagggaatacctctggaatgcagtttgttccgttcgatacgtgtcagactggagaagacaagaatggcgccatctgtctgccgacgcagcatgttgtcaatccaggatgagtccgggtgctggcgattgccgccttcggtggtgatgacgttcaaatcatgcaacttggcttcgcgaatggcgccacggagtacttcaagggcccaaacattatcgaaatcttggaacacgatttcgataattcgttggcttttcgcgcctgtcgctttacgggaatacccataccgtttcaacaccgcgttgatggtttgccgcgtctcttcggaaacgtcggctctgccgttgagcgccttggatacggtggaaagggaataaccggtctctttagctatgtcagagagtcgtaccgtagctttctttgtcgtattgcgcatgagtcactccttcttcatgctcatcatatccgaaaacgcgaacgaaagtttcggtttgcgtttttcgaaactttcgatatgttggcaatacttaaaaacgttgtaaaatcaacgaaaaataattagttttctgattttacaaaaaacttgactttgtgtgatttgtttcggtagtctataggtacaacgaaaacgaaatggaaattttcgaagggagtcaaaggctgattctctgtctgccaggggagctgcagcagcattcgttgcggtcatgcttcccgattcgacccaattcgagagaaattcctgtcgttgccatcattttgtcgatgatgatttggtcaataaggagaagacaatgaagttcagaaccattgcagctgccactcttgcggtggcgaccatgttgggcatgggtgcctgcggctccagcactggtgctaaagacgataagaccattacgttctggcataacgcaacagctggtgacggcaagcagtattgggaggatatggccaaagcgttcgagaagaagactggtgtcaaggttcagattcaggccatccaaaacgaggatttcgaaggcaagctgaccaccgctatgcaggatcccgcctccggcccggatgtgtacatgacccttggtggagccaagaccaaggacatgattgacgccggacagaccatggacctcactgataagatcagtgacaccgtcaagaagcagatgtcttctgcgctggagtccatgtcctatgacggcaaggtctatggtgttccagtcactgtgcagcctggtggcatctggtattccaaggatctgttcaagcaggctggcatcgatgccgcgccgaccaccttcagcgagctgaagaccgatgtgcagaagcttcgcagcgctggcatcgatccgatcgcactcggcggcaaggatgcttggccggtcggtcactggtactactggttgtccatgcgcgaatgctctccgaaggcctacgccaagggcgtcaatgacaaggacttctccgactcctgctggaccaaggccggagatgatctgaaggatttgttggatgcgaatgcttttaacgaaggattcctcaccacgacggcccagcagggcgccagctcgtccgcaggtctgctggccaatcataaggctgcgatggagctcatgggcacatgggagcctggagttctcaaggacctgactccggacaagaagccaatggctgaccttggcttcttcgccttcccgaccgtggacggaggaaaaggcgaggaaggtgctttgatgggcgctgtgaccggtttcgctgtcaatcccgaggctccggacgctgctgttgatttcgtcaatttcatggctgagaaatcaaatcaggagaaatacgccactgcgttcagcaccattccggcttccgccgaagcttacgatgcggttaccgatgaaaatcttaaagccatcatcgaagctatgaaaaagtccgatggcatgcagctgtggatggataccgctctcggcggaaatattggcaacgctcttaattccggagtggtgaatctgctttccggacaggggacttcggctgacatcgtcaaggcgatgaaggacgcagcggccaagggctgacagtgaacatggctggttgaaggccaaaggagggtggatagacagattttcatctgccctccttcctattcgagaaacgtatctggtagtggagaaaaccatgtcaagtacaagcaaagacgcggtgacgctgcgcgctaagcggtccaagaaaccgtccgatggcaaaatgcgtcgtaatgttgagattttcgtactgtccgcacctgcgattcttctgttcgtctgctttgtgattctgcctatcgtcttgggtgcttattacggcttctatcagtggaagggttacggacttccctccaagacaggtaaattcgttggtctccagaactacatcacagcgcttaaggatcccgcgttccaggcggcaattctgcataccttcgaggtcgtgatcggctcgttggtcatccaggctccgctcgccatcctgttcgcattgctgctgaaccagaagttcaaggggcgtggtctcatccgcaccctcatcttcgtgccgtatgtcgtttccgaggtcatcgtcggcacaggatggagcctgttgctgcagaagaagggcgccatcaatgagattctggccaacttcggcatcaatggtcccgattggctggccgacccgaagatcgctatttggacgctgctgttgctgatcagctggaaatacgtcggtttcgccgtaattctgatgctcgccggcatgcaatccattcccgaggaactgtatgaagcagccaaggtggatggggcgagtttctggcagatgcagaaaagcatcacgttgccgttgcttgctccgacgttgcggatctgggtgttcctttccatgattggctctctgcagcttttcgatctggtctatatcgtgtggggcaagtatgtgtcgaccaccgctggtgtgtccaccatggccacctacatggtgcgtgaaggtcgtggagccggcaactatggctatggttccgccgttgctctgatcatcttcgtgatctctttgatcatcgcactcgtctatcagaagttcgtgctgaaccgtgacttggacggtgctgttactgaacagaaagaagccgagaagcgtgccaggaagcgcgcaaaagaagtgcagcatcgtgaggttgctgccctggcaagtgaggtgaagtgatgactgccgcaacaatcgcaggacattccaacaaaagcgagtacagcaagaagaatggttaccgtaagtcatccaagacgccatggggcaacccaatcgtctacttcttctccctggtgcttgtggccatctgcatcactccggtgttgtacattatcttcggcggtttccgtaccaattcgcagatcaccaaccatccgtccgggatgccgaacccatgggtccccgacaactacaagacggtcttcgaaagtgatattttctggacggaactgaagaattctaccatcgtgggtatcgccaccatggtaggtgtcgtggtgcttagcatcatggtgagctttgtcatcgcccgatacaaattccgctatgcgccgcttatgtacgcgttgttctctgctggtctcatgttcccgatgaccgttggcattacacctttgtatctgctgattcgcaatctgggtctggccaactccctgtggggtctgatccttccgcaaattgccttcggacttcctcagaccatcatcatcttggtgccgttcctacagtcgattcctaatgagcttgaggaggcctgtcttctcgatggatgctcccgccttggcttcttctggcgcatggtcattcgctgtccatgcctggcgtggccaccactggaatcctcacttcgtggaagctggaatgcctacatgctgccgctgttcgtgctcagtgatgccaacaagtacacattgccacttggcgtacagatgttcagctccgaacactccgttgacaccgcacaggtgttggccttcacctctctggctatgattccggccctgatctgtttcaccatcttccagaagaagatcgtcggcggcctgacaggtgcggtcaagggctgacgaaatgtgacaatccacgcccggaagatgttcctttccgtcttccgggcttcatctcttatgcaagaggtacattatgaagatttccaacccggtgctcaccggttttcatgccgatccttcaatgattcgcgtcggtgacacttattacattgccaattccactttcgaatggttcccaggcgttcgcctgcatgagtccaaggacctggtgcattggaacattcttccaagcccgttgagccggtccagccagcttgatatgagaggaaacccctcttcgggaggcatctgggctcctgacctaagctatgcggataacaaattctggttgatctacactgatgtcaaggtggtcaatggtgcattcaaggattgcactaattatttggtcaccgccgaggacatccacgggccatggagcgagccggttcgcatcaacggggtcggttttgacgccagcctgttccatgacgacgacggccgcaaatacttggtgcagcagacatgggatttccgtgaataccaccaccagttcgacggcatcacgttgacggaattcgacgtcgacaccatgaagctcaagccagaaacggcccgcaccatctgggatggcacttcggtgaagatcaccgaaggtccccacctatacaagaaggatggttggtactacctgtttgccgcagaaggcggcacggtgtatgaacatcaggaatctgtggcgcgttcccgtacccttgacgaatactccttcgaagttatgccgaatggcccgttcatcggtaacttcgacactcctgacacctatttgcagaagcagggccatggagcgttggtggacaccccgtccggcgagtggtattacgcctccctatgcggtcgtccgtggcgtcatgataccgaaccggcccatggcacccgcggatggtgcacactcggacgcgagacctccatccagaaagtcgaatgggatgaggacggttggccgcgcgtggtcggaggtcacggcggacagcgttacgttgatgctccgaaagatgccatcgagactttggccccaacaacgcgtgacgaacatgatgagttcgattccggcgagctcggtccgaattggaacactctacgcgtcccgttcaccgacgccatgggcacggtgggcggtggcaaactggcattgcgtggtcagggctcgctgtgcaacctgtttgacttgtctcttgtggctcgtcgctggcaggcatttgatttcgacgccgaaaccaaggtgcgtttcgatccgaagaattacatgcagatggcaggcctgaccaactattacgatgacctgtgctggtcatgggcgtttgtcacttgggatggaagaacgacatgcaagggtcatcgaagtggctcagaacgatttcaaccaatatacgtcgttcctcaaggatgacgccatcgtagtgcccgaagacgccgaagcggtatggctgcgcaccaaggtccgcacggaatactattcctacgaatattccttcgacggagaacatttcaccgagattccggtcaagctcgatgcgaagatcctgtccgacgattacgtgaaccaacgttacggcggcttcttcacaggcgcgttcgtgggacttgcctgcgtcgatctgtccggctacggcgcgcaggccgaattcgactacttcgactatcgggagctttccgataaccagtagacagtgccggctggcgacagagcgtccgtcgtcaaggcagttcggcaatcgcaagaccatgctcgtccgctcctcattgcccatagatttcaatgccgtcgagtatgccggctgacgacggacgctctgtcgccagccggcactgtctactggttatcggaaagctcccgatagtcgaagtagtcgaattcggcctgcgcgccgtagccggacagatcgacgcaggcaagtcccacgaacgcgcctgtgaagaagccgccgtaacgttggttcacgtaatcgtcggacaggatcttcgcatcgagcttgaccggaatctcggtgaaatgttctccgtcgaaggaatattcgtaggaatagtattccgtgcggaccttggtgcgcagccataccgcttcggcgtcttcgggcactacgatggcgtcatccttgaggaacgacgtatattggttgaaatcgttctgagccacttcgatgacccttgcatgtcgtttctcatcccaagtgacaaacgcccatgaccagcacaggtcatcgtaatagttggtcaggcctgccatctgcatgtaattcttcggatcgaaacgcaccttggtttcggcgtcgaaatcaaatgcctgccagcgacgagccacaagagacaagtcaaacaggttgcacagcgagccctgaccacgcaatgccagtttgccaccgcccaccgtgcccatggcgtcggtgaacgggacgcgtagagtgttccaattcggaccgagctcgccggaatcgaactcatcatgttcgtcacgcgttgttggggccaaagtctcgatggcatctttcggagcatcaacgtaacgctgtccgccgtgacctccgaccacgcgcggccaaccgtcctcatcccattcgactttctggatggaggtctcgcgtccgagtgtgcaccatccgcgggtgccatgggccggttcggtatcatgacgccacggacgaccgcatagggaggcgtaataccactcgccggacggggtgtccaccaacgctccatggccctgcttctgcaaataggtgtcaggagtgtcgaagttaccgatgaacgggccattcggcataacttcgaaggagtattcgtcaagggtacgggaacgcgccacagattcctgatgttcatacaccgtgccgccttctgcggcaaacaggtagtaccaaccatccttcttgtataggtggggaccttcggtgatcttcaccgaagtgccatcccagatggtgcgggccgtttctggcttgagcttcatggtgtcgacgtcgaattccgtcaacgtgatgccgtcgaactggtggtggtattcacggaaatcccatgtctgctgcaccaagtatttgcggccgtcgtcgtcatggaacaggctggcgtcaaaaccgaccccgttgatgcgaaccggctcgctccatggcccgtggatgtcctcggcggtgaccaaataattagtgcaatccttgaatgcaccattgaccaccttgacatcagtgtagatcaaccagaatttgttatccgcatagcttaggtcaggagcccagatgcctcccgaagaggggtttcctctcatatcaagctggctggaccggctcaacgggcttggaagaatgttccaatgcaccaggtccttggactcatgcaggcgaacgcctgggaaccattcgaaagtggaattggcaatgtaataagtgtcaccgacgcgaatcattgaaggatcggcatgaaaaccggtgagcaccgggttggaaatcttcataatgtacctcttgcataagagatgaagcccggaagacggaaaggaacatcttccgggcgtggattgtcacatttcgtcagcccttgaccgcacctgtcaggccgccgacgatcttcttctggaagatggtgaaacagatcagggccggaatcatagccagagaggtgaaggccaacacctgtgcggtgtcaacggagtgttcggagctgaacatctgtacgccaagtggcaatgtgtacttgttggcatcactgagcacgaacagcggcagcatgtaggcattccagcttcccacgaaggtgaggattccagtggtggccacgccaggcatggacagcggaatgaccatgcgccagaagaagccaaggcgggagcatccatcgagaagacaggcctcctcaagctcattaggaatcgactgtaggaacggcaccaagatgatgatggtctgaggaagtccgaaggcaatttgcggaaggatcagaccccacagggagttggccagacccagattgcgaatcagcagatacaaaggtgtaatgccaacggtcatcgggaacatgagaccagcagagaacaacgcgtacataagcggcgcatagcggaatttgtatcgggcgatgacaaagctcaccatgatgctaagcaccacgacacctaccatggtggcgatacccacgatggtagaattcttcagttccgtccagaaaatatcactttcgaagaccgtcttgtagttgtcggggacccatgggttcggcatcccggacggatggttggtgatctgcgaattggtacggaaaccgccgaagataatgtacaacaccggagtgatgcagatggccacaagcaccagggagaagaagtagacgattgggttgccccatggcgtcttggatgacttacggtaaccattcttcttgctgtactcgcttttgttggaatgtcctgcgattgttgcggcagtcatcacttcacctcacttgccagggcagcaacctcacgatgctgcacttcttttgcgcgcttcctggcacgcttctcggcttctttctgttcagtaacagcaccgtccaagtcacggttcagcacgaacttctgatagacgagtgcgatgatcaaagagatcacgaagatgatcagagcaacggcggaaccatagccatagttgccggctccacgaccttcacgcaccatgtaggtggccatggtggacacaccagcggtggtcgacacatacttgccccacacgatatagaccagatcgaaaagctgcagagagccaatcatggaaaggaacacccagatccgcaacgtcggagcaagcaacggcaacgtgatgcttttctgcatctgccagaaactcgccccatccaccttggctgcttcatacagttcctcgggaatggattgcatgccggcgagcatcagaattacggcgaaaccgacgtatttccagctgatcagcaacagcagcgtccaaatagcgatcttcgggtcggccagccaatcgggaccattgatgccgaagttggccagaatctcattgatggcgcccttcttctgcagcaacaggctccatcctgtgccgacgatgacctcggaaacgacatacggcacgaagatgagggtgcggatgagaccacgccccttgaacttctggttcagcagcaatgcgaacaggatggcgagcggagcctggatgaccaacgagccgatcacgacctcgaaggtatgcagaattgccgcctggaacgcgggatccttaagcgctgtgatgtagttctggagaccaacgaatttacctgtcttggagggaagtccgtaacccttccactgatagaagccgtaataagcacccaagacgataggcagaatcacaaagcagacgaacagaagaatcgcaggtgcggacagtacgaaaatctcaacattacgacgcattttgccatcggacggtttcttggaccgcttagcgcgcagcgtcaccgcgtctttgcttgtacttgacatggttttctccactaccagatacgtttctcgaataggaaggagggcagatgaaaatctgtctatccaccctcctttggccttcaaccagccatgttcactgtcagcccttggccgctgcgtccttcatcgccttgacgatgtcagccgaagtcccctgccggaaagcagattcaccactccggaattaagagcgttgccaatatttccgccgagagcggtatccatccacagctgcatgccatcggactttttcatagcttcgatgatggctttaagattttcatcggtaaccgcatcgtaagcttcggcggaagccggaatggtgctgaacgcagtggcgtatttctcctgatttgatttctcagccatgaaattgacgaaatcaacagcagcgtccggagcctcgggattgacagcgaaaccggtcacagcgcccatcaaagcaccttcctcgccttttcctccgtccacggtcgggaaggcgaagaagccaaggtcagccattggcttcttgtccggagtcaggtccttgagaactccaggctcccatgtgcccatgagctccatcgcagccttatgattggccagcagacctgcggacgagctggcgccctgctgggccgtcgtggtgaggaatccttcgttaaaagcattcgcatccaacaaatccttcagatcatctccggccttggtccagcaggagtcggagaagtccttgtcattgacgcccttggcgtaggccttcggagagcattcgcgcatggacaaccagtagtaccagtgaccgaccggccaagcatccttgccgccgagtgcgatcggatcgatgccagcgctgcgaagcttctgcacatcggtcttcagctcgctgaaggtggtcggcgcggcatcgatgccagcctgcttgaacagatccttggaataccagatgccaccaggctgcacagtgactggaacaccatagaccttgccgtcataggacatggactccagcgcagaagacatctgcttcttgacggtgtcactgatcttatcagtgaggtccatggtctgtccggcgtcaatcatgtccttggtcttggctccaccaagggtcatgtacacatccgggccggaggcgggatcctgcatagcggtggtcagcttgccttcgaaatcctcgttttggatggcctgaatctgaaccttgacaccagtcttcttctcgaacgctttggccatatcctcccaatactgcttgccgtcaccagctgttgcgttatgccagaacgtaatggtcttatcgtctttagcaccagtgctggagccgcaggcacccatgcccaacatggtcgccaccgcaagagtggcagctgcaatggttctgaacttcattgtcttctccttattgaccaaatcatcatcgacaaaatgatggcaacgacaggaatttctctcgaatgggtcgaatcgggaagcatgaccgcaacgaatgctgctgcagctcccctggcagacagagaatcagcctttgactcccttcgaaaatttccatttcgttttcgttgtacctatagactaccgaaacaaatcacacaaagtcaagttttttgtaaaatcagaaaactaattatttttcgttgattttacaacgtttttaagtattgccaacatatcgaaagtttcgaaaaacgcaaaccgaaactttcgttcgcgttttcggatatgatgagcatgaagaaggagtgactcatgcgcaatacgacaaagaaagctacggtacgactctctgacatagctaaagagaccggttattccctttccaccgtatccaaggcgctcaacggcagagccgacgtttccgaagagacgcggcaaaccatcaacgcggtgttgaaacggtatgggtattcccgtaaagcgacaggcgcgaaaagccaacgaattatcgaaatcgtgttccaagatttcgataatgtttgggcccttgaagtactccgtggcgccattcgcgaagccaagttgcatgatttgaacgtcatcaccaccgaaggcggcaatcgccagcacccggactcatcctggattgacaacatgctgcgtcggcagacagatggcgccattcttgtcttctccagtctgacacgtatcgaacggaacaaactgcattccagaggtattcccttcgtcttgttcgatccattcggtaatccagatccagacacgctgtcggtgcaagcggacaactggaccggaggcgtaatcgccaccaggcatctgctcgcactcggacatacccgcataggcatcatcaccggaccggaggaaatgatgtgttccaaagcacgtctggacggatatacatcagcgcttgcggaacatggaatcgaaaccgatcccgaacttatcaccgaaggcgatttcaccacttccggcggttacgcacagtccatctccctgttgaaacgaccaaatcgtccgaccgcaatcttcgccggcagcgatctgcaggccatgggcgtctacgaggcggcaagacagctgggattacgtattccggaggatttatccgtggtcggattcgacgatgtgcagactgccgcattccttggcccggcgctgaccaccgtacggcagccgctccaagacatggcaagggccgccgtacgcatgctggtcgaggcgctgtccaccgacgacgtgatccaaccgcacatcatcatgccgacatcgctagtggtacgcaacagcacacagcaactcgagggttaatcagcggggcaaacctcacaggcacaaccgtaagggagaacacagcgctcctagcctttcgacccgttttcacctcgttctaagacggcccgtcggaacaccagcagtgaaccatcctgaaattccgtagaatctatgccatgaagccggccatgcaaccgacgaacccaccagcccattcggtgctgaggaaacgggcatcgacactcagcaggacctgcccctgacgcacgaacgtcgcagaatcaaccggaccatgcatgccagttacgatgaccgacaagcggttgtcgtcgaaaagtaccgccggacgcactccgtcagcctgtacggcaacagacccagcttgcgaatcgtctccattcaccatctcgtagcgcacatccgtgccatgcatcgaaaacaccgcgtaatgcgtggaattctgccgaatcactaaagaaccggacatgggaatcggcatgagcgtcggcagtttcgctattctgcggtagctgacatcacgctcgtcgcgcaccaccacatcgttcgtcgagccatcagccacatccaccagcgcaggttccacgtcaccggcgagcgaggatttcaccctaggctcgatggtgatgccatcgtcttcagtagtaaccgtgatctcgtcggccaagcggccaagaccagcgcacgtcactggccatccggggtcaccctcatgcgtatctaatgcaccgttgccgtccagcttccaatcggccggattatgttcccaggataccggagcgacaaagctctcccttcccaagtagctcaataattcgccgtcatgctttccccgcgtctccctcacgccgagacacaccagccaccatcccagttccggatgaagcaacaggtccgcatgtcccacgcattgcagcggttccgacaaacccagatgtcggtgggtgagaatcggattcttcttatccgcgtggattgtttgtgaggcacggattgcggtgccaagatagcagcgttccccgtcacgaacctgcggaatgcactcacccgattcggatgcttcccgttcgtaagcttcgaacgcccgaagcagtccatgcggtgcatagatgcgcatggccatttcgctatgttcgaaactggtgccccctcagcggtcatcagatacacataatcacccacgcgatagagatgcggcgcctcagcccacaccgattccataccgtatccgcgccatattaccgtcttgcccgatcccgcaggaagaccgtcatcgacaaaagtccaagtctccggattaatgcgttgggtccagacctcggtctggccttcccattgcggattgaccgcaggacgggtctgggtccagtacacattgccgtccccgtcctcgaatatgtctggatcgatgccttcggcgccctcgatccagaacggcccacgccaaggtccgtcgatcgagtccgactcaagaacgaagttgccttccgccgcctgggccgcatccaattcggcctgggagcatccttccgcgatggctttgcgtccattgatgcgagcgatggtgcaggcaatcacgtatttgccacgaatcctacgcagcgtcggcgcatagacgccacccgagtcatccacgaaaggaatgagcaaacgtcttgccaactcctcatctatggcatccgacacgtgtttccagtgggccatatccctggaaacgtaaataggcaagcctggaaccagttcgaaggtggaggtcacaagcacgatttgccgaagatcatcatcccaaatccaactcggatcaggatgcattccgtgaagaatgggattggcgatggtaatcgttgtggtcataagtacgcctcattcgggaacgtttggatacatcacatcattgcgaataatcgaaattttcgcttggtctaacaacgcacgcaagccgctcaccggcgatctagccggcaaacgacttgcgtgcgaaggaaatttgaggaaggaggaaggaaagaaaagtgagtggtgtgccggaacaccgacgcttcggcacaccacatccggctctgtcacagtcgagccccactgtttgatccagcgatgaatcaggagtcctaacggaaactccttactgcgcccatgcctcggtcctgcaattccggaacgctacgcgcgcccagtcattgctcgccctcgactaccgtctcggacttcgcccgaggctacctaaaaccctagtgagttttcggctcacgcctcggccagggcgtcgatcatgtagttgttgatcgtggccttgacggactcgaggtgatcggacttggtggcttcgatgagcttggactgcgggatatccagagcgtactcctcgagggaagccagggaggcggtgccgttctcgacggttgcgccgatgccggaatcgaaggagctgtagcgctcggcctgcaggttctcgatgaccttgtcctcgtgcatcttggcggcgaccaggaggcctgctgcgaaggaatccatgcctgcgatgtgggaacggaacagatcctcggcggtgaaggaggtacgacgcggcttggcgtcgaagttcagaccaccgtgagggccgatctggccttcggcgaggacttcccacataacggtggaggtctcgtacaggtcggtcgggaactcatccatatcccagccgatgagcttgtcgccctggttggcgtccaaggagccgagcacgccggcctcgcgggcggtgcggatctcgtgctggtaggtgtggccggccaggttggcgtggttgccttccaggttcagcttgaagacgtccatcagatcataggtgcgcaggaagttgatggcggtggcggcatcgaagtcgtactggaacatcgtcggttccttggccttcggctcgatcaggaactgggcgtccaggccgatttccttcgcgtagtcatggcacatgtggaagaacttggccatgtgctcctgctcgcgcttcatctgggtgttccacaggttctcgtagccttcacggccgccccagaacacgtagttctcggcaccaaggcgcttggcgatctccagggagtgcttcagctggccgccggcgtacgcgtagatgtcggcgaacggggaggtggaggcgccggagacgaagcgcgggttggtgaacagggaggaggtgttccacagcagcttgatgccggtggacttcatgttctcttcgatcttgtcgacgaccttgtccaggttcttgtcggtctcgcgcagggtgtcgccttccggagcgatgtcgcgatcatggaagcagaagtactcgacgccgagcttctggaagaactcgaaggcgtagtcgaccttggccagggcctcgtcctccggatcggaatacttgccgtaccacggacgctgggcggtgccggtgccgaacggatcgacgagctgctggtcgaaggtgtgccaccatgcgacgccgaaacgcagccagtccttcatcttcttgccggcaacgaccttgtcggcatcgtagtaatggaaagcaagaccctcctgcggccccttttcgcgaccgacgtacggaatcttatcgatatcccacagacccatggaatgctcctttgcttggtttacttacgtaaagctttatttcgcagcgggctttccgcccgtcttggtctacataataaattgaattacctaagtttgtcaattcgttaaactatacggcgtttccattggaatcaagccatttatcaatgcagtgatacagtgtgtttgtttgttcgcatcgcggcgcaacacctgcgcggcacacggaagcgcggaatcgaaagaaggaacatatgagcgaaaacgtcgacaccatctgcgtgcagggaggctatcagccgggcaatggagaatcccgcactccccaatcatccaggccacgaccttcaaataccagtcgagcgaacagatgagccgactgttcgacctgtccgaatccggctacttctacacccgcctgcagaatccgaccaacgacaccgtcgccgcgaagatctgcgagctggaaggcggcgcggccgcgatgctcacctcgtccggccaggcggcgaacttcttcgcgctgttcaacatctgcaacaacggcgaccacatcgtcgcctcctccgccatctacggcggcacgttcaacctcatcaacgtgaccatgcgcaagatgggcgtcgaatgtaccttcgtcagcccggactgcaccgaagaggaacttgaggccgcgttccagccgaacaccaaggccgtgttcggcgagtccatctccaatccggcgcttatcgtgctcgacttcgagaagttcgcgaacgcagcgcatcgtcacggcgtgccactgatcgtcgacaacaccttcccgacgccgatcaactgccgtccgttccagtacggcgtggacatcgtcacgcacgccaccaccaagtacatggacggccacggatcctgcgtgggcggcgcgatcgtcgattccggcaatttcgactggatggcccatgcggagaaattcccgggcctcaccactccggacgactcctaccatggcgtcacctacgcgaaggaattcggcaaggccgcatacatcaccaaggccaccgcgcagctcatgcgcgacttcggctccactccggcgccaatcaattcgtggatcatgggcatgcatctggaatccctcggcgtgcgcatggagcgccactgcgcgaacgcactggccgtggccaagtggctcgacgccgatccgcgcgtcagctgggtgagcttcccgggcctcgaaacggacaagtaccatgcgctggcggagaagtacatgccgaacggcacctgcggtgtgatctccttcggcgtgccgggcggccgcgagaaggtctccgcgttcctcgaccatctgaagatggtgtccatcgccacgcatgtggccgatgcgcgcagctgcacgctgtatccggccggcaccacgcatcgccagctcaccgaggagcagcttgaggaagccggcgtcggcatcgacctggtgcgcctgagctgcggcatcgaaaacacggccgacatcatcgccgacctcgaccaagccctcgccgccgtgcagtgagccgcagaaatccgccatctcgcttatggatggcggatttcttcacccgaccgatgctatttcgcttatagatggcagtcttcttgaatcgctaaggccctagggggtaatattcatacc

SEQ ID NO: 3 - DNA, 75754 bp, Bifidobacterium adolescentis WBS-01
cgtcagatagatgttccgataaggcctcgcatctttttgcccactcgtcgatccggacggcaacggaagcctcatcagcatatcagcgttgtcgagacgtcctggatgcaagccgtcgacgctttgtggaagcaggagccaccgttgcacgactgcgacctgatagccgtgagccaagctctcttctttcagtcttgcgtattgttcgttgtcaatccgtgccatgattcggtacgggaagttcttgcgtcccacgttaatctcgcctttcgcttgtttgttcagtgacggtctggcatccggaaaggatgtctccgcctggaccggaagaaggttcttcctcttttggattcagcggtcgatacaaatcgaatatgacatcatgcttccttccggataccaactacgcatgattcccattgccacttctggcgcaaggtattcggtgtagcccataactccgtggaccggcctcactatccgcgtccatactgtctttagccacctcaaatccggatacgaaaaggccgcgcccagtaggtgcggccggaagacgacaggcgacgtcacagttcaacgaatccgagcaatggcgcgaataccgccgccacaccaaacatggccacgatcatgaagacgacaccgagcacgtatgcggcaacgatgatggtggttcgtccagccaggctcccgttcaaatcagccgtcggaccgttcatgcgtttcgcaacgattgtgcacacgcctgacatgacgaccgccatgaggacgagcgtgacttgcaatccgccgttcagtcgtatggtccaatcccatagtccggtgagcatgccggcaacgttttccagaagacgctccattctctgatccttcccattgttggctattgatgaatggctcttcaatcctgatgcggttcccaccagccagcggcgcacggtgtctacacattctccgaacgctttttgtagacaccgtgcgccgtcgagcgcggcgtatcgattcatccttgcagggtatccggttcatcgaaggtaaggagttgaatttgtcccacagcaacagggcccgcgacacaagacgcaacatttcgaaggcgattcgcgaatcccagcagtctcggatggacgcgctcgatgcgttagcccaaggattgactgaaatcagtgccgcgcgcatacggctcaaggagcttgagacgcatgtggaagacttgcgcgtccaggcgaagaatgcgggcaacactgccactgacattcgggccgtggaacgtattgttaatgaactcgctctgaaacggtccgaagcgccggagaacgattccaaggacatggaagagccatccgggatgggggatgagtgatgaccgggagggggaaagaaccgcatccgatgcctcgacccttccgctggctggccatgttcctcgcgtttgtgttcgtcatatctctcggcgtggctgccacctatcgaatgaaacgaaccggcaacgatggagatcttgggagagtcccgtccaaatctgcgcagaaggaggacgtcagcccgcacggtgaatatgccggtttgaaggccgcgggagtccccgttcccggtgaatggtcgcgtcagtcgctcttagccgtcgacgggacgcagaacagtgacggaaacggtgccgcgctatcacctgtcggaggggatgggggaccggtcaacgtcgcgttggagacagtcaacaggattctcaacccaacgcaatccgacgtggaatgggaccggacgatgagagacctcttccaaccggatatggccggattgacgcatggcccgtcgaacatggctcgttactggtggcagcaacgccgcttccaaccggaccgcctctgcacgggaatcgcaaaggacatgctcatcattcagtcctatgactgttcgacggaccgcatgttccaaggccagaatacggaagcgatcaagggtacccagtactggtggacgggcatatcatttttcgatgctccacggtcgatcacggaaaagattccatcgtcgaccgaccctcagaccgtgatttcgcaatactacgacgcggttgctttccccatggatgacggcgtctggtatgtgaccgtcgcatgcccggcgatgtccgatcatccatatctcgacgaaaacggcaatgagctggcgacggaagacgacagcgctccatcctccaagtactggattagcgtcggttcgatggtgggagtcggcacgaaccaacgtccgtgccggccggttgaaatcaccgtcggcgggcaacgtccgttctggtacatcggtgcggacgggagtaactgacatggctgtatcctgttccaccgacctgatgaaaggcttgttccgtcgccgtgtgcttcctatcgttgccatgctgtgcatcgtattgacgaccggtgcgtgcaatccgactgatgtattgcatttcctcgccggctgcaaggatggctcctcgtcggcggaatcctcatcgagcatggtcgcttctactgcaaagggcgactggacgggactcgtcggcaagaccgaaggcgagatcaaacatatgtggcctagccacgtggcgccatgctcaggctataacgtgctgtatggcggctccagattgcaatgcacttggtgggcgtgcatgcgtcagcgtgccctcggccatgatctgggccaaggatcctggggcgacggcggcagttggggagcatccgccaaggcacgcggttggaaacaaggtgccaaagccggaggcatcatctcttgggcgcccggctcgggaggctcggatggactgtatggccatgtcgcagtcgtcgaacaggtcgatggcgacaacgtgcatatcagcgagggcggtgccgggttcaggaattccaacggcgtggccgctatccacacccgggtcatccccattcacggcacgggcgcgactttctggtatccggacggcaacgacaacgccgagcccgtggccccagataccagcaaacgatcctcctcgtcattggccgccacgtcggcgaaatggacatgctcggcatcctcgtcgaacgattcgacgagcggagcggtgaacgtgaaatacaacggaaacgggtatcatgccagtcctgaggacgccaagggcatcgccaagcagatgatcgccagcggatacaaggaatgggataacgacaacgactggcaggcgctcgtgtggatatgggagcatgaatccggctggcggtggaacgccgagaatcccacgtccggcgcatacggcattccgcagtcctatcccgcatcgaagctcgctgctgccggaaacgactggaaggacaacgcggccacccagatcaaatgggggctgcagtacatcaagcaacgttatggcagtccacatcaggccaaggagttctggctgcgcaacaacgcttactaagattccatgaccttatgtgcctttgcctcacgattacacaatctaggagggctggatagaaaagtgattctgcaaaacatcggcgtcatcgcgagcatgcgacggacggtagattgtggagtactaaaacatatgcatcgtcagggaagttcggcttcctgtggataaaaaggagaatgcttgatgacgtgcaccggcactgaagcaaaaagtctgtcgaagacggctatttcagatgaccatccaagcacgctgggcaagacgagcgtggagaaagtcagcgaaccactgacgaagtccgtgaattaggcagacagaggatgcgtagttatcagcaagcgaatgcctctcttcctattgcccgacagcatttaccttggcgtccgataagaggtttcgaacgttctcttggaaatatgcatgcaattttaaactctacgagcgcatttgaaaagaacaaattccgctgcgattcgtaaaggaaagtaaactcatcaaattcatttgcaatgatgctcagcacctgaacggattaatcgttagttttatccactatacagaattcatataacaagcaagcgttttctggccttcctttttctaccattgatttcaatcaacttatggcaagaaagaaacatgatgaaagtagcagtcttttcagcagggaacaccggattggccacagcagctcatctatcaagtcttggttttcaaccgatgttgtatacacgtaactccgaaaaactacgaatgcttcaatcccatgcaatggaatcgaccggcatactggatggctcatggcatataccagcaagcagggacgcgaagcaggttttgaacggtgccagtctcgcaattgtgtgcacatgggcaaatgcacaccgtgcgattttcgaaacaataaagcacgcatggcaagaattgccacctcagcctttgcggattctcgtgttcaacggtaactggggcgcatacgaagcgtatcagatgttttccatggactacatagttccagagagcataaccatcgctgaaaccgctggaatgccgtatgtggcacaagcgtcatttgacagggatcatccggtgccatcagcgtcagtccatattagtggcatcaagtcctccattgaggtcgcatacgcggccaatcatgacgccgaccatgtcatcgattcctttttacaggctatgtacgccatagtacgctatgacacatccgtcttcaccacttcgctcactgctcccaatccaatcattcacgctccgttatgtctgctgaacatgacgaaaatcgaagccggtgccaattacaagatgctggtggaaggattcacggaaaaacagaacggctcatcctagctatcgatgacgaacgtaaagcgttagcgaacgcgcttggatgcaaatatattccaatcggcaaacagctcaatagcttctggggaagtagctatgcgaccctgcgggagctttttacaaacaattcattgtattcgcacgtccgcggccccgcgaacgtttcgcatcggttcatccatgaggatgtgccattcggcatcattccgctggtcaggcttggacacctgttagatgtccttacgccaaccagcgaggccttatcgactatctatagcatgtacctcaacgaatcgttcgacggtcccctgttcgatatagagatggttgaggcattgggaaaatgacgcgacgccgtttcctcccattcagactcatgcaacaacatgttcaatcatgttttccgagctaaacgtcatttcgccatcatcttgctgagaaattccttgattcggggcgactggggattatcgatgacctgttcgggggttccctcctcgatgatgttaccttgttccacgaaaacgacccgtgacgctacattccttgcaaaacggatttcatgggtcacaaggatcatcgtgacgccggtgccggcgacttttgtgatgacatcgttgacgtcgctgacgagttcgggatcaagggctgaagtgggttcatccagcagaatcacgtccgggcgaatcgcgagagcgcgagcgatggagacgcgctgctgctggcctccggacagctgcaccggatacctgtcctcatacccgtccatcccgacgcttgacagggctttcaacgctctttccctggcttcgttcttggcgacgccacgcacgacggtcagaccttgtgtgacgttgtccagaaccgtcttgttcttgaacagattgtagttctggaacaccatcgcggtcttgcggcgtagttcgagtatctgcttgttcggcactttgccgctgaaatcgatggtggttccatcgacgcggacgataccggcgtccggtctttccaaggcattcacgcagcgcaggagcgtggtcttaccggagccgcttggtccgaggatggccagcacctcgcctttgcgcacctccagatccacgcctttgaggatctcgttcccggaaaaggacttgcggattcctttcagcgaaacgaccgtttcgccggtatcatgtccagtcatacagcctgtttcctttcactgcttcttgaaacgcagcacgcataccggcttgccgtctgcgatggtgccttcgagggagaacttcacatgtgggaactgggccgcgaaggcgtggtcgccggccatggcgatctcgcataagcgggcgatctgctgcggattctttccttggcgtacccactgggtgacgtacgggcagtagtggaagtcgatctcgagctcgtcgtcggtcttcttgaccgtttccatctcgtaaatctcacggttgtggtctgtgccgaaattgtcgatgaactcttggaacgaatcgggatctttcagggtcttgcggaattccttggcgttgtcccttccgtaatcggctaccgcatcgtacgcgaattcgtcatcgaggcctcgcttcgaggcctcgtccaccatcctgctgatggtcgccgcgcggcgttccgagatttctcttgtggcgtcgacggtcttgctgcgcagatgaggagtgttgttttcgaatgccatgatcggccttcttccttgggtttgtttggttgttctgtctgaatgtccaatatttacgcgcgtgccggcttcaggaagaatccaacgcgtttgaagagtcgttccgacccaaattcgatggccgcgcacacgacccagtagatcagcgccgcatcgatgtatgcctctaagtactggtatccgtcggcggcactgatctgcgcggtgatgagcatttcggtcacgttgatcaacgaggctaggctcgtgcccttcagcaaccagatgaagtagttggtcatgcttggcagcgatatcacaaccgcctgcgggacaatgacgtgcagagccgtttgcagtccggtcatgccgacggactgcgcgctttcgatctggcctcggtccacggccttgaccgacgagacaaccacatcagttatgtaggcgccgaaattgcaggctatcgccactaccgccgcggggaaatacgagatgtgccgtggattgaagtcatagatgccgatggaaccgagccattttgccacgaacgggaccgcgtaatagcagaagagtagttgcacggcaagaggtacgcccttgatgaacgtgttgagagcgaccaccagctgtttgaacgccggggcgttggacaggatcacgcatccgaatatcagggcgatcagcagcgcgaacagcgtcgaccagaaagtgagtatcagggtcttcggcaatcccgccaaaacggtggggaagtccgtgaccatgaaatcatagtcgagttccatcaggcgtacctcctttcatagcgttccatacgatgtgaggcgaaggtgaagccgacctcgatcaatgagcacagcacgaagtagataatcgcaacgaggcctagtatccaaagctgtccggtgccgtattgtgcggatatgatcgctttggccgaaccaaggatctcgacggttccaatcgtgtaggcgaccgaagtgtccttgagcacgtctatctcgagattcttcagattgaggaccgcgaccttgagtgtctgaggggcgatgacgtggatgaagttctggactcggttgtagccgatgctcagccccgtctcgatctgccctttgtcgacgcccagatagcctcccctcaacgtctcgcagatgaagcatgaaagattcatggccgtcgcgatgatgaagaagaccccgggatcccagtcgtcgatatccaatccaaagaggtagaacaccttcggcaatccaaagaacacgaggtagatctgcacgattcccggagtgccgcggaaaaacgagatgaacaccgtgcacagccagtagagaacgttatgacgcccgaccctgacgatgcaaagcagagtgccgaagaacagggccagcaccgacggcacgatccagtacagcaaagtggccggtaggtactgcagtattctgggcagcacgcctgtcaacaggtcggacggcatgacgtttcacctcgttccgtcgggtcagtccttgagggcgccgagttcacgggccttctggaagttgtcctgcttgaagtacttctcgctgatcttgccgagggtgccgtccttgatcaaggcatcgatctgctcgtcgatggccttctgaacgtcgccgttcttcctgttgtacaggatcacggttcccgcggcgtccaccggatcggtcaccttgagcttgtagccaagcgtgtcggccacgccatcgtactgcgccttggacagatagaccgcatcgtaggtgccgtcatgcactgcgttgaacatgtcctggaaggtctcctgattggtaacggtgggaaccttaatcttgacatcgggattgcgcttgagccaattctgaatggccacgtaacgtccgtctgtcggaacgatcgggtcaagggtcttgccatcaagatccttcaggctctcaaccttgctgtcttccggaacgatgaggttcatgaagaaatagttatacggcttggaaagcagatactgcttggctcgggcgggggtctcgaagaacgcgccgatcagtgcgtcgtacttgccctgcttggtgccgatcagtgcggtctggtagtcgatgacgctgtattcgaacttgtagttgtcgagcttcttgtcgatggctttaagcacggtgaggtcgaaaccggccggattaccgttcttatccgcataggagtacggcggatcctgggactcgagaacgaatttaacggtcttgaccccgttgtcggattccttcgcgttcgcggtgccgcagccggccaacgcccccaacgagccgaccgccacaagtgccgcgaccaccgtggtgaacaatttgttccttctcatttgtcttcctctcttcggaaagcgttgtcgtgtatgtggcatgacggtacgccagaaaaacggggggaacaaaattctcggtcatatgttttgtttataggcagtgccaacagcgcgaattggagccggttgataactcgttataaccctctttcgtctcattattcgaaaccgtcgataacttttgtgcaggggtccgcagccacgctcgaaaacaggaaaaaactgaaagcacatttctgttcattgcgttttataccaagctcatatccgctataacgcagttcgatagcaagaataccgtgcgctaatcatcaacagggttgcaacatcaactatgttgttcatgacagtgcacttcccacatgcatgtattcgagatgatgcatgatttctgttctagccacgcaaaaatgaaataattcggaactcgaatctaagaagagccttcgccgcatgaccagcaccaaggcaatggtcttactggatgggttaccgaatagtgtccaacataaacggacgaatgttcccatccaaacatgtagacatcgtgtcccgttcatcatggatgggacatagacaatgttttcggcgctgtgcgccgtcgaaaagagcgggaagcggtttccgtgcggatattccagccggaaggagtcaccatggaacgggaaaacggtcagctaggggactggaattcggagcgttggacgcgtatgaggcccgccgacgccttcgcgcatcaacactatcgtccaatcaaggctggtctcacaccaaacagcccaataagcccagccatagtgtttggacagcttgccgacatagaggcgatagtatgagcgggagatgggactcgaaggggaacgagtggacgaatcttaggtttccgaatgggtttgcgcacccattcatgtctcagagccgcgacgggagtgcgcatgagcgtatgcttgtggtcatcccaaagggtgtcattctatcggatggccgcaacttgggcggttggaacctgagcgtgccggcatctccatgggcattgatgcagaagcgcactgggagacctgtgaacatcgggctgcgttccgaccagcccgtcgaactgttcaagggacgtggggccaagcggcaagtaatatcgctggccagccccgaggaactgcgcgccgcgctgaatgagcatcgcgacagaatgcttggtcaaaacaccgttcgtgacaagccggccgctattgcgtacaacgtaattccagcgtttggacaaggtgcggggggaggcctcgctgatgcggcccctcagtcatatgagccggcgaatgacgaaggtatgcgtctattcaatgatctcgctttcgatgtcggtttcgtctcgcggatggatatgctcgtatccggattcgcggacgattgcatccataaccgttacgatccggaagcggccttggacagaacccgctcgttgacagagcaggccactcgtcttctggaaccgttgtccggcgtggtcttcagcgatatggcaatcgattgcgccgcgaaccttgcattgtcggcagtgactgacgcgatcaatggttatatcaacgaactcacggatcgcggtgaaggcaatccatccattatcgcggcgaaccatgcggaatacgtcgaagacgcacaaacctgtctgaacacggagcgatgtttgcgcatgttcaccaccgcgtatggcaagacagcagaaactgatgtatttggcgacacgatgtccatcgagaacctatccatcggcccaaacatgatgacgcgattgagataggggagaatggtcaatcccaccgttccaacaacattcgactctttgaatccacctatctggctggacctgtttttagggaatcagccatcacgtcgatcaatagggaaggatcactttcaaccttgataagtattaccaaccaagccgatatcacggatattcacaatccgaaaaacaagcaccctaagatatcttccacatcgtgtgtattcgtcatccagatgttgagattgaacaaaatccaatttgtacttcttgtagcgaaacgatacgttgttttttgtgacaaaaaagttaccgtcagaagtgaatcacaaggagtgtgaatgctgaagagggtaaaggattggctacagcatagccacatctcataccgcaatctcgctgacgagatgaatcaatcggtgagcggcatttgcaaaaagcccgatggcaaaacctatggcccgtccacgatttgccctgactgaagacacatctggaccatccttacgactttgtcatcggcaatacgccgcggatgaaacagaggaatggaccagagacatcgcaccgtttgagggcagatgtcgaataactaaaaattaaaaagggaagtcccatcccatcggaaacgcaaaaccatcagggacagggcttgcatgcgaaccaatggtcggaaagcctgccggggcattccgatcgtcttacaccccctcgaggacgaagaaaggtccacatatattatgatagctgaaaccaccatccaaggcgtttccaacgtcaagtgtagattgcagatcagtactgaatggtacacattgtctacaacatccgacgaagcggttctgatgtcacgacactggtgtcgaagcatggcacggcacagactcataaccaccctaagtaaaccctataaatgttgcgccgaccattcaagtccgatgacggtatgcgtccgcgtcagacatgcagtttcgaaagaaaggagtgtggaaagagatagagccgtaggccgtaatccaaactcgcaacacggcgattgggacaactttggatgctcggtcaagcgcatcgcggacaacgtcgacaggttggagaacaagaacgaggagggcacaggctcatcggctgaggtggatttgcatacagaacgagggaagcgttccgcttcgatggctgcacacccctccgcaacccattccatcaatggggaagggaagcgttccgcttcgatggctgcacacccctccgcaacccattccatcaatggggaagggaagcgtctgtaatggaggccatgtatatcgtgttcgcggccgcggctctggtatgtctcggtctgttgttgccggtcttgtctcttatcgcgaccgtactgtcagcgctcgtcagcctgctaagaagcatcgccaagctgattggcggtggacgatgacagccgggactcttgagaaggtgtacagactaaacgatccaaaaatcagtccgacgatgggcgcggtactcgcatactacgccttccgctcctactacatggacggacgttgcgcgtggccgtcgcttaccacggtcgcgaaagcgtgtttctgcgacgagaagacggtccgccgagcgctggcccgcctatgcgagattggttacatgaggctcagccccgatcagtcatggaatgtgcgtgacacaaccaccggcgagctcaaacgcaggggatatcgcagcaaggtctatgacgtgcttgtggagaacttcgcctcaatggctgacgagggggcttccgaacgtgccggagaaatggtggaaaggcagaccggtcagaatgcccaccctgacgaaaacgttgaaagcatgccgattccacagaccggtcagaatgcccaccctcagaaaagcgacgaaaacgagagtggacatcctgtcccttcagaccggtcagaatgcccaactactaacaaaagaccaactagcaacccctctctccctacgggaaagctccccgcaggcgggaagcgcatcatcgaggagaagaggatggaacgtgtggaagacgccagcgccgatgtgtggagggtgatggatcgtctcgcttccgtccgttccaggctggcgctgtctacgtcgaaacctaccggacgggattttgcgagaacttcggatctcatcggacgtgttaccaaagccaatggtgataatcatgcggtcgcgatggctctgatcttcgacatcattgactggctgccggcgaacacacattggctcggacgcgttgattccgcacgccatcttgccgacaactgggaaggcatcgccaacgactggaccatcgtccagatcaaacgccgtcgcgaacacgacgaagccgcccggaaccaagatcggaaaacagtcgacaaacggtcgttgattcccgacagtcactcgagacgacacacgcattcgctcctttgcaagcatgtcatcgccgacatgaggccacacgaggatgaatacagccatgagggaagtctgcgctacggcaagccgtcagaatggcagaccgcgtgcatgcggcacgcggacaagctcaaccgacgagatggaatcaaggtgacggaatgaccggagaatccaatctcgtcaccggcgtctgctccggtcttccactaggcatccaggatctcatgtggggcaccgacaacgaacgaatcaaaagcacatccgaccagagggtcctgaaaagcaccgcgcgcatcctgtgcgacatgtgtcccatccaggcccagtgcctagcccaatccatcatcagccgcgagcagcacaacagaatcggcggcctcgatgtcaaggcgcgtcgcatactccgccggcacgccgaagctgatggagtgaatctgtcgccatcgagcccagcgcggacacggaatcttaccgtgtggctccgggagcatcccgaactcgtccgagaggtccgcacgcagtcgaccacccgtgaggggaggcggcgtagaagtgaggaccagtacatttatcggcatcgcaaagcgatgcgggaaaaggccggcgaagcatagggcatctgatgtgccgggcaggcctggtcccggcacgtcttatgtccatcgaacttgtagacaccgtgcaccgcggcgcgtccttcagcaatccaagatggaagcacgggaaacgacagagcaacgtccgattggaaaggctggcgggaatggcacaggcgacacggcagcaggtcaggaacatgcatgggctgattgaaaccatgaaggaacgcgaatacgttcctggtgagtcgaaaatcaccgacgaccgaatcaccgacacgttgaggggcatggccgaaccgaacgggctgacggatgcggtgatagccaagatcattcgcccagacatgggattcgacgagttcgagtccattgccgacttggaggaaaaggcctcgtatgacgtgttcgacacgcttcgtgccattatgctgccttccggctatgacgtgtcgcacgccatggcacgcgcgttcaaacaggatattccgcgccttttcgagcagttcgcgatactgatccatccggcgtcggagcgtgccggggcctatcgcatcgcggccaccatcagttatctcgaaggagattccacgattcgctgcaagcattttgcagatatgctgttccaggtcaagcccgaggacgagatgctccgtaatctctccaccgcgctgatccatggcgtggagccggatcggccatccggaatcgaagatccttccaacatccgaaaccagcggatggacaacgcgacgctcggagcgactgccgccgaatccgcaacggctatccgataaaggaaaagagcatcatgaacgcggacaacgggtatctccccgctttcgactccatgccgccattgccaccgcacccgtcggcacgttcccgaaaccggccgaacgaaagcgtctcgggaatccatccgacccctctaaatcctccaatgccgaatccgatcattcccgcacccggaaacgatgacgggcgctcgaagatattcgccgcgcagccgatccaggtgccgccaccgattccatcgttcgccgcccggcccgctccgggccgcatatggctggtgggcgcgcatggcggatcgggatgttccaccatccgcatgagcgcaaaagacaggtacgtggacgcggggcgcgcgctgcccgtcagcaccgacccacgtgtcccaagccggatcgtgctgtgcgcgatgtgcacgggacgtggcctcgaatcgctcagaaatctgctcgccaactggaacgacgggctcttcggcgcgagcgtccttatgggagtggccgtgaccatgccatcgccgagaactccgcgcgaactgcgcaggggaacacttctggtcggttccgccgcaccagccttgtggcggcttccgttcatccgcaatctcgacctcgacggttttcccgaagcgtatccacatgcgtatgagaggatgctcaaggatctcaacgggagcatgcaaacggctgacggcatcagcggcaatggctaaccatccgtggaagcgcgcttcctggatgccgtacgctcaggccgatgtattggccgcggcctcatcggctttgacacggtcgatggctatcaccagtgccagaatgagcacgtccagtcggtcatcaaggacccgcacctcataggagtctccccaagagaggagcttctgccggatatacgcgaccttggcgccgtccatcgacgcctcgaagctcagatcccaccagtctcccgtgatttgcaatcctggaacgtcgatgtcgtaccggtcgcgaaggaacgtgaatcgtttgctgatggtcgcttgtgtcaatccttccatggtgacggtgaagcgggggagcaacgagaacacctctttctcgatgcgtgccacctcgatgccgtcaaccgacgtgatgacgaatgatttcggaatggcgaggaagctgccgcgcacgtaatagcgtgggttgccggcgatgtcggtcaccgtgaatttctcaccgattgagaacaccttctgcttgacatacatcgtgctcatcgttgatccttccgacaccatctttacggcttgaatcttattggcaatcttatatgtcacaaatgacttcgccgtctgccggtagccatgggcatcgagatggaacgtgtagacgccgtgcaccgtcggccagcttggagcatgcgacggtggaaatgcatggtcaactacatccgaaggagaaaccacacatgatgatgttggaacgcatcgcatccgcagccgatacggtgcaggacgccgcatacggtatggtcctcgccgacctccagaacccaagggcgtgcctgcctcccggattctccagtccggtgaccaccgcgctcggatgggtcaaggccctcggactggtcgtcgccattgtcgcactaatccgcattggcgtgcatgtgctgcgtcagcagggcgacggcgtgcccgacagggacgacacattcgacaagatcatcaattgggtcgtcggcatcttcatcgtcgccggagctttggcgttcatgagcgcgctcggactgtccatcgcggaaagctgctgaacggatggcaagccggcgcaagggacgcctgtccgcgatgcttctcgcgctggtggccgtcttttccctgacggcctgcggaggaccgaacttcgatgcgctgaaggatgacctcaaattcggcgacgaagaaatcgccgacacacagaccgtatattccatgaagattcccaaaaacggcgtgggaaaactgatccgaagcaaccagatcgcctatgcaaaggccacatgggcgaatgccatcaatccgtacttcaacggcaatgcgagaaagtatctcgcatcggtccccgcgaaccaatgcgtcgcccttgccaacacgtaccaggaggagactcctgacgcgggaccgtggaactggaacgcggccaacaattcctgcgataagacccgtaagctcagctggctcgagaagaccatgtggacgatgtacgagcagcagtccgacgatacgattgaatggctcagcacgacccgcaatacgctcgttgccgcgccgggtactgtggacacgcttcagaattccatccttcccatgtatgacacgtgggacacgaacgtcaacaaatacctcaatgtcgcccaggccgtactcgtcgtcgcggcggccatcagtctcatgatcctcgcggcgcgcatcatctggcaaatcggcaacggctcggctggcatggacgggcatctgctcggcaggatcggctggattttcctaggcgtgttcatggggtcgtccgccgcgagcatcgcgctcacgttcttcaaacaggcgaatatgacgcgcaccgtcgtcaacggcgtgcccacggccacggcgggacggtccactcctgcgctcacgtcatggacgccgggagctggaacctcgtttttcgtgtccgattgggtacggctccaggtcgatccgttcctgatcatcgcggctgtatgtggtgtgatcgcagccggttttaagctgatcaccacgcaagagggacgtgacttggtccctttgggcaaggcgttcatgtggtccatgctcaccagcgtgtgcctcgcgggattcgtcaatctgttccaaggcactgtggacacgtggacggccggcgtgctcaggagcgcgtccgacatgatgaagtcggcgtggagccataacaccctcgccgcatcagaattcttcaatcttgactggccgattgcattggtgttgaccatcgtcatgtggttctgcaatctcatcagcaaggtgttctgctatctgcgtgccggtctgctgcccattctggtcggcatcgcgccggtgtgggccgcgatgagctggatggagactggacgccaagcgttcggcaaggtcatggggtggctgttcgcgttcctcatgtacaagcctgtagccgcactcgtcatggcgacggggtgcgcgatcatgacgaccgccggcgccggcgatgacagccaggccatcaccctcatgctcaccatcagcgtaatcgtgctgcttcccgcgatgatcaggctcatcgtcccttccgtcgcaggaagcatcggcggcggaggtgtcatcccgtccatgcttggcggaatggccggtatgggcgtcatggcggccggcggcgtgctcaaagccggcgcaaagggcgtgatgggagcgaccggcgccctgtccgggaaggtgaagccttctgttccgaacggcgcgaaacgtgccgtcggctccggagaaaacgctggagcaagtggcatcggatccggcatatcagcgcccggccggcccggaagtgaggtggccaagggtggcggtgagaccatgttcggtggttcctccatgccggacggaacccgtgcggctggttccgttccgaagggtgcggtgggatcttcggcgtcgaatggcgtgaagacgtccatggccgatgacgggaccggttccgtagacgcgccttccggaggaggcattcctgcggcgccgccatcatccggctcgggaggcgtacggccgtcctccgttgcgcagcagcctcggaaagacgttggacggcgggttagcgaaccgtcagccatacagagggtccgggcggagttcggcagtgttccggacggagggccgcacggtgcgaaccgttcgggcgcacgtaagacaaaggagttctaaatggcttccaataccacttacggcgattggatgcgtcccatcgccggcggcattcgcaacatcggcagaccgttgacgttcgcgggtcttggcgtactcgtggccacgctgatgctgtccatggttaacgtggttgcggccatcgccaccgcggtcgtcggcatcggtgtcatcgcgatacttgccatgcgcgacagggagcaccgcaatgtgcttgaccgtactgtggagcgacgcacatggctcgccgaatcaaggaagggacgggcgttgtaccgttccggcatgctcgccccggtcgaatcggggcagtgccgtctgcccggcatcttgtcgcgcgtctcgctcgtcgaggcgaacgatgggttcggcaaccggctcgccctgatacgtcacgggcataccggcgaatattcgctcccgttctcatgccagccacagggcgcgtccctcgccgatgacgatgtcgaggacgcatacgtcgcctcatgggccggtctgcttgagtcgttgggaggcgagatgggagtggcccaactgtccgtgaccgtcgatacgtcgcccgattctggcgtgcggttccgccgcaacctcagcaagcgcaccgttcaggacgcgcctgaactcgctgcaagggccatggcccagatcatggacctgtatgcgactggcggcgcttccagcagcgtcatcctcacgcttacgttccgttatgtcgacgcgcgcaacggaagattcctggaaccagacgaggcggcccgccgtatcgggcagctcgttcccaatctcatccgccgcatcgcagacgcgggaggcgggaccgcccgcacgctcaccatcgacgagatcagccgcatggtccgtgtcgcatatgatccgggcgcgcaggattcgctcgagcagaccgacgggcggccgtggatcgaatgggaggatgccggtccggtcgcttgcgaggccggctgggaccattaccggcatgattccggtgtgagccgtacgtgggagatgtgcgacccgccgaaatccaacgtgaccagctctactctggcgcgtctgctcggtcctctcgcagactgcgaccgcaaacgcgtcaccgtcgtgtttcatatcctgcctcctgacaagaccgcgttcatggccgagcagaacaggcagagggccgccaaccaggtcagccaggagaaacgcgcgtccatcagtgctatgagccagatcaacaaagcgaaccgtcaggccatcgaaatcgaccgaggtgcggccatcgtgttcttcggactgctcgtgaccgccaccgtgcgcgccggcgatgacgagcgcatacgtctcgaacaggccgcgcacgccgtcgagggcgccgcgggaagcgcgaagatcgacctgcggccatgttatggcgcgcaggacacggcgttcgccgcgagtcttccactcgggctcaatctcagaacctattcgccgcccaacgcgctcaccgcgctctcatgaaaggaacgcatgccatgcggaacacgaacacgaaagaccgaggcatggatccggacatgccccttctgcgccggcatatgccatctccgtcgccggagccaatctggagggggcggcgagcaaggggcggcggatgggctggactgatgcccacggtcgacgagttcttcggcaccagcacgcaggtgtgcggcgggttctggccgtttgtcaccgacatggccctgcccgtcgagggcgtgcccataggacggagcatggcgaccggcgcgggcgtgtgctgcgatccgatcagttggttccgggccggcatcatcgaacagcccagtatgttcgtcatgggtctgcccgcaatcggcaaatccacgttcgtgcgccgccaagcatgggggatgagcgcgctcggtatgaacgcgatcatccccggcgatctgaagcccgactatgccgaactcgtccgcctgcttggcggccaggtcatccgtctgggcagcggacttggttccatcaatccactcgatcccggcggcatccatgacgcgcttaaacggcttgccggcaaatcccgcgaggatttgctcgccgactaccatgaacgccgtagcgctctcatggaggtgctgttgaccatcagtcgcacgggccgtgaggagggacgccgcaccgtatccgacgtggagtcgaacatcctcgccaccgcgctcaggattctgtacgagcgtaccaagaacgatccggagccacccgttattcccgacctgcgcgaccttgtcaaacagggcacgccggagatacgcgcggccgccgtgttcgacgaccctgagaatgatcaggcgtatgcacgcgccgtgcgcgatctgctctccagcctgcatgggcttgcgaatccgatgggacggttcggacgcttgttctgcgagcagaccaccgaacgaatcgaactgtcccggccggtcgacttcgacatcagcgcccttgcccaagccggtgacgatgtcgtcgccgcggtgctcgccgccacatggtcgagcgcgttcgcggcgaagaacgcgaccgacatgatggccgaggccgggctgctgcccagacgcaaccacgtcatcatcatggacgagatgcatcgtgccctgcgcgccagtccgctcatggtcgaccgtcttgatctgctcacccgcctcaaccgccagtggggcgtcggacagatcatgatcacccacacgtttgccgatctgctgtgtctggacacccaggcgcagaacaacaaggcacgtggtttcgtggagcgcagcaagatcaaggtcctcggggccttgagccgcactgagatacagcattacctgcgcggcgagtccggcctgcctatcagcatgcgcgaggaggacatgctgtccgattgggccacgcccacgaattttgacgcgaacgcgagcttcaaaggggtgggcaagttcctcatcaagctcggcggactgcccggaatccctgtcaccgtgcagatgtgcggcatcgagcattccggatttaatgacacgaacgcgaagtggaaccgtcgatgatcgccatcgttccccatgcgattaccgacacggggctcggcgtttcaatccgtctcgccattcgcgatctcgccgtcgtcaacggatacggcgacgcgttgtcggtccgtcacgtgcgccgtggcgcggatgacgggctggaccggccgctcgatgccgcttcggtcgcgatcggcgcgcgcggcttcacgctcctgttctgtccccgcgccgtcatggagcccaatgcgttcatcgcgcttgtcatcgaccacgcgggccggatcatctggcaggaggacaccgaccatcccagttattatgagtcgtacgaccttgcgcgccgtgcattcgctcgtctgcatcgtttcgagcgcgaaaacaggagacgggtcatgacgccgtcccgcaggacaaaaaaggatggccagtgaacgagcgtgagcaaggcaaggtcgtccacatgcccgatttgctcgatccgaccttggatgagcttgaactgctcgccgaatccataggggagaaggccgacgggttcgaactggatatgcctgacggttcgaccgcgcgcggctaccgcacgcccggcgtccacggtcctctgccggatggctggcacgtttacgacatcatggagtgcgatagcgatcggtggacgccgtacccgagatacgaggacatcgatgaggatgagcgtgaggatggcgagaacggacgctatgagaccagtttggccgtcgacgacaatcccggaccacatttcgtcgaccaaggcgacccgttcgtcaccagatacgatctgactggcgttgattgggagttcgacgaggatcactgtgggtatgacggtacgcaattgtccgacgacatcatgcggctctccatacccgtcatatccgaatccgcttgcggcagagcggattcgatgatccgctgacggaatcgagaagaccggaatgcatgcggccggacgcatatccgtccgtctacctccacgtagacatcgtgccctattgcgccgtccatgaatgtcgacaatcgctttgaagcaacggcatggaatgccgtgacgggcagaaaggcggacgacatggcgaaacggactatcagcgagacggaattgcgtcagtggatcgacgaatggggagaggaatcccatgacgatatcctctccagcgacgacgaatcggatatagccaacagaatcctggaacatcatacgggaggctcgtatccggacgatgacgactgggacgaggcgtggaaggcgttgcgggacataatccgtcccgcattgaaacatgtcgacggagttttcccggacggcgcgaaagccctcgcacggtacgtgcgcgagcttggccagggcatcgatcccgaaaccggtgaggaagccggacggagggacgatgagaagccccgtcgcacgtcgttccggattcgtgccatcgcccacgccgacccggtggaggaaccgtgtctcgacaagatcatccaggcagccgaagaggactaccgtcatgatgtgctcgccggaggcgacacggcgcgtatggattggctcagcgccgccgcgtacgaatggcggcgtcttatgcttgagccgcacgcgccgaccgacccggtgacggatccgtccgcgttggcaatcatcgcggtgggtttgcggcatgcgcccgacgcgacccgcgccatgatggccacggatgtgctcagtcccgacctaccggacatgcgcgagttgagaggcatcgccaccaccgcggaacaggacgtcccggtagtgacactcattcctaacctgattgggcaatggcccgacgccattcctgacagggattcgatactcgaccgcgatcatgcggcatggcgcatcctctcgccgattcacatgaacgcgtccactcctgtcgaggggcgtatcgaaggattgctctccatgttcgaccatgtcgaatatgacggttcgacgcatggcatggaacgtgagcatgccgaacgcgcgctccgtttcgacccgtcggaccgtttcgcctccgcagcgctggatgccgcaacaggcccgaatgaaatgactggcctggtggaatgctcagaccacgtggaagatgggaggatgaagcgatgatcgatgatcggggccgcgcgttcgacatcgaggacgtggagatgaagaccactgcggcatggcggaacgggccgcgggccttcgacgcggaactgccggatggacgggttctcggacatgtcatgccttatgagggcaggtggttgtggcgactgtcggacgatgtcgaatggcatgatccggagccggtcagaggcggcatcgcgcgattcatcgatccggatgggcgggaagcggccatcctgaatctgctggaagccatcgagacgcggtattccgcatcgggcacggacatggagcgcgatatgggcgaggctttcacggatgcggacatcatgacgggcgtggaggatgccacggatgcgagcggcgtcacgcgttgaacgacggaaacctgtagacgtcgtgttccgtggtgagaccggtaggggcgcaggatgacgtgtggaatgccacgggcgtcgtggcgtccttctctgcgatgaaaggaaattgatggacgtcgatccgaagctccaaaccaatagggtcgccgatctcggacagactgtcagaccgtccagtcgagccgcgggcgttgcgctgctcaccgcgttggcggtcatgtccgtgttcggcatgatgtgcgcgatgtccggccatggctttgacatattcgcgcttctgtacattctctcgggccaatgggaattcacgcgcgcgcaatggacgctggccggttttcttatcgtcttgaccgcaatactggccggattgtgctggtggctcgtctcgcataaggtcgcaccgaaggtcacgggaagcgcggaccgcaccagggtcgatgtgtatgcaccggcgatgggtcatggcaatgccgttgccaaggtcaccaggcagcgtgcggagaaaatggcatcccggcttgtcaaggatttcgatcccaagcgcatggagccaggctatccgctcggccgtaatatcgttgacggaacgccgatgagcaccagctgggaggacatggcgatcgtgctcgccggcccccgttccggaaagtctctgtgctatgcgatcccggcgatctgttcggcaccaggaccatgcctcgcgacttcgaacaagggcgacatccttgatgtgacccggcctgtgcgcatgcatgaccatcctggtggacggatttgggtgtttgacccggaacgcattgccgagccgaaccggacgcataccacgtgggtgtggaatctgatcgattccatccacaccatcgcagacgcgaaacgtatcgccgactgttggcgatacgcctccggacagccggccacaggaggcgacgacttctttcctgggaccgccgcccagcagctcgcggactacctgttcgctgcccatcttggagacaagaccgtttctgacgtgttccgttgggcgtcgtccgaacgcaataccgagcctgtgaccatcctgaccaaacatgaggggtatggcgagatcgccagtcgtgtcagcagtgtcatcgcgttgactccggaaacccgtagcggcgtgttcggctcgttgcagaccatggtggcgttcctcgcagatccggacgtgatcgaatgggtccttccccgtgagggggacggcactccggagggcagggacgtgttcgatccgctcgcctttgctaccagcgagggggacacgctctatctgctgtccgcgcagggccgtccttcgaccgcgttgacggcgagcctgaccgcggtggtcgcgttcaccgcgtttcaatacgcgcaggcagaatgcgcggacaacagccggcgtctacctagaccgatgtgctgtgtgctcgatgaggccgcgaacatctgccggtggcccgaattggccgatgtgtactcgtatttcgggtccgccggcataccgatcatgacgatctggcagaacccagatcagggcaaagccgcgttcggcgagacgaacttcggtagcctgttcaacaacgcgaacatccttgtctacttgggtggcatcaaggatgcgaaatggcttggcgagatcagtagcctcgttggccagagggagattgtccggggcagcctcaatatcgacgggcgggggagacgcagcgtgaacaatagcatccagaaggagaacatcctggatgtgtccgacttggccgaatggcctgtcggccgggcgctcgtactcgcctcgcagtgccgtgcacagattgaccggaccatgccgtggaccgaaaaccatgtctggaacgacatcatccgcagagccgcatgacatgggcttcggatcattcatcgaaaggttgagcatggcgttccatagaaatccttcaaaagacaaagagttccaaacaatccgcaaggcgatggtctttccgccgaacttgtcggccgatgcgccggcagctcctgttccacttccgtggtcggatgcgcttccgccagagccgcctgctccaccgcaaacggcttccggaaacgtgcgggtcgaagaactgaccatcgaggatgggccggagctagaacgcgcggtcgctgccacatttgccgtagatggggttaaggacgcgaccagatacgggttgaccattccttttctccgttggcttatcgcctacaaggccgagctcacggcagaggatttcgccgtcgtctcgcgggaagatctgatccaggtcgaacggaagcggacggatgcgagacgacattcgtcgaactccgcatatcgtccgcggccttcccagatcggcatcgagcgggagccgaattcgaatccaaagattttcgatgccacgacagtcgattccgagggccgaacttccatcgccactattcagaatggaggtgagcctgcggatggaaacgggatcgacgatgtcctatccacaccggaatcaagggagataggtgacgaccaggccgaacgggaggctctggtcggccaattcggcgcacgcacgcaaatgcgtgacacgtactatccgaacctcgcttgtttcgtggaactgcatgtcgcgaacatgtggccctaccaacagggcgtgatgacgaagttcctatgggtaccggactggtggcgctatccgccgctcatctaccagcttgacgcgctgtggcgtgcctacgagaacgcgcgacggcaaccgggacagatgatgatattcagcatccaggcgttcggtctgctcgaccgcgtgttcaacaaggacaccggtctcgtcgcctctcttggcatcgacgagaccgagcacacgaccggcccgaacgaaccacttccatgtatccggcctcctaggggctggcggcgcaaggccatggaaccgctgcgtccaatccgacctaaggacatggatgaaccgatacccaccgtggagatggaaaaacaatcacaccgcatgataccgaagatgcgctcgtccagtaggaatcaacgaaaacaacaggaaggaaatcgatgatgtcagcgatggatcctgatgacgcactcgaccagctgcttaacaacacatggagcaacatggcccagcagttaggcatgctgcatcgttccctgagcgcggacgcccagcagcatcggagggaacgtagggcggagcggatgcaacaaaatcggcttcaggctgcggaaatcaaagagatggagctgcaacgcacacgtctgttgtcttgggagagcgcccatcgacgtgaattgaacaatggtttcgaaagtgtactgaacgcgaccgtactcggtaaaaaaggttgttcaccgttaagcgacaccagtctgctgaaggcttggaatatcagcgacatgctcgtggggacggatccaggatacgcagcccagctcaaccgtgcgcggaatcttatgaatgcggaatggtcgaaacgccatcctggcgagacgattgaacaacatgcggaccgagtcacgcgcaacgtgactatcgcatatgcggctcgtacgcccgcattggaggatacgctcgccgcgtttgagaaggccggattcactgtctccttggatcggcaggagctgtccccaaatgagttcgaggccctgcatgacggtgaaacatttcgggtcgaaccggagttcggcgagggttggaacgggcagaggaacgacctgatcgccgagtgtgtgatgatgcaagccgtcgtgtccgtcgatgaggcaggacaacagatcagctatttacgcgatgctggactgccggaatcatctggtggcgacaaccgcagcgaaggcaatgagccctccagcttgttcgagggatccatgaacgaaaacgaaaatgcggctctcctttccgacctgccgctcccatccgaatccaatatggaaaaaccggataagactgctagcgccatgattgtttcctcttccgaagtcggacccacggagaggagaagagaagaagtcgtcgaggtcaaaaccgggggagacctatccgccaccaggatagagaccgttgatgatggaaccaatctggttgacctgtatgaagcagaggaatggaatggtccagatatgtttggcgaatatagtcccaagcaggaggcgtcaatgatgggtagtaattcaccaatgccggcagggaacatcgcgttaccggacattcgcactctcaaacattcagataatcgataataggttatatgtttcttatataaattctatataagaaacatataacctccatacaacatcacttcatccgccgacccacaatcaaaaacagtcaaatcgacttcctcgcaccaccccaaaaatatccttgcgaacacatacccaagccccgcttaagtgttgttaccaaaaagtgatacaacgtttattttgccggcaaaatcaacagagaacatagaaagcgccccgtaaacacgaatccagaacacacctcggatatagagaccacttcatcacatgaggcaaaccacggcgagagtcgcagtgaatccgccgctcaaaataaacccgcaaatcaattcccgatgaccccaagaaggggatgctacagtccaaaaaactatataatagttatatatatcttatataactattatatagttatgcagatatgtcacatcaacgcaaccgattagcgacaataaaaaggtcccgcattatctaaagtgttgtaccctcaatagtcacaacgcttattttcaatagaagctaagcgttgtaaaagaaccagatacatcacttatttttgcggcggccaaaaatgcaatcatcccaaagttgccgaaccatggaactcgcggtttcgatggtcgtacagacaaaacgggcattcatcctggggtgatataccttccagatggtctctggcaagaccgacatcgaacagagactggctggtgaagacttttccccatccagtgatgttctgccagaatccctcatcatcagatttcccgctaacgagagagcacgaatgagatgatgatgcgcgcctagcaaattcctcgttacgttcttttttcctggtctcggcaagagtgggcacatgcgtggaggaagggaacagggtaacaccattgctgtcgctgactgtcaaatcaagaccatcccatgcatccctcacatgaaccaaagcagctttaaatgtctgcttgaattttttcatggtctgagcggagcttccgaattgtccgcgaagctgttcccaagtcaccagtgatggctgacgcagataggacatccttcgattgagccacaggtagatatccaaagagaggggagacttgatcttgttcagttcgcgaaggaccctgaaatcaacaggtaccggattctccttgaccacctttttcacaaacatttcggagaactgaatccagcattccttatcctcgggatgctgagcccattcctctgcatccacccacggaacatgccaggcctcggcgacgacgaattggcctcccgaatcaatctggtcctcgccaagatttgtgattgtgtatgcggttctgagccagtagttgaattgattgcgtaaacgtctatactgatttcctccccgcgtaatgcctaagcggtgttctgcaaattcgtaaaaactttttccgatgacccatttacggctggaggtatcccaactggaatcgttggtcaatatgagagtggcgacaatggcgtcaagattacgcggcagcttgccataaggcatgcattcaccgagagcggtgaaggtcacctcgacattgccattccgttttacgattttacgttccggggttttcttcaatggaagagaaacaatggaggagatacgtgatatgtacccggtatcagcatcgaagcgggagacttcctttttgggcatatcttttacctctggactttggcgaaacggcggcatggggtgttgttatttaggtaccactgtaatgcatagtggtgtcattcgggtaccaaaccgtatgaatagtgtcattctggtaccaaagcattgtcatttgagtaccaaatcatgtcttctaggtaccgcttggagcatctccccgtcatctgatttcattggtggcgatgtctcctccccctagattgctccgtgtcttctaggtaccattccaatacgcgtcgaagtccattttccttagaaaacattgggattcaccaccaaaaccgaagggaaaaggacatttcgtgtcttctaggtaccagctcgtgtcttctcggtaccaccagaatccgcgccgaaggtcaattccccctagaaaacattgggattcaccaccaaaaccgaagggaaaacagcatttcgtgtcttttgagtaccaatgtgtcttctaggtaccatttcgtgtcttctaggtaccatttcgtgtcttttgagtacttgaataccctcggagctctactgtcgcaaggatttgaggggaatcccctatatacctatatacctatactagaaaatagattcgtgtcttctgggtaccagctgtagattggtcagacaccttgtatctattctaaatgttgtatctaaattaaccacaacatttatcttgtctgtttcaccacatcatttttcaagaaagtcaactggatcacactggagagcttccgacaaacgtctggcagtatctagcctcatgccggaggtagagcggtagccggtctcgaaccaagaaatatttggttgaggaattcccgtcatttcagacagctcactttgcgtatagccacgagtcctacgaatctctctcaatccgtcttcagcacaatgaattccgcctcgccatccgctatcggggtgtaaatctaaaacattgcaatgcaacgctttggatatctggcaagcagtgtccaaatgcatgttgcgtacactttcgggattaccttcaaacatggcaagacgttcatgatcaacgccggaaagattggctagttgctctagtgaaagccctttctcgagccttatctcttgcatccccataagcaacgcctccatgccattccctcccttcaaattatcactaggttttctcccaccctccattcggcctaccggagagagaggttcttttcccgatagtctgctgtgaattcaggcttgaattccacgcgacccacagaataacagaacgccctcaacgaactactttgcatgattctgtcttatttgcaacctagctggttacaaaccgcatgaaaaagccagatatggaaagatacattttcaacgaaagaactttccgacacgccgagggaaccgttgcgcggcaacgcctcacgccatacgcgcgggacgccgatttgcgtggacgggcgggaacgtgtaaattaatcccttgctgccgctcagcgagtggtccggttcactccggattgcgaggtgggtgagtggtggtggtttgagaactcaagagcgtatttgtactacttctttatagtcaatgattgccagttcgttgccggccacgctgacgcgtggtgccgagggatcggtcaaacggcggcgaggtttttgtgcgatgcgcctttccttataaggcgatcgtcaattttcttattttgagagtcattcaattggttctcttcatgaagttttttgtggagggttcgattctggctcaggatgaacgctggcggcgtgcttaacacatgcaagtcgaacgggatcggctggagcttgctccggccgtgagagtggcgaacgggtgagtaatgcgtgaccgacctgccccatacaccggaatagctcctggaaacgggtggtaatgccggatgctccagttggatgcatgtccttctgggaaagattctatcggtatgggatggggtcgcgtcctatcagcttgatggcggggtaacggcccaccatggcttcgacgggtagccggcctgagagggcgaccggccacattgggactgagatacggcccagactcctacgggaggcagcagtggggaatattgcacaatgggcgcaagcctgatgcagcgacgccgcgtgcgggatgacggccttcgggttgtaaaccgcttttgactgggagcaagcccttcggggtgagtgtacctttcgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgtcactgacgctgaggagcgaaagcgtggggagcgaacaggattagataccctggtagtccacgccgtaaacggtggatgctggatgtggggaccattccacggtctccgtgtcggagccaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacagccgtagagatacggtttcccttcggggcgggttcacaggtggtgcatggtcgtcgtcagctcgtgtcgtgagatgttgggttaagtcccgcaacgagcgcaaccctcgccctgtgttgccagcacgtcgtggtgggaactcacgggggaccgccggggtcaactcggaggaaggtggggatgacgtcagatcatcatgccccttacgtccagggcttcacgcatgctacaatggccggtacaacgggatgcgacaccgcgaggtggagcggatcccttaaaaccggtctcagttcggattggagtctgcaacccgactccatgaaggcggagtcgctagtaatcgcggatcagcaacgccgcggtgaatgcgttcccgggccttgtacacaccgcccgtcaagtcatgaaagtgggtagcacccgaagccggtggcccaaccttttttgggggagccgtctaaggtgagactcgtgattgggactaagtcgtaacaaggtagccgtaccggaaggtgcggctggatcacctcctttctacggagaatttcaggacacggttccgtgtccggtgtaagccccgtgctcgtggaatggttccacggtctcgcatggggatgctggtgtggaagagatcatgggcttggatgtcccgtcgggatgtccgggagtggtatgggtatgcttttgggctcccggaccgccaccccacaggttttctgtggcgcggttcgatgcccatgcgtggtggccggtcctgggtggctggtcggatcgtgtggcgcgtggtggtttgagaactggatagtggacgcgagcaagagaaactgaaagaacgtttctttttgcttatcgcgatttcgccaaactcttcaattgagtttggtttcgagatcgatcgttttgtgatcattttagtgttaagatttgtcgtctggcgatcttgctatcaggaaacccgcgggtggggcaatgacaatttgttttgctgttgtgccgcttgcgagggcgtatggtggatgccttggcagacagtaccgatgaaggacgtttgaggatgcgataatcctaggggagcctccaacatggctttgatcctagggtctccgaatgggggaacccgccggccgtcatgggccggcaccgcctatgggcggggggtacgcagggaagtgaaacatctcagtacctgcaggaagggatactccgtgagtagtggcgagcgaaagcggatcagaccaaaccggttgcgcgtgatacccgtcgggggttgcgttgccggtgttgtgggatcacgtgtcccggttccgacggaccgggcgggagtcataaaacggcttgccaggggaacaggcttgaaggcctggccgtagagggtgccagccccgtacctggacgtgagccgtcttccgatcgtgttgtcccaagtagcgcgggcctcgtggaatcccgcgtgaatcagcccagaccgttgggtaagtctaagcatacctgtctgaccgatagcgtaccagtaccgtgagggaaaggtgaaaagcaccccgggaggggagtgaaacagttcctgaaaccgtgcgcccacaaaccgtcggagcctccttgtggggtgacggcgtgcctatcgaaaaatgagtctgcgagtcagtggcgggtggcgagcataagccgtgtggcgtatgcgtagcgaaagcgagtccgaatagggcgttttcagtcgcttgtcctggacccgaagcgggatgatctagccctgggcaggttgaagcgcgggtaagaccgcgtggaggaccgaacccacctgggttgaaaaccggggggatgacctggggctaggggtgaaaggccaatcaaattccgtgatagctggttctctccgaaatgcatttaggtgcagcgtcggttgattgcgtcgcgggggtagagctaccggatgcttgcgggcccttgttgggtaccaacagcagccgaactccgaataccgttgacgtgtattccggcagtgagtcggcgggggataagctccgtcgtcgagagggagacagcccagaccgtcgtctaaggtcccgaagcgtgtgctaagtgggaaaggatgtggagtcgcatagacagccaggaggttggctcagaagcagccatccttgaaagagtgcgtaacagctcactggtctagtggttccgcgccgacaatgtagcggggctcaagcacaccaccgaagacgcggcagcaatcttcatggttgctgggtaggagagcgtcctgcgaggggcgaagcggccgggtaaccgtgccgtggacttcgtgggagtgagaatgcagacatgagtagcgagagacgggtgaggatcccgtccgctggatgaccaagggttccggggccacgttcgtcgtccccgggtgagtcgggtcctaaggcgaggccgacaggcgtagtcgaatggatgaacgggtggatattcccgtaccgaccatggaccggcaaaaccgagacggtgagtactaacctccgcctcgtggtggttccttccttcgggttggttccgtcgcgtggtgttgggagcgtagccgcagtaggtcagcgcaggggtgacacggaatgggagccggccgcggaggtggttttccgtggtcaagcacgcagccagtcatgtaggcaaatccgcatggcatgcatggcgaggtgtgatgatgggagccgttatggttcgatatccggttgtccaggccgtcgagaaaagcctcggcgtgagggccatggccgcccgtaccccaaaccgacactggtggtcaggtagagaataccaaggcgatcgagcgaatcctggtcaaggaactcggcaaatcactcccgtgccttcggtataagggagacccactggggtgaaggaccttgcgtccggagctttggtgggtggcacagaccagggggtagcgactgtttaccaaaaacacaggtgcatgcgaaggcgaaagccgctgtatatgcactgacgcctgcccggtgccggaaggttaagaggatccgtcaatcccttcggggacgaagcggtgaattcaagccccggtaaacggcggtggtaactataaccatcctaaggtagcgaaattccttgtcgggtaagttccgacctgcacgaatggcgtaacgacttccccactgtctcgaccaggagctcggcgaaattgcagtacgagtaaagatgctcgttaagcgcagaaggacgaaaagaccccgggacctttactataccttggtattggcgttaggcgcggattgtgtagcataggcgggaggctttgaaacgggtgcgccagcattcgtggagccgcaaggtgaaataccgctctgttctcgtttgacgtctaacctcgacaagtcatccttgtcagggacagtgcctggcgggtagttcaactggggcggttgcctcccaaagagtaacggaggcgctcaaaggtccgctcagcccggttggcaatcgggtgtcgagtgtaatcgcacaagcgggcttgactgcgaggacgacggtccgagcagggacgaaagtcggagatagtgatccggtgccggcgcacgggcgcggcatcgctcaacggataaaaggtaccccggggataacaggctgatcattcccaagagtccatatcgacgggatggtttggcacctcgatgtcggctcgtcgcatcctggggctggagcaggtcccaagggttcggctgttcgccgattaaagcggcacgcgagctgggttcagaacgtcgtgagacagtttggtctctatcctctgcgctcgttggaatcctgaggaggcctgcccatagtacgagaggacctgggtggacgaacctctggtatgccggttgtcgcgccagcggcacggccggttggctacgttcgggagggataaccgctgaaagcatctaagcgggaagcctgctccaagattaggattccgtacggtcttgaaccgttgtagcccgcatgttgaacacgtgtttgataggccggaggtggaagccccgtgaggggtggagccgaccggtactaacgggcgacggcgacataacattccgatccttttgcggggttggttccgcgtctttcctgtgctggatcgtcctggacggcaatatgcgttgggatggtcactgaacgatacaacgataggtgtttgcctcgcgtccgctagccggttcccaaaccgccacatgataattgaatggccggaatggttgccttgttttggttgtcgttccgtgatcgcggttttgcggtggtcatagccctggtgagacgcccggtcccattccgaacccggtagctaaggccaggcgcggcgatggtactgcactcgagagggtgtgggagagtagcacgccgccgcttcaaacgttgggggttcccgtcgagcatcctgctccgggaaccccattttttatccccgaatcttttgttcctcctcccggttcttccggctgaccccatgcgggttcccggaagggcttttttatttcccgtatttccttcttccttccgggactcccgtggggcttggcttccggggaccccgtctttccatccttgatttccatctgattcccaggtctcccgcaggggcatggaaatcctttccactcctggttttttctcttcggcgccgcggattcctgctagaagaccggaaaaactatggttttgggacctcgtgtgtgtcccatgcatcaaagcgcttagactggtcttatggcaagagttacggtgtatgacgttgcagagaaggcgggtgtgtctaccgcgacggtctccttcgccttcaggcatcccgacaaagtgaaggatgataccaaggccaaggtcctcagggtcgccgaggagcttggctacgttcccagcggcaacgcacgtagccttgccaaaggcaggacgggcacgttgggcatgtacgcgttcgatatgctgctggaaagacctcagggaagcaaccttgaggatgattggcctgatgtttcccccagatccatcgacgagcctctggacggtgacgaacccaacgttcttgtatatccgttatacgttgatgaggtgctccgcggcttcgaactcgaatgctggaagagcggcaagggaatacttatgggagccgcctcggaaagggatgatcatagatctgtaacggatatcgccggtcgcgttgatggtctggcgctgatgccaagtggatataacgatgcgcttcctctttccatgttggcgaagaccattccgcttgtaatggtgggtgtgggcgatgaaaaactgcctgccgcatacctgcaatgcgataacgcatcgggcatgagacagattgtcgaccatcttgtcgaagtccaccatatcaacgatatggcattcgtcggtggtgtcaatggtggagcgtgcgcgaggggtaccgacgctgatgacgtcgtctcgcgctatgacgcgtttaaaaaatacctcgaggaacgcgggctagactccaaaggggctctgttggatgactctttcgccacgtccgatgaatacatggtgggtttgtgcgaggcgataggatccggcagactgccgcaggccttggtctgcggcacggaccagaccgccttcggcgtgatcagactcctcgaggaggccggtgtccgggttcccgacgacgtcatcgtcaccggattcgacggaatcctcgccggacggctgatggaaccgcagctgacgaccgtccgccagcccatggaggacatggggcgcgaggcggctcgcatgctgctttccaggaacggggagccttgggagaaggctgaaagacgagtactcccggttcgcctcattgtgcgcggcagctgcggatgcaatcaaaaaatctaagcgcataaatcatatgggcgtgtcgccttgacttcctcaaatctaagcgcttaaattgtaatatcaatctaagcggttagattgatatgaatcaaaggagatttcaatgaggaagccatttttcaaagcggtcgtggccggcatggccagtgtggcgatgattgccggtatgtccgcgtgcggacggtccgcgaacaacgcggattccgattccgatgcggtcaagaccatcgattcaagcaaggccaccggcgacctgaccatctgggccatgggcaacgagggcgacctgctgggtgatttcgtcaagggattcgaaaaggagaaccccgacgtcaaggtcaaggtcaccgcgatcccatggtcctcagcgcacgacaaactccagaccgccatcgccgcgggcaacggtcccgaccttgcgcagatgggcaccacctggatggccgatttctccaactcgttctccaccgtgcctgacaacctcgacatgtccgacttctccgacgggtctagggctactggccaggttgacgggaaacagctcggcgtgccttggtacatcgacaccagagtgctgtactaccgtaccgacatcgccgagatggctggttggaacaaagctccgaagacttggaatgagcttaagcagatggctaaggacatgcagaaggtcgatggggtcaaatacggcatgaacctcaacccatctggcactgacgcgttcctcggaactttgccgttctcctactcggccggggcgtccttgactaacaaggaacagacgaaatggactttcgaagatactggcataaagaagggactgaactttaccaccagtctctacaaggacggcgtcgcgaacgtcaacgccgacgtaagctccggtgccgacatcgcgaacttcgtgtccggtgacactccgatgatgctgcaggggccgaccgccgtcagccagatcaacgaattgggcggcgacggattcgaatccaagtacgccaccgtcgtcctgccgtcgatggacgaatcctcggggcccgccacgtccttcgtcggaggcagcgaccttgtgacgttcaaggattccaagaacaagcagtccgcgtggaagttcatccagtgggtcagcaaacccgaggtgcaggccgaatggtacaagaagtcctccgatctgcccgcttcccagaaggcatgggacgatgacgcgctctccggcaacgacaagctttcggcattcggcgaccagctgaagaacaccatggctccgccggcgctgtccacctgggcgcaggtgtcctccgctgccgaccgcatcctcgagcagataaacaagggacaggtctccgttgacgagggcttgaagaacctgcagtccgaagccgactccatcggaacgggaaactgatcccatgagcctcgggacaagaaagacaaagacggagggctcgggcaacgtcctccgccgccgccgtacgattctcgcatggggatttgccttgcctttcgcagtcgtgttctgcgtattcatgctgattcccctcctgtcctcgatggcgatgtccttcaccgacatcacctccaaggaccttcgcaccccgttcaacgtcaacttcgtcggactggaccagtacatcaccctgttccacgaccaccgtttcctgcacgcgttgggcgtcaccggaatcttcgtgcttgtcggcctgccgatcaccatggcgatcgccctcgcattcgcggtggccctcaacaagggatccaagcacctcaacgcgttcttcagggccgtgttctacgcgccggttgtcgccagcgtggtcgcggtctccgtcgtgtggaggtacatcctccagaaggacggcctgctcaactcgctcctggccgtcttcggtatcgccgggccggactggctgcacgacacccgctacgccctgcccgcgctgatggccatgaccatctggcgcaacatgggaacgctgatgatcatcttcctcgccggcctgcaggccatccccgaggaattgaaggaggctgcggccatcgacggcgcaggcaaatggcgcacctttcgtagcatcacgctcccgctgctcaagcccacgctgctgctgggtgccgtgcttctttccgtcgcctacctgcagttcttcgaggaatccttcgtgatgacccagggaggaccgctcgattcgacgctctccgccgcgtactacgtgtaccagaagttcggtttcggacagtacggcatcgcctccgcagccagctgggtgctgttcatcatcatcgcgctggtcagcgtgctccagttccgcattctcaaggaggattgagatgacagccacgacagtcgcggcctcgaggccgcaaagcaacaagcagtcgctctggcgccgattcgtcaaggggcgtggactctcctactgcgtcctcgcggtgatcggagtcttctggatcttcccgttcctgtggatggcgctgggctcgttgaagacccagagggagatcctcgccaaaccgccgaagctcctacccgagcacgcctcgctcgcaaacttcgcgaaatggttcggggagctgaacttcggcacctacttcaccaacagcatggtcgtcgccgtgatcaccgtcctcgggaacatggtgttctgctccatggtcggatacgccctggcgaagatggacttcgccggcaagaacatcttgttcggcgccgtcatggtgacgctcatggttccgagcgtggccacgttcgtccccctgttcgtgatcatctcgaacatgggactcgcgaactcctacgcggcgctcatcctgccgttcctgtgccagcccatcggagtcttcctgatgagacagttcatctccggaatccccgacgcgctgatggaggccgcgagggtcgacggcgccggtgagctgcgcatattcttccagatcgtcctgccccagtgcgggccgccgctggcgacgctgtccatcctcacgttcctgtcctcctggaacaacttcctgtggccgttggtcgcggcccagaccgaggagaagtacacgctgcccgtggcactgtccctctactccaccggccagaacgccacgaactacagcgtcctgctcgccggagcggtactggtggtcaccccgatcctcctcctgttcgtattcctgcagcgctacttcatccagggcgtcgccggaacgggcatcaaatagaaagacatgtcatgaaagaacaatacgagttcccgccggaattcatctggggcgcgtccacggccgcgcaccagattgaagggaacaacgtcgcgagcgactggtgggccagggagcatgccgaacgcacggatctcagcgaaccgtcgggagacgcggccgacagctaccaccgctacggcgaggacatcagaatgctcgccgacgccggattgggcatgtaccgcttctccatcgaatgggcccgcatcgagcccgcggagggctgcttctccaaagcgcagctgctgcactaccgccaaatgatcgacgcgtgccacgagaacggcgtcgagcccatggtcacgctgaaccacatgacactgccgctgtggctcgccaccaagggcggatggctcaacgccgatgccgtcgactacttcgcccggtacgtgcggtacgtgatgccgatcctccacgacgtcacctgggtctgcaccattaacgagccgaacatggtcgcgctgacccgtggcggaaccgaaggcagcgacttcgtggccgcctcgctgcccgcgcccgatccggacatctccgccacgctcgtcaaagcgcacaggaaagccagggaaatactatccgagaacccgcgtatcaagtccgggtggaccatcgcctgccaggcgttccacgccatgcccggatgcgaacgggagatggaggaataccagtacccgcgcgaggactacttcaccgaggccgcggccggggatgacttcattggggtgcaggcctatctgaggaccttcatcggcaaggatggccccgtgccagtccccgaggacgcggaacgcaccctcaccggctgggagtacttcccgccggcgctgggcatcgccatccgccatacttggaacgtcgccaaacgcacgccgataatcgtcaccgaaaatggcatcgccactgccgatgaccgccggagaatcgattacaccttcgacgccatagccggcatgcacgacgcgatggacgacggtatcgacgtgaggggatacctccactggtccctgctcgacaactacgagtggggctcgttcgctccgacgttcggcctggcctcctgggacagggacaccttcgaacgccatccgaagccatccttggattggctaggatcaatcgcgagaaagggggtcatggccagatagaagccgtttcctctccatccattacatgaaagggcgcacgttttgaaacgtgcgccctttcgtttgatttggcggattcaatagaaaacgggtatagccctcgatctggaagaacatgtccgtccggcggccgatgctcgcggctggcatacgccgaaaacgcagcactgctgttcccgtaaggtcgcatctcccttaacgtgtcaagcgtctcctgatacgttgctgtatcgacgccggtttcgtcattccttgcctttcccgagtggccctgtcggccaagtgcgtttcaactcgagaaaatagccgggttatggcggaccggcggggaggggcgtgctggacgcctgcgcgaactcggtctgacccgattcgctggatgtctagccacaatggaatgacttgatgcgtattccaagccggacggaggatggaatgcatctccacgcggatggcggccgaattcttaagtgtttgcaccagcgttacataaaacgcttagcgaaccgaaatgatgtccggcggaacgtgtccttgcgcgtcttggaaacggatatccgtattcgttcgaaggtttctcgaccaggggatgggctttgctttttcagattgacagtccgtaatcatttcggatatgtcggaatttagacaggaatcccttggatgcgccgcgggcgataaatacgggccgtggtgcgggaaggacctcgaacatgacgattcgaagaacacggtcgcctatttcggcgagcgtgccgcttcccaccctcggcgaggtcacggccggcaccgcgagcctcagccggtaggagctacccacaggatcattcgtgttggtcggagttctctcgttcggcgacggaattgtatccgtggggtacttcgtcgttgtttctacggacggatccgagggtgtccatccaccagtgttcgcggtcgatgatctctttgggtgacttgttcatgtcgaagatctccaggatcgagtactggaagttcttctcgatgtatccggcgccgaggtttctgagctgcttgtttcccccggagtggtctccggacgcgtattccttccaacgcgacagcagaccgtgcgaggctcctttccgtgagtaggcggaccccacgtaatgccatcccgttcgtctatcggtctgcagatagaccgcctggacgctgccgagggccgcccgccattcctcgttgttcacggccgccacgagctgccggtgcgtcaaccgaacgttctcgtatccagagaacggtaacgcggatacgggggattgagcgattttctcaagggtcatcgtcttgagaaaatcccggcgtcgttcttcattgttggacaggttaaagacgactcccgtgtaacccggatctcttttgtagtacactaccgccctggcctttagcgaggcgtattccgggatctcattgtaacggtatagaatcttgccgtcgttctccgtgtactcgtcgaggacgtcgtaggctccgacgaacagccattgtgtggggtggggattctctggcttgagctgaatgaactggaggactttacgtgtgtgaatctgcgctgttgccttatccttatctggccatttcttcgtgaaaatccacttcatcaggtcatcataggaggaatagtaggcgtcgggaagatcactccatttgccccattccgggttgctgccattcagacgaatgctatagccggctaggtcctcttcgtcgagtcccaatagttcgaggaaccggatcggttccgtatcctggattccgtcttcgatgcgcgtcattgccatcgcctttccattcccgattgccgccggacggtatgattttccggtttgtaagacagtctagcgtcttgatgatgaggattatggaaccggctggctccttgccaggtggacgtggagtccgacgaagggttgcgggtccggctgtcttcgtggaacgacgacggtttgacgtggccgggtgatgggaatgagaccggtcgcgcggtgtctgggcgttatctgttgtcatgtcgccatgtcgcgaaatcggttcgttgttggatgagtgtggtcctgtgaattcttaaatgttgtaccgaatgcaacatgcaacacttggtgaatccgactaggaccatcggaatgcgtcttggaccatttcgaaaacggatgtttccggaacggaggacggaccggccgccatgtccacgacactccggcgattggtgttccgaaacccgtcccgtaatcaatgttccggaactcaatgccattgacgggtagtggtatggtcggacgcatggcgagcatgatttacggatacgcgagggtcagcaccaacgaccagaccaccaatctgcagaaggacgcactcgagaaagccggctgcgaccggatcttcaccgaagtggcctccggcgcgaaggcccaccgtcccgagctcgaccatatgctcgacctcctgcgcgagggcgatactgtcgtagtgtggaagctggatcggctcggcaggagcatgcagaacctagttgacctgatgaccacgttcgacgagaggggagtacagttcagatccctgaccgagtcgatcgacacgaacactcctggaggcacgctcgtgttcaacatcttcggatcattggcacagttcgaacgcgacctgattcgcgagcgaacgcgcgccggacttgaggccgctcgcgcccgcggaaggaagggtggacggcccgccaaactcgacgagaagcaggtcagggaggtgcggcgcctatacgaatccaggacggtgacggtagaccagatcgccacgatgatgggtgtgggacggtccacaatttatcggtgcctgaatacgtcggataagtaattttgattcggtatgtgatgtgacctgattctaaagtcgacgatgtatgcttttattgtgtcaataagaggacagattgacctataaataaccgggagtacgagatggtcgacactgattacggacagcagattaaggataaacgtgagcggttgcatatgactcagaaggaacttgctgacgcaataggcctttctaagaacggtgaccgtactattcgccgctgggagaatggcgaatcaaaaccgactgaaccagaattcagacagatcatggaattccctgagaatgcgccatttaagaatcctgacgaggcggactataggagtatcgacttatttgccggaattggcggtactaggcttgggttccaagagacaggcagagtgaaggttgtcttctcatctgagattaataaattcagtgctaaaacgtatcatgccaattttggagaatatccagctggcgatattacgcagattgctgcgagcgatattcctgaccacgacattctcgttggcggttttccctgtcaagccttctctcaggcaggccttaagaaaggattcgaggacgctcgaggaactatgttttttgagattgctcgaattctaaaggaaaagaggcccaaggcgttcttgctggagaatgtgaagaaccttgtcggtcatgaccatgggaacacgttcagaactatcaagtccattcttgagggcctcggctatgcggtaaacgcaaaggttctagcggcgaaggacttcggagtgccgcagaacagggagcgaatctatatcgtcggtttcgacaaagaacaggtgccaaactgggccgacttcaaataccctgaaccgccttgtattcctacaaggctcggtgacatccttgaaaaaaacgtagatgacaagtatacaatctcggacgcgttgtgggcgggtcatcaacgtcgcaagcaggagaataagaaggcaggtaagggcttcggctacggcttatttgatgaggacagtccctatgcgaacaccattagtgcacgctactacaaagatggttcagagattctcattaggcaggatgggaagaacccacgtaaactgacaccgcgtgaggcatctagactgcagggtttccctccagagttcatcatccccgtttcagatacacaagcatacaaacagtttggcaactccgttgctgtacctgtcgtgaatgccgtagcaaagcaactactcaaggtgcttgatgctagcaaggaatgatgcggcttggcggggggataacggaatatcccgttatccccccgccaatgactataggcactcggccaagcgagccttgtaataatcgcagacgataggatggttcttgtgcttctctatctgtttgcgcagaaactgctctacaacgcttcgttgcttgtcggtataggagtatccctcccatttttcggtaatgttggacgcttcagtgatcatttcttcgaaggtcatgactcgtggattggtgtagtgcgaacggttctctttcgtggtcacgatagttatgttgctttcatatagtacgttcaaggtgttttcggttatgtcgctgtcgagcgtcgctaagtacattcgaggtgcgccggtcctagttacttcttcaggaacctcttgccagcgttcacgaagtgtagtttttgcggaaatcagcacggtacgttgcttatctatcgagtattgaattgcccccggtgtcacaaaatccaccagtttgccaaggtgatgctgggcaaaaaattgcttgccaacgttgccttgggagtcggtcggaatacttgccccaattagcatcatctctataatggcttcgaactctttaccagctcgtgacctgcgcgactgagtgttggagagagtcaattcgtagatgtgctgcgggtagtcagacacgaacttcttgatcgcatcgacagcttccattcctttgaaagacatgggatcgataagggatgatagtgctttgacagtgaatttcttttcgcatacttggaaatccttccaacattgcgtacgcatttgacctacgaagtcactggcgtgttccttgaagtatgactttcccatcttgtcgaatccgagttccatgaacgaattgtaggcgatgtcgaaaggagatggaaagtggtctttgcgcatctctttaattgtctctttgtaatcgtcagcggtaatcatcgagtctcctcgcccgtattgagattcacagattcctcaattttagcaatctttgttgtggaaattggagaaattagctctctggagaaagagtaactgcctttctcactaagtaaatcgcaccaaaactgggcaatctgattggtgctcgtattgtttacgtacaaggagagcgctttctttatatcgagcgcaaaagcaggtatcgctctccaatctgggagacgttcaatgtatgcgtcggcaatgaaatggaatttgacagtgtcttcatttttgggtgcctctgggaaaatgaaagcgttagtcgttcctttgatacgtgaatacttgtcgttgccttttcttttgcaaagaactgatcggagagtatcctcgtaataatactgtttgatgatgtctggaccgccgggcatgttgtgccgatagtcatagtatttggcatctaggatatataatgtatcgttcgttacgaacagaacatctggacgttgacttgtgtctggcttgagattcggtagcttccaccgcggttgcggaagtaggttgtcgtaaatgtactgatcgtcatggaaaatatgcttgcaggtggcttcccagacgcgccaataggtttttgttccgaagaacgatacgtcgtttttagaatcattccggatggtcgaactgatatattgcatcagaaggtcaataacatgcatttctcggtcagagaagacagtccatttttcccttgatagaaatgtcaatgccgtctcctgcgtgcatgggagccatccgcgttcgtgctgtcggaaattgacgtgatatcgctctgggtcaatcaaccagccccaacgtttgtagcaatcttgtacacaagctttgtgcaatatggttagaggcgagtcgtcgtcgtcgattctacgtgcgatgaccggcaatggatagaatacggaggattccgtgaatatgggatcgcttctttggatggttctattccatgcgatacgtcctgattggttttgggaatattgggttaggaaacgcctgattgggccgttgacttcgtaatcttgaattaactccatggcggtgagaagcggagtacttgttcgcctatctgccgaatataggaagcctgcgtcttcaggagaatgcggataatcgtctctgaaacgaataagtgactttgttacaagtgatattaactgttcagtatcttcgtcagaaatattggagggcgaagcgaacagttttttagggaaacaaaatatgacacaatcggcgaaggctactatgccgacgaaggaaatggaaatccacctttccttagaggaaactaaggaaggttggacctttcggactctgtccagaagattccatgtttcttcatcagtgtagtggcgtccgtcaatgagcgtgtagaggttcatgcgtcttgtccgtcgttttcctcaaattcgttcgtgtcaggttcactgtggtcttctggctgagcttcctcagatagcgtctttttaagcgactcctcgatgtccaacacatccttggtttgataattggcaaacagatacgataacgagtccacgttcgcatcaaaaaactcatttcgatcatttcgtagcacatcatcccaaaggtaaataagcaccttcttgaaagcgcctcgaataccagcctcgctgcgcaacgcttcctcagggaggaagaactgcccgataagacgatcctctggaacaggtgggcgtttttcccgaagcttattgttcacggaggatagaatctgaagcagactatgcgtttcgttgttatagatgatctgagacgttttgagtttttcgttcagtgacagggagatagtctcatattcaaaatcccatctcctcttgaaggcggaatccatgaacatgactccctgatcagcattgttcatcgtagcccatatgaataagtttcctggaatgcggagttcattgggagatgagaccccttcaagattgagtaaatgctggcttagatagttggggctgcggacgttttcttggagaccgaacggaaagattttcgtatgttcagtcttgaggaacgagagcgtgcggtggagttgtatttcaccacgccgatgacgacggcccaggtggtggagcatctgggttatccgaccaggcagtgtctggagcgttggctggcgatggattcccggtatgctggccatatggccaaacccatcatcccactggagaccaggcgaagggcagtcgagctggtgctgggcggcatgcagcagaagcaggccgccaaacagctcggcgtgagcgtcggcgcggtgcatggctgggtcagggcgtaccgcaagggcggcatggccgcgttacagcccaaaaacaggaactccgcgcagggcaataagcccgctgactcccgtcgccggccgtccgcagccgatgatgatgacgcggaggctttgcgccgcagggtcgaggaactggagctggagaacgcgttgatgcgggaggtggtggaggtcgtaaaaaaagaccccggcgccgacctgcggcgcctgtcgaacagggagaagacgctgctgatcgaccggttgaggccggcgtattcgctcaggtcgatgacatgcttgctcgccatcgcgcccagcagctaccactaccaccacgcccggctcggcgttgacaagtacgccggactcagggcagaggtggccggggcgttcgccgattccaagggcaggtacgggtaccgcaggatcaaggcggtgctcaagaccggcgtatcggagaaggtggtccgcaggatcatggcggaggaagggctcgtggcgcatgtgcccaagcgacgcaggtatagttcctacgagggcgagacgacgccggctcccgccaatctcgtcgaccgggacttcacggccgagcgtccgaacgagaagtggctgacggacatcagcgagatcaaggccagggacgggaaggtgtacctttcgccgatgatcgactgcttcgatggcaagatcgtcgcatacaccgccggcttcagccccaacgcggagctggccaaccggatgctggagaaagcggcctcgacgctgccggggaacgcgcgtcccctggtgcattccgaccgtggatgccattaccggtggcccggatggctcgggctcatggaacgcttcgggttgacgcggtcaatgagcgcgaagggctgttccccggacaacgccgccgcggaggggttcttcggtcgaatgaagacggaatccgtctatcccgagcattgggagaaacgcacacgcgacgaggtgctcatcctgatcgacgattacatccgctggtacaaccacgagcgcatcaaacggtcgctcggttggatgagtccggtacaataccgtcaaagccaaggaatggctgcgtgaccatctccaagaaaacgtccgcagcccatttgtaatcttaaaatgagcaaatatttctttttcgattattccgatttctgagggttgataatttccagcccttgtttgttgggagcaagttcaagtatggcgtgatcggaattatccagtactggtaatgctgccggttgtgaatgtaaggcacaagtcagcttaaagaagctagaacgcaaggcactcgttttctttccactcatttcgacggggaattttgccgctcctaccggaagaaaactaaggctttccaaggtgtgaacaagttgttcctgtcgttgggcaatagaatccaactcgcttcgcaaaatagtctctacatgagcgagtgaacgactcgcattgttctgttccgcggcaactttttccagaaggatgattctggcgcgcagggcaaacgtctggtaggtctgttctactgcacactcgaaatcgtatagagaattttcgctggagttagtgagctctttcaataaatccgagctattaacatgcgactgcttggaatagtgttccgcaatgtccgaccacttatcaagacgttctccataaagcacgaagagttcttctaacttgccaaaagcataaggtgccgtggacatgcttggaatacacgcttgatctagcagatatcccgtcacttttcgcgcttgttgagcggcgttgataaggatggctcgatcttctgcgtccctgcgttcttgcagagacttgactgatttatagatagcgtcaagttttttgtttgtttgataagaggacaacatgtcacccgccatggccaaggctacagtagcgatcattggtcctgccgccacggcagctccggttgcgggaattagtcgcacatgactcgcaatggcggaggacccagtggcacgcgtgatcccccggaagcctccacccacggcagggactaaatccttcacagtgaacccagccggtagtatcactcgatacagtccactatctgaagcaacgtggcctatttgctgagtagccagactcactgctttggcaaatgagcctgcagactgggcgacaaggttggtgccgtttgaagattgatgttgtgttgttgaagatggctggtactgaataagcatggcatcctgatttaaaagcatgagcagcatggtttccgtatccatctgaccactcagttcacgactgattggtttcagcggcacgacgattgcatcttccataatcagggtccttgtcagatctgcttttcgatgatttgatttttcaatcttaagtatatggggaatgatattgacgttgaggttgtcaagtatttttcgagcgagcaaattcaaagattagcgtactaagtgttgtctcataaacggtcgcatacttaaatacttgtattgattcatgcggctagtcagtaggctctgggcttttcaacaatggtggcgcagaaagtaacgctgccatccttgttctcagtggggagactaaactgccagattgaaccaagctgagattcgaggtcgttgaggagcatgtcgattcggtcaacgcctccacggatgcttttgacggtaatacgcaattcgggaccgttcttctgccgttctttagtaatgtcaagacgactagatgggtctgccacgcgtactgcgcgccacgcattccagccttccttgcgggcttcgttctctttctcctgcgccttctccaaggcacgttccccatgtctgacatcccagtcgacagctttgcgcatggtaagcaacaagttggtgccgcggttctgacgcactgcggccagacccttgcggtcaagactccgtgcggctcgtcggcgagcctctttttccgctgcagaaagctcacgtggcgcgaccgttaccatgccggtccgctccagttcatccaacaactcccgctcgacctttccaagacctctgctcatggcgttctccgtctctaagtgttgtacatttattatctacaacatatagaaatatgtcaataagtgtcgcacggagaagtgaagcaacatttatagcaatgaaaacgataaatggaatagacgggaataaaagagcatgacaacaattgaacaatcttcgcaagtctattagtcaggattgttcgggaacatctaagaacaattgccggcatactgaaatcgacgtaaagaatcagacgccgataatttttcttatgtcagattcaaagcacgcaacagccttcatcgccgttcaagcaacaggattatacgccgtttcgcggtcgaatgtcctatgcgtcgaccgcgaaacggcgtatggaatcacttcttagcgacaatcgctacatatccgccggcatagtagccatcgataggctcctccaccatgcggttcgtgtaaacgggatgagcgacaagcgtctgcttgtaacgtaggtcatgcaatccaagttcatcggtcagaaccttacttttctcttcggttgtatgccagagagcggcatggacgagttccaacgggtatgggcatttaggcgccgtatcaacggtttccggggaatcgtaggtgtcaagttttcctgccagtagatagagcagaccataggcgctttctttcggaacatcgagcaggacgaggctgccacctttcttcaacgccttgagcacgtttccgtaagcaactttcaaatcgggaatatagcttgaagatccattgaagtagatcacgtcatatgattcctctggtagatccgccgtctctgcggtggctatctgcacatccatgccacgtttgcgcgcaatggcagccatatcctcagacggttcaatgccctcggaaacagtgatgccatactcgtcttgcagtgatttctcgaacaaaccggatccgcaaccaactgatagcatccgtcccccgtcggttaaatccaacgaagccttgagcagcttcaactcgctgaggaaaacgttctcgttagtcatgaaccagctgtcatagtcagcagcgtatccatcgaattttgcatgtgccatttatcggcctccctttcatcattgttagctaggagaccggtaaacacggtcttgcttccctacgcgagcattaactcacaggttcaaagggtcccaaaggtctcagcggaatcgctcccctagcgactcctagtatagccatacggggacatacttcgttccgttgtccagaatctatcagggataacatctgaatgtgtaagcgttccgcggcatattcgcgttaaccaaatttactgcatgccatcagaaatacgcaaaaatagcattagccgcaatttttaggtcgatggtcaaataccataactgatcggccgtaagaggcaccttccgtttttggaaggagagaaacaggtttagcgcaagatgctaaaccatcatttatcactatatatagttattatatagaatttatataaaatcaatatagttgatatattgcttttatatagtcctttttgcgtggaccctgcactggaaaatcattgccgcctatatcgtcactcccctgtgtcaaaaaacgtctgccactgcttctataaataaacgtcgcaatgataaggggcagcactggggatagctatcctcgtctatcacgccatgccacgccgctttccatccagtctcaacggagtcttccttagggaccactcccccgcccactatcagtttaaagtagattccattccagcaccgcactacacgtcagacacaaatcatggtggttatccaacgccatgttcaattaccaacgatggatccgaactaatcccgtctgcctcatttgcgttagcgtactacatgacacgatatggttccttattctccgatgagacgtcatccgtttgcgcatttttcatcaagagacaacaatgcttaaatccacattgatatcccagctaagcgtatcgcataaaagagctaaaatatataggtcctatatgaaattcatataggacctatataatacttatataaaaatcattgattggcgtcagtcatcctgcttaagtctcagtcgaactccatccacgatgagacgcgaggcgctggtgccaagacgcgcagcgcgttccttaagttccttttttaggtcgacagggatcatgaaactcatcatggtcttatcattgccttcgctgtcgcctttgtgcttggtgtcctgcaggtccataagtctgccggtcggctcatccggcctgttcgccctgattggtttaatcgccatcagttggttgcctcctcgagttccttgtagacgtcttcgtagccatataggttgctgccgaatggctgaccgtacacgttgcccaagtcggccctcttaggaatcacagcgtcgaacacgctgctgtccttctccctgaagtattcctgcgcgcttttgagcgcgatggtgtgcggctcggcacggactatcaacactgcatattgcttgccgacttcctcgagattgtcagccactgccgaagtctgctgcaggtcaatgctgttgggactggtcggtacgatcacgaagtccgagacggaggtcgcttcgtcggtgatcttgcctgtcggcggggtgtcaatgatgacgaggcgcggatcgtcgggcttcagtctgcgtagggtggcgatgttggcgctttccaccgagaacggcagcggcttgccgttctgctctgcattccaagcccataggctcgcactggattgctcatcggcatcgagcaccacgacttcgtgccctttccgtgcggcaagggtggcgagggcgatggccgtggtggtcttgccaacacctcccttgatattcactacagccacaatcatgatgacctccatagttttatataatcattatataatatatcataaatacttatataagtcttatattaatcttatatttcgctatagaccttcagacaatcctttaagcgttgtatcgcaaatgcgagcaacacttatagtgccgtgtgaatgccatccaatcgttcggtaatacttatgtgccgtagggtcacactagattcagcggacatcagcaaccgtgtcttaaattaagaagaggagcaagtcctggcattttgcggatcagtttcccgactcggccataggagacctcatcggacgcgccaaacttgcgcacctctcccctaggcttttttatgattcatgtcaattcttatagacggaagtcaaacaaaagcattaatgaatcactgccatcagcggatacgttccaatgaatgaaaacgggaaatcgttccctgattacttcgcatgagaccagtatttcaatagatgaatatataattcttatttaatgcttatataaggattatataagtctttattagattttatatagtttaatcggataatctgatcaaatccttattcatgatcgagtgccaggaatcgattcgctgtcaaatcaacaatctgtgcgagcgtcccgtaccccgaacgtcagtgttatctgttttatctattccgctgttgcagtcaatgaagctttcaacttatattcaatgcgatgacaggtggtctattctggcactcgacggctgtgacaataattcgaccacgttgccgtccatatcgtttctatccgtgggagcatttccgattccgtaacgttcgaacaatctgtcgaatacgcgcagtccctcgcatagcgcttggtcatagtcatccgggttctcgtttgcgcgtcgtacgtttatggcgatgtggaatgcttcgttgatcagtttttccatatcatacgtggataaattcgcaatctgccgttccatgccatcggaaaggaacggtggtctgttttccatgcttgctcgccactcctggacggcaagggcttcgcttctctcatcatgaatccaagcgtttcgcaattcccgtagtctcatgtccgaaccgatgtcgattgcgttgaatcgttcagtccaaccgtccgcactgcgccaggtgatttggtatccgaccacttggcttggtgatttgaatgagtccttggacactcctttacgtagatgcgggtcgatgttgaatccttcgcgtcggacgcggcggatgaattcgtcttcgctccttgacgctttcgcgcatgcctccacgatgagtcccacgtgttgtttcggcatcgtttcggcagctactgcggcgatcctgcgggtgtgttcgtccctgctgagcgtcggccaggggagtgccccatcatattcgttccgagctttccattccgcccaacgacgccattcggcataccggtatctgacgtggtttgccgtggtcgaccggtcgagttcaatcagttcgggatgttcccgttccatctcgcggcatgatcgctgcgcattcttcatgtcgttgaatgtgttgagccatccgtcgtccattgcgagctgcaccatcacatgcacgtggtcgttgccgttccggctcagtccatggcgtaccgcgagccaagtcaccttggacatgtcgccggcaggcaggatgttcatacgttccagatagtcgcggacgatcgagtcccattgctcgtcggtgagaataccttgacctgccttgatggacaacgaacaatgccagatacgatccttgccatgctctttgtcgggattatgtctgcctcggcggtcgcgggggaatgggtcgtccctaagttccctgtcatggtatcgtcggtcgaaccgtgttccgattctcgcgtacgcctcgatgaggcgcccgtcgaaatcgaatgagtcgagcagatcagtactgcaggcgatgaggtgctggttggcgtgctcgttatggcgacctttgccgaacaggtacttcaccaatcctgcaggattcgaaccgcggctaatctttggaatcatgcttctcatcgtccggcatgttaattcccttcatggtgcacaacgtctacaaatttccaaaattgagtggcggcatccccgcaaggtttcttcttatattgaaattcatcatccatcgaccaagtaggggagtggctgctcctacctggtaaccgaggcgacaatgaactgtgtcgacaacacttttcagaacaaacacaacagatatcaaaatgcagaaaagccggtagagattgggttatgaaaatccctaccggccggatacaaaataaacaacgagaaaattcactggacgagagtgaagattccagttcattatatcatttggtatcagtccaacgaaaaccattgatgatttcgcgtacctctgcaagcagcaacgcgcagttccgcactgctatgacggccgaatattcgtctctttcatcggcggccatctcccgattcgtattgcgcgctatctggttgatgttgtgcccgatatgccaaatctcagtcctgattgcttcaagttctttcacgaccggttcggtttcgtactttctccggaccgattcgagattggcagcgacttcgcaagactcaatcagataacgtgagacactgatacctctcgtttccgcggccgaacgaatctcatcgaactcttggtcagatacacgcacgaaaatccgtctgctacgggtgatccctgtcctatattgttggtttttagccgtcaatgacccatcatctccttccaccacttcgtccggcaatcttgcaaagcaccgttccttcttctaaagcctgcggcactcgggtccatgtccaccgccgtaggcgcagtggggaatggtttcggtttgtacgcacaaaccgtataacttgctaccccacggtgacgctttccgagtccggcttcgtgccggccttccgcctatcccgttgattaggattgcgcctgtctccatgccatcctgcgtcatcggtgaacggaagcgtcctcttccagctcatggagcatctgcctagcgtcggcgtctactgacacgttcgtaatatcttccggtaacggccacccgagacgctcggcgaggtcgaattgctccgcgaggatctccgacacgtatgtggcgcgggtgacgcccctcatcatcgcggcacgggtaatcacctcgtattcggcatccgataaacggataccatggcgcgtgcccgcaggtctcaactcaccaccgactgttccggagggaaatggtcgacgcatcatcccatccgccccatcaagacttcccggataaagacacgatgacgcttgaggaagaagcaaccagcgcaacacgacggcgacctgatagccatgcgcccggctctcatctctcaaccgctggtactggtggtcacagatccacgccatgatgcgataggggaatgccttgtatcccatttcgtttttccctttccttttgacgaaactattcgccagtccatggggaagagcccgtcccgtcgtctcacggaagagcgagccttccgacgaggcaccggaacaatgtcgttaccggacaccacatcaatccaaccgcacgccgataggtgtgacggtgcacggtgtctaccagtcctcgtcggtggacggcatccgccgaggaagacatatgccgatggaggacacgggcgtcggaaggatttgaaaaacataagtgtatactctataatagagttaacactttgaaaaggagcggacatgagcctcggatacggaagggtcgagcggcagctgctcgacgagctcaccgcagacgcagccagaccgcacgacgtcggcgtgctggtcaaaaggccaggcatggcgcagagcgaggtgtgcagccgccgcagggccgcgaagcgcctcgaggagaagggcatgtgcgagacgctccgcgtcgtctacgccggacgccgccgcctggtctgcatgacaccggagaaggcgctggaatacaagcggcgccaggccgtggaccggcgggccgacaacaaactcgaacggctcagactggacgccgagttctccaggctcgacctggacaccgagacgtggaagcccatcgacgaggaaggggaggaatggtgatcatcactgtcgtgaacgtcgatggaggtgcgactaggaccacggcatggaaccgaccgcagaacgagacgatgggcagaaagccgaaacgtcgcaccaaaagcgtaaaacactaaaacaatctaagtgtatgcttaataggtaaactatacactgtcgccgggctgagcattcttgccacgtgagtctcgcgaacgccggccccacgaacggcaaccgaagaaaagtctgcggcgtgggagaccacgccgcagaccgggaccgctagccgcggttatggctggccatcgcgtacgcgcctatggcgagcaccgtgatgtcggccgcggtggtgtccaccttggccgcgagggcgacgacaagcaccgccatcaaccagaccatgggaccgccgcgcggcccctcttcattcatgcgcatgatctgcgcctttccggtaaagccgcgccgcgtcaggcgcggcaacgtcgaccggctgtcgccgggcggtcgttccagcccctgcaaaaaggccttctcgacataaacgatgatatcggttagaatggaaatcgccggtcgaggcactgcaaacttcctcccacattcaaggcggtgcgcaacgacttcttcgggaggatggccggaaccggtggggtggtttcattcccatcccctggcaaagcgtcgggccggtgtcttcggacaccggccctttgcattctttggccataccggaaataagagtttatcttacaataaagtatacttttaagcgctggcgaacccatccatgcaacacctgcatcttgctggaatgtcactcatcggttcgagcatcgttccgttgtcctacgctccatcagcttatggagcattcgcctagcttcgtcgtccacggattcatttgtgatgtctttcggtaatggccatccgaggcaatcggcggctctgatttgttcctcgaggattcgtgtcacatacgtggagcggatgatacctttattcatcgcggcgcgggtaatcagttcgtattcggcatccgtcagatagatgttccgataaggcctcgcatctttttgcccactcgtcgatccggacggcaacggaagcctcatcagcatatcagcgttgtcgagacgtcctggatgcaagccgtcgacgctttgtggaagcaggagccaccgttgcacgactgcgacctgatagccgtgagccaagctctcttctttcagtcttgcgtattgttcgttgtcaatccgtgccatgattcggtacgggaagttcttgcgtcccacgttaatctcgcctttcgcttgtttgttcagtgacggtctggcatccggaaaggatgtctccgcctggaccggaagaaggttcttcctcttttggattcagcggtcgatacaaatcgaatatgacatcatgcttccttccggataccaactacgcatgattcccattgccacttctggcgcaaggtattcggtgtagcccataactccgtggaccggcctcactatccgcgtccatactgtctttagccacctcaaatccggatacgaaaaggccgcgcccagtaggtgcggccggaagacgacaggcgacgtcacagttcaacgaatccgagcaatggcgcgaataccgccgccacaccaaacatggccacgatcatgaagacgacaccgagcacgtatgcggcaacgatgatggtggttcgtccagccaggctcccgttcaaatcagccgtcggaccgttcatgcgtttcgcaacgattgtgcacacgcctgacatgacgaccgccatgaggacgagcgtgacttgcaatccgccgttcagtcgtatggtccaatcccatagtccggtgagcatgccggcaacgttttccagaagacgctccattctctgatccttcccattgttggctattgatgaatggctcttcaatcctgatgcggttcccaccagccagcggcgcacggtgtctacacattctccgaacgctttttgtagacaccgtgcgccgtcgagcgcggcgtatcgattcatccttgcagggtatccggttcatcgaaggtaaggagttgaatttgtcccacagcaacagggcccgcgacacaagacgcaacatttcgaaggcgattcgcgaatcccagcagtctcggatggacgcgctcgatgcgttagcccaaggattgactgaaatcagtgccgcgcgcatacggctcaaggagcttgagacgcatgtggaagacttgcgcgtccaggcgaagaatgcgggcaacactgccactgacattcgggccgtggaacgtattgttaatgaactcgctctgaaacggtccgaagcgccggagaacgattccaaggacatggaagagccatccgggatgggggatgagtgatgaccgggagggggaaagaaccgcatccgatgcctcgacccttccgctggctggccatgttcctcgcgtttgtgttcgtcatatctctcggcgtggctgccacctatcgaatgaaacgaaccggcaacgatggagatcttgggagagtcccgtccaaatctgcgcagaaggaggacgtcagcccgcacggtgaatatgccggtttgaaggccgcgggagtccccgttcccggtgaatggtcgcgtcagtcgctcttagccgtcgacgggacgcagaacagtgacggaaacggtgccgcgctatcacctgtcggaggggatgggggaccggtcaacgtcgcgttggagacagtcaacaggattctcaacccaacgcaatccgacgtggaatgggaccggacgatgagagacctcttccaaccggatatggccggattgacgcatggcccgtcgaacatggctcgttactggtggcagcaacgccgcttccaaccggaccgcctctgcacgggaatcgcaaaggacatgctcatcattcagtcctatgactgttcgacggaccgcatgttccaaggccagaatacggaagcgatcaagggtacccagtactggtggacgggcatatcatttttcgatgctccacggtcgatcacggaaaagattccatcgtcgaccgaccctcagaccgtgatttcgcaatactacgacgcggttgctttccccatggatgacggcgtctggtatgtgaccgtcgcatgcccggcgatgtccgatcatccatatctcgacgaaaacggcaatgagctggcgacggaagacgacagcgctccatcctccaagtactggattagcgtcggttcgatggtgggagtcggcacgaaccaacgtccgtgccggccggttgaaatcaccgtcggcgggcaacgtccgttctggtacatcggtgcggacgggagtaactgacatggctgtatcctgttccaccgacctgatgaaaggcttgttccgtcgccgtgtgcttcctatcgttgccatgctgtgcatcgtattgacgaccggtgcgtgcaatccgactgatgtattgcatttcctcgccggctgcaaggatggctcctcgtcggcggaatcctcatcgagcatggtcgcttctactgcaaagggcgactggacgggactcgtcggcaagaccgaaggcgagatcaaacatatgtggcctagccacgtggcgccatgctcaggctataacgtgctgtatggcggctccagattgcaatgcacttggtgggcgtgcatgcgtcagcgtgccctcggccatgatctgggccaaggatcctggggcgacggcggcagttggggagcatccgccaaggcacgcggttggaaacaaggtgccaaagccggaggcatcatctcttgggcgcccggctcgggaggctcggatggactgtatggccatgtcgcagtcgtcgaacaggtcgatggcgacaacgtgcatatcagcgagggcggtgccgggttcaggaattccaacggcgtggccgctatccacacccgggtcatccccattcacggcacgggcgcgactttctggtatccggacggcaacgacaacgccgagcccgtggccccagataccagcaaacgatcctcctcgtcattggccgccacgtcggcgaaatggacatgctcggcatcctcgtcgaacgattcgacgagcggagcggtgaacgtgaaatacaacggaaacgggtatcatgccagtcctgaggacgccaagggcatcgccaagcagatgatcgccagcggatacaaggaatgggataacgacaacgactggcaggcgctcgtgtggatatgggagcatgaatccggctggcggtggaacgccgagaatcccacgtccggcgcatacggcattccgcagtcctatcccgcatcgaagctcgctgctgccggaaacgactggaaggacaacgcggccacccagatcaaatgggggctgcagtacatcaagcaacgttatggcagtccacatcaggccaaggagttctggctgcgcaacaacgcttactaagattccatgaccttatgtgcctttgcctcacgattacacaatctaggagggctggatagaaaagtgattctgcaaaacatcggcgtcatcgcgagcatgcgacggacggtagattgtggagtactaaaacatatgcatcgtcagggaagttcggcttcctgtggataaaaaggagaatgcttgatgacgtgcaccggcactgaagcaaaaagtctgtcgaagacggctatttcagatgaccatccaagcacgctgggcaagacgagcgtggagaaagtcagcgaaccactgacgaagtccgtgaattaggcagacagaggatgcgtagttatcagcaagcgaatgcctctcttcctattgcccgacagcatttaccttggcgtccgataagaggtttcgaacgttctcttggaaatatgcatgcaattttaaactctacgagcgcatttgaaaagaacaaattccgctgcgattcgtaaaggaaagtaaactcatcaaattcatttgcaatgatgctcagcacctgaacggattaatcgttagttttatccactatacagaattcatataacaagcaagcgttttctggccttcctttttctaccattgatttcaatcaacttatggcaagaaagaaacatgatgaaagtagcagtcttttcagcagggaacaccggattggccacagcagctcatctatcaagtcttggttttcaaccgatgttgtatacacgtaactccgaaaaactacgaatgcttcaatcccatgcaatggaatcgaccggcatactggatggctcatggcatataccagcaagcagggacgcgaagcaggttttgaacggtgccagtctcgcaattgtgtgcacatgggcaaatgcacaccgtgcgattttcgaaacaataaagcacgcatggcaagaattgccacctcagcctttgcggattctcgtgttcaacggtaactggggcgcatacgaagcgtatcagatgttttccatggactacatagttccagagagcataaccatcgctgaaaccgctggaatgccgtatgtggcacaagcgtcatttgacagggatcatccggtgccatcagcgtcagtccatattagtggcatcaagtcctccattgaggtcgcatacgcggccaatcatgacgccgaccatgtcatcgattcctttttacaggctatgtacgccatagtacgctatgacacatccgtcttcaccacttcgctcactgctcccaatccaatcattcacgctccgttatgtctgctgaacatgacgaaaatcgaagccggtgccaattacaagatgctggtggaaggattcacggaaaaacagaacggctcatcctagctatcgatgacgaacgtaaagcgttagcgaacgcgcttggatgcaaatatattccaatcggcaaacagctcaatagcttctggggaagtagctatgcgaccctgcgggagctttttacaaacaattcattgtattcgcacgtccgcggccccgcgaacgtttcgcatcggttcatccatgaggatgtgccattcggcatcattccgctggtcaggcttggacacctgttagatgtccttacgccaaccagcgaggccttatcgactatctatagcatgtacctcaacgaatcgttcgacggtcccctgttcgatatagagatggttgaggcattgggaaaatgacgcgacgccgtttcctcccattcagactcatgcaacaacatgttcaatcatgttttccgagctaaacgtcatttcgccatcatcttgctgagaaattccttgattcggggcgactggggattatcgatgacctgttcgggggttccctcctcgatgatgttaccttgttccacgaaaacgacccgtgacgctacattccttgcaaaacggatttcatgggtcacaaggatcatcgtgacgccggtgccggcgacttttgtgatgacatcgttgacgtcgctgacgagttcgggatcaagggctgaagtgggttcatccagcagaatcacgtccgggcgaatcgcgagagcgcgagcgatggagacgcgctgctgctggcctccggacagctgcaccggatacctgtcctcatacccgtccatcccgacgcttgacagggctttcaacgctctttccctggcttcgttcttggcgacgccacgcacgacggtcagaccttgtgtgacgttgtccagaaccgtcttgttcttgaacagattgtagttctggaacaccatcgcggtcttgcggcgtagttcgagtatctgcttgttcggcactttgccgctgaaatcgatggtggttccatcgacgcggacgataccggcgtccggtctttccaaggcattcacgcagcgcaggagcgtggtcttaccggagccgcttggtccgaggatggccagcacctcgcctttgcgcacctccagatccacgcctttgaggatctcgttcccggaaaaggacttgcggattcctttcagcgaaacgaccgtttcgccggtatcatgtccagtcatacagcctgtttcctttcactgcttcttgaaacgcagcacgcataccggcttgccgtctgcgatggtgccttcgagggagaacttcacatgtgggaactgggccgcgaaggcgtggtcgccggccatggcgatctcgcataagcgggcgatctgctgcggattctttccttggcgtacccactgggtgacgtacgggcagtagtggaagtcgatctcgagctcgtcgtcggtcttcttgaccgtttccatctcgtaaatctcacggttgtggtctgtgccgaaattgtcgatgaactcttggaacgaatcgggatctttcagggtcttgcggaattccttggcgttgtcccttccgtaatcggctaccgcatcgtacgcgaattcgtcatcgaggcctcgcttcgaggcctcgtccaccatcctgctgatggtcgccgcgcggcgttccgagatttctcttgtggcgtcgacggtcttgctgcgcagatgaggagtgttgttttcgaatgccatgatcggccttcttccttgggtttgtttggttgttctgtctgaatgtccaatatttacgcgcgtgccggcttcaggaagaatccaacgcgtttgaagagtcgttccgacccaaattcgatggccgcgcacacgacccagtagatcagcgccgcatcgatgtatgcctctaagtactggtatccgtcggcggcactgatctgcgcggtgatgagcatttcggtcacgttgatcaacgaggctaggctcgtgcccttcagcaaccagatgaagtagttggtcatgcttggcagcgatatcacaaccgcctgcgggacaatgacgtgcagagccgtttgcagtccggtcatgccgacggactgcgcgctttcgatctggcctcggtccacggccttgaccgacgagacaaccacatcagttatgtaggcgccgaaattgcaggctatcgccactaccgccgcggggaaatacgagatgtgccgtggattgaagtcatagatgccgatggaaccgagccattttgccacgaacgggaccgcgtaatagcagaagagtagttgcacggcaagaggtacgcccttgatgaacgtgttgagagcgaccaccagctgtttgaacgccggggcgttggacaggatcacgcatccgaatatcagggcgatcagcagcgcgaacagcgtcgaccagaaagtgagtatcagggtcttcggcaatcccgccaaaacggtggggaagtccgtgaccatgaaatcatagtcgagttccatcaggcgtacctcctttcatagcgttccatacgatgtgaggcgaaggtgaagccgacctcgatcaatgagcacagcacgaagtagataatcgcaacgaggcctagtatccaaagctgtccggtgccgtattgtgcggatatgatcgctttggccgaaccaaggatctcgacggttccaatcgtgtaggcgaccgaagtgtccttgagcacgtctatctcgagattcttcagattgaggaccgcgaccttgagtgtctgaggggcgatgacgtggatgaagttctggactcggttgtagccgatgctcagccccgtctcgatctgccctttgtcgacgcccagatagcctcccctcaacgtctcgcagatgaagcatgaaagattcatggccgtcgcgatgatgaagaagaccccgggatcccagtcgtcgatatccaatccaaagaggtagaacaccttcggcaatccaaagaacacgaggtagatctgcacgattcccggagtgccgcggaaaaacgagatgaacaccgtgcacagccagtagagaacgttatgacgcccgaccctgacgatgcaaagcagagtgccgaagaacagggccagcaccgacggcacgatccagtacagcaaagtggccggtaggtactgcagtattctgggcagcacgcctgtcaacaggtcggacggcatgacgtttcacctcgttccgtcgggtcagtccttgagggcgccgagttcacgggccttctggaagttgtcctgcttgaagtacttctcgctgatcttgccgagggtgccgtccttgatcaaggcatcgatctgctcgtcgatggccttctgaacgtcgccgttcttcctgttgtacaggatcacggttcccgcggcgtccaccggatcggtcaccttgagcttgtagccaagcgtgtcggccacgccatcgtactgcgccttggacagatagaccgcatcgtaggtgccgtcatgcactgcgttgaacatgtcctggaaggtctcctgattggtaacggtgggaaccttaatcttgacatcgggattgcgcttgagccaattctgaatggccacgtaacgtccgtctgtcggaacgatcgggtcaagggtcttgccatcaagatccttcaggctctcaaccttgctgtcttccggaacgatgaggttcatgaagaaatagttatacggcttggaaagcagatactgcttggctcgggcgggggtctcgaagaacgcgccgatcagtgcgtcgtacttgccctgcttggtgccgatcagtgcggtctggtagtcgatgacgctgtattcgaacttgtagttgtcgagcttcttgtcgatggctttaagcacggtgaggtcgaaaccggccggattaccgttcttatccgcataggagtacggcggatcctgggactcgagaacgaatttaacggtcttgaccccgttgtcggattccttcgcgttcgcggtgccgcagccggccaacgcccccaacgagccgaccgccacaagtgccgcgaccaccgtggtgaacaatttgttccttctcatttgtcttcctctcttcggaaagcgttgtcgtgtatgtggcatgacggtacgccagaaaaacggggggaacaaaattctcggtcatatgttttgtttataggcagtgccaacagcgcgaattggagccggttgataactcgttataaccctctttcgtctcattattcgaaaccgtcgataacttttgtgcaggggtccgcagccacgctcgaaaacaggaaaaaactgaaagcacatttctgttcattgcgttttataccaagctcatatccgctataacgcagttcgatagcaagaataccgtgcgctaatcatcaacagggttgcaacatcaactatgttgttcatgacagtgcacttcccacatgcatgtattcgagatgatgcatgatttctgttctagccacgcaaaaatgaaataattcggaactcgaatctaagaagagccttcgccgcatgaccagcaccaaggcaatggtcttactggatgggttaccgaatagtgtccaacataaacggacgaatgttcccatccaaacatgtagacatcgtgtcccgttcatcatggatgggacatagacaatgttttcggcgctgtgcgccgtcgaaaagagcgggaagcggtttccgtgcggatattccagccggaaggagtcaccatggaacgggaaaacggtcagctaggggactggaattcggagcgttggacgcgtatgaggcccgccgacgccttcgcgcatcaacactatcgtccaatcaaggctggtctcacaccaaacagcccaataagcccagccatagtgtttggacagcttgccgacatagaggcgatagtatgagcgggagatgggactcgaaggggaacgagtggacgaatcttaggtttccgaatgggtttgcgcacccattcatgtctcagagccgcgacgggagtgcgcatgagcgtatgcttgtggtcatcccaaagggtgtcattctatcggatggccgcaacttgggcggttggaacctgagcgtgccggcatctccatgggcattgatgcagaagcgcactgggagacctgtgaacatcgggctgcgttccgaccagcccgtcgaactgttcaagggacgtggggccaagcggcaagtaatatcgctggccagccccgaggaactgcgcgccgcgctgaatgagcatcgcgacagaatgcttggtcaaaacaccgttcgtgacaagccggccgctattgcgtacaacgtaattccagcgtttggacaaggtgcggggggaggcctcgctgatgcggcccctcagtcatatgagccggcgaatgacgaaggtatgcgtctattcaatgatctcgctttcgatgtcggtttcgtctcgcggatggatatgctcgtatccggattcgcggacgattgcatccataaccgttacgatccggaagcggccttggacagaacccgctcgttgacagagcaggccactcgtcttctggaaccgttgtccggcgtggtcttcagcgatatggcaatcgattgcgccgcgaaccttgcattgtcggcagtgactgacgcgatcaatggttatatcaacgaactcacggatcgcggtgaaggcaatccatccattatcgcggcgaaccatgcggaatacgtcgaagacgcacaaacctgtctgaacacggagcgatgtttgcgcatgttcaccaccgcgtatggcaagacagcagaaactgatgtatttggcgacacgatgtccatcgagaacctatccatcggcccaaacatgatgacgcgattgagataggggagaatggtcaatcccaccgttccaacaacattcgactctttgaatccacctatctggctggacctgtttttagggaatcagccatcacgtcgatcaatagggaaggatcactttcaaccttgataagtattaccaaccaagccgatatcacggatattcacaatccgaaaaacaagcaccctaagatatcttccacatcgtgtgtattcgtcatccagatgttgagattgaacaaaatccaatttgtacttcttgtagcgaaacgatacgttgttttttgtgacaaaaaagttaccgtcagaagtgaatcacaaggagtgtgaatgctgaagagggtaaaggattggctacagcatagccacatctcataccgcaatctcgctgacgagatgaatcaatcggtgagcggcatttgcaaaaagcccgatggcaaaacctatggcccgtccacgatttgccctgactgaagacacatctggaccatccttacgactttgtcatcggcaatacgccgcggatgaaacagaggaatggaccagagacatcgcaccgtttgagggcagatgtcgaataactaaaaattaaaaagggaagtcccatcccatcggaaacgcaaaaccatcagggacagggcttgcatgcgaaccaatggtcggaaagcctgccggggcattccgatcgtcttacaccccctcgaggacgaagaaaggtccacatatattatgatagctgaaaccaccatccaaggcgtttccaacgtcaagtgtagattgcagatcagtactgaatggtacacattgtctacaacatccgacgaagcggttctgatgtcacgacactggtgtcgaagcatggcacggcacagactcataaccaccctaagtaaaccctataaatgttgcgccgaccattcaagtccgatgacggtatgcgtccgcgtcagacatgcagtttcgaaagaaaggagtgtggaaagagatagagccgtaggccgtaatccaaactcgcaacacggcgattgggacaactttggatgctcggtcaagcgcatcgcggacaacgtcgacaggttggagaacaagaacgaggagggcacaggctcatcggctgaggtggatttgcatacagaacgagggaagcgttccgcttcgatggctgcacacccctccgcaacccattccatcaatggggaagggaagcgttccgcttcgatggctgcacacccctccgcaacccattccatcaatggggaagggaagcgtctgtaatggaggccatgtatatcgtgttcgcggccgcggctctggtatgtctcggtctgttgttgccggtcttgtctcttatcgcgaccgtactgtcagcgctcgtcagcctgctaagaagcatcgccaagctgattggcggtggacgatgacagccgggactcttgagaaggtgtacagactaaacgatccaaaaatcagtccgacgatgggcgcggtactcgcatactacgccttccgctcctactacatggacggacgttgcgcgtggccgtcgcttaccacggtcgcgaaagcgtgtttctgcgacgagaagacggtccgccgagcgctggcccgcctatgcgagattggttacatgaggctcagccccgatcagtcatggaatgtgcgtgacacaaccaccggcgagctcaaacgcaggggatatcgcagcaaggtctatgacgtgcttgtggagaacttcgcctcaatggctgacgagggggcttccgaacgtgccggagaaatggtggaaaggcagaccggtcagaatgcccaccctgacgaaaacgttgaaagcatgccgattccacagaccggtcagaatgcccaccctcagaaaagcgacgaaaacgagagtggacatcctgtcccttcagaccggtcagaatgcccaactactaacaaaagaccaactagcaacccctctctccctacgggaaagctccccgcaggcgggaagcgcatcatcgaggagaagaggatggaacgtgtggaagacgccagcgccgatgtgtggagggtgatggatcgtctcgcttccgtccgttccaggctggcgctgtctacgtcgaaacctaccggacgggattttgcgagaacttcggatctcatcggacgtgttaccaaagccaatggtgataatcatgcggtcgcgatggctctgatcttcgacatcattgactggctgccggcgaacacacattggctcggacgcgttgattccgcacgccatcttgccgacaactgggaaggcatcgccaacgactggaccatcgtccagatcaaacgccgtcgcgaacacgacgaagccgcccggaaccaagatcggaaaacagtcgacaaacggtcgttgattcccgacagtcactcgagacgacacacgcattcgctcctttgcaagcatgtcatcgccgacatgaggccacacgaggatgaatacagccatgagggaagtctgcgctacggcaagccgtcagaatggcagaccgcgtgcatgcggcacgcggacaagctcaaccgacgagatggaatcaaggtgacggaatgaccggagaatccaatctcgtcaccggcgtctgctccggtcttccactaggcatccaggatctcatgtggggcaccgacaacgaacgaatcaaaagcacatccgaccagagggtcctgaaaagcaccgcgcgcatcctgtgcgacatgtgtcccatccaggcccagtgcctagcccaatccatcatcagccgcgagcagcacaacagaatcggcggcctcgatgtcaaggcgcgtcgcatactccgccggcacgccgaagctgatggagtgaatctgtcgccatcgagcccagcgcggacacggaatcttaccgtgtggctccgggagcatcccgaactcgtccgagaggtccgcacgcagtcgaccacccgtgaggggaggcggcgtagaagtgaggaccagtacatttatcggcatcgcaaagcgatgcgggaaaaggccggcgaagcatagggcatctgatgtgccgggcaggcctggtcccggcacgtcttatgtccatcgaacttgtagacaccgtgcaccgcggcgcgtccttcagcaatccaagatggaagcacgggaaacgacagagcaacgtccgattggaaaggctggcgggaatggcacaggcgacacggcagcaggtcaggaacatgcatgggctgattgaaaccatgaaggaacgcgaatacgttcctggtgagtcgaaaatcaccgacgaccgaatcaccgacacgttgaggggcatggccgaaccgaacgggctgacggatgcggtgatagccaagatcattcgcccagacatgggattcgacgagttcgagtccattgccgacttggaggaaaaggcctcgtatgacgtgttcgacacgcttcgtgccattatgctgccttccggctatgacgtgtcgcacgccatggcacgcgcgttcaaacaggatattccgcgccttttcgagcagttcgcgatactgatccatccggcgtcggagcgtgccggggcctatcgcatcgcggccaccatcagttatctcgaaggagattccacgattcgctgcaagcattttgcagatatgctgttccaggtcaagcccgaggacgagatgctccgtaatctctccaccgcgctgatccatggcgtggagccggatcggccatccggaatcgaagatccttccaacatccgaaaccagcggatggacaacgcgacgctcgggagcgactgccgccgaatccgcaacggctatccgataaaggaaaagagcatcatgaacgcggacaacgggtatct

(The sequence listing continues in the following parts.)

What is claimed is:

1. A method of treating a insulin insensitivity in a subject in need thereof, the method comprising: administering to the subject a pharmaceutical composition comprising a therapeutically-effective amount of a population of isolated and purified microbes with a rRNA sequence comprising at least about 85% sequence identity to a rRNA sequence from *Clostridium beijerinckii*, wherein at least one of said isolated and purified microbes comprises a microbe that alters glucagon-like peptide-1 (GLP-1) production in the subject, and a pharmaceutically-acceptable carrier.

2. The method of claim 1, wherein the population of isolated and purified microbes further comprises a microbe with a ribosomal RNA (rRNA) sequence comprising at least about 85% sequence identity to a rRNA sequence from *Akkermansia muciniphila*.

3. The method of claim 1, wherein the population of isolated and purified microbes further comprises a microbe with a rRNA sequence comprising at least about 85% sequence identity to a rRNA sequence from *Clostridium butyricum*.

4. The method of claim 1, wherein the population of isolated and purified microbes further comprises a microbe with a rRNA sequence comprising at least about 85% sequence identity to a rRNA sequence from *Eubacterium hallii*.

5. The method of claim 1, wherein the pharmaceutical composition is formulated for oral delivery.

6. The method of claim 1, wherein the pharmaceutical composition comprises an enteric-coating.

7. The method of claim 6, wherein the enteric coating dissolves at a pH greater than at least about pH 6.5.

8. The method of claim 1, wherein the pharmaceutical composition is delivered to a small intestine, an ileum, a large intestine, or a combination thereof of a human subject.

9. The method of claim 1, wherein the pharmaceutical composition further comprises a prebiotic.

10. The method of claim 9, wherein the prebiotic comprises inulin.

11. The method of claim 10, wherein the inulin is present in an amount of at least about 50 mg/ml in the pharmaceutical composition.

12. The method of claim 1, wherein said treating results in the subject having increased insulin sensitivity as compared to a pre-treatment level.

13. The method of claim 1, wherein the pharmaceutical composition is administered before food intake, with food intake, or a combination thereof by the subject.

14. The method of claim 1, wherein the therapeutically-effective amount of each purified and isolated microbe in the pharmaceutical composition is at least about $10^5$ colony forming units (CFU).

15. The method of claim 1, wherein the pharmaceutical composition is administered after completion of an antibiotic regimen by the subject.

16. The method of claim 1, wherein said population of isolated and purified microbes further comprises at least three additional different microbial strains, wherein each microbial strain comprises a rRNA sequence comprising at least about 85% sequence identity to a rRNA sequence of a microbe selected from the group consisting of: *Akkermansia muciniphila, Anaerostipes caccae, Bifidobacterium adolescentis, Bifidobacterium bifidum, Bifidobacterium infantis, Bifidobacterium longum, Butyrivibrio fibrisolvens, Clostridium acetobutylicum, Clostridium aminophilum, Clostridium butyricum, Clostridium colinum, Clostridium indolis, Clostridium orbiscindens, Enterococcus faecium, Eubacterium hallii, Eubacterium rectale, Faecalibacterium prausnitzii, Fibrobacter succinogenes, Lactobacillus acidophilus, Lactobacillus brevis, Lactobacillus bulgaricus, Lactobacillus casei, Lactobacillus caucasicus, Lactobacillus fermentum, Lactobacillus helveticus, Lactobacillus lactis, Lactobacillus plantarum, Lactobacillus reuteri, Lactobacillus rhamnosus, Oscillospira guilliermondii, Roseburia cecicola, Roseburia inulinivorans, Ruminococcus flavefaciens, Ruminococcus gnavus, Ruminococcus obeum, Streptococcus cremoris, Streptococcus faecium, Streptococcus infantis, Streptococcus mutans, Streptococcus thermophilus, Anaerofustis stercorihominis, Anaerostipes hadrus, Anaerotruncus colihominis, Clostridium sporogenes, Clostridium tetani, Coprococcus, Coprococcus eutactus, Eubacterium cylindroides, Eubacterium dolichum, Eubacterium ventriosum, Roseburia faeccis, Roseburia hominis, Roseburia intestinalis*, and any combination thereof.

* * * * *

UNITED STATES PATENT AND TRADEMARK OFFICE
CERTIFICATE OF CORRECTION

PATENT NO. : 9,486,487 B2  
APPLICATION NO. : 15/139097  
DATED : November 8, 2016  
INVENTOR(S) : Cutcliffe Page 1 of 1

It is certified that error appears in the above-identified patent and that said Letters Patent is hereby corrected as shown below:

In the Claims

Column 63, Line 2, Claim 1:
Delete "treating a insulin insensitivity" and insert --treating insulin insensitivity--

Signed and Sealed this
Twenty-fifth Day of April, 2017

Michelle K. Lee
*Director of the United States Patent and Trademark Office*